United States Patent 12,569,549 (FLAVIVIRUS VACCINE) - sequence listing, part 56

SEQ ID NO: 19840 - RNA, 9876 nt, synthetic construct
  misc_feature 1..9876: note = derived and/or modified CDS sequence (opt5) from DENV-2__KC294208__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccaaatccagcctcactggattgcggcctctatcattcttgagttctttctgatcgtgctcctgattcccgaacccgagaaacagcggacccctcaggataaccaactgacatacgttgtgatcgctatcctcaccgtcgtggccgctacaatggccaatgaaatggggttccttgagaagacgaagaaagacctgggatttggctccattaccacacaggagagcgaatccaacatcctggacattgatctcagaccggcgtctgcctggaccctgtatgctgtcgccacaaccttcgtgacgcccatgcttcggcatagcatcgaaaatagctctgttaacgtgagcctgaccgctattgccaatcaggctacagtgctcatggggctgggaaagggctggcctctgtccaaaatggacatcggggtccccctccttgccattggatgttacagccaggttaaccctatcaccctgacagcggccctgctcctgcttgtggctcactacgccatcattggccccggcctgcaagctaaggccacccgcgaagcccagaaaagagcggctgccgggatcatgaagaatcctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctctacgctttgggagggagaccctggccgcttctggaacaccacaattgctgtctccatggccaatatctttagagggagctacctggcgggagccggcctcctgttctctattatgaagaacaccacaaatacccggcgcggcacggggaacgtgggagaaacactgggcgagaaatggaagtccagactcaatgctcttgggaaaagcgaatttcagatctataagaaatctggcattcaggaggtcgatcggaccctggccaaggagggcatcaagcgcggggaaaccgaccatcacgctgtgagcagaggatccgccaaactgcggtggttcgttgagagaaacatggtgacacccgaaggcaaggtcgtggatctcggctgcgggcgcggaggctggtcttactattgtgggggactgaaaaacgttcgggaggtgaagggccttaccaaagggggaccgggccatgaggaacctatccccatgagcacatacggctggaatctggtcagactccaatccggggtggacgtgttctttacgccccctgagaagtgcgataccctgctgtgtgacattggagaaagctcccccaaccctacaatcgaggcgggccgcaccctccgggttcttaatctggtcgaaaactggctgaataacaatacacagttctgcattaaggtgctcaacccgtatatgccctctgtgatcgagaaaatggaaaccctgcagagaaagtacgggggagcccttgtccgcaatcctctgagccggaactccacgcacgagatgtactgggtttctaatgctaccggcaacattgtgagctccgtgaatatgatctctagaatgctcatcaaccgctttacaatgaaacacaagaaagccacctatgagcccgatgtcgacctggggagcggaacacggaatattggcatcgaatccgagattcctaacctggacatcgtgggcaagagaattgaaaagatcaaacaggagcatgaaaccagctggcactacgatcaagaccatccctataagacatgggcttaccacgggtcttatgagaccaaacagacgggatccgccagctctatggttaacggcgtggtccgcctccttacaaagccgtgggatgtggttcctatggtgacccagatggctatgaccgacacaacgcccttcgggcagcaacgggtctttaaagagaaggtggataccagaacacaggaacctaaggagggaaccaaaaagctgatgaaaattacagccgaatggctgtggaaggagctcggcaaagagaagacaccccgcatgtgtacaagagaagagttcacccggaaagtgcgctccaatgcggccctgggggctgtctttacggacgaaaacaagtggaaaagcgccagagaggctgttgaagatggacggttctgggagcttgtggacagagagcggaatctgcacctcgaaggcaaatgcgagacctgtgtgtacaacatgatgggcaagcgcgagaagaagctgggggagtttggaaaagccaagggctctagagccatctggtatatgtggctgggggcgcggttcctcgaatttgaggctctgggattccttaatgaggatcattggttttcccgcggcaacagcctgtccggggtcgaaggcgagggactccacagactgggctacatccttcgggaagtggggaagaaagagggaggcgccatgtacgccgacgatacagctgggtgggacacccgcattacactggaagacctcaagaatgaggagatggttaccaaccatatgaaaggagaacacaagaaactggccgaggctatcttcaagctgacgtatcagaataaggtggtcagagtgcagcggcctacaccccgcggcaccgttatggatattatcagcagaaaagaccaacgggggtctggccaggtgggaacatacggcctcaacaccttcacgaatatggaagcccagctgattcgccaaatggagggggagggaatctttaagagcatccagcatcttaccgcgacagaagagattgccgtccagaactggctggctagagtgggccgggaacgcctctccagaatggccatctctggggatgactgcgttgtgaaaccgattgatgaccggttcgctagcgccctgaccgcgcttaatgatatgggaaaggtcagaaaagacatccagcaatgggagccttcccgcggctggaacgattggacacaggtgcccttttgctctcaccacttccatgaactggtcatgaaggacgggcgggtgctcgttgtgccctgtagaaatcaggatgagctgattggccgcgcccggatcagccagggagctggctggtccctgaaggagaccgcctgcctcgggaaatcttatgctcaaatgtggacactgatgtactttcacagacgcgaccttcggctggccgctaacgccatctgtagcgcggtcccttcccattgggtgccgaccagcagaacgacatggtctattcacgccaagcacgaatggatgaccaccgaggatatgctcgtggtttggaaccgcgtgtggatccaggaaaatccctggatggaggacaaaacacctgtcgaatcctgggaggaggtgccctatctgggaaagcgggaagaccagtggtgcggcagccttattgggctgacctctagagctacatgggccaaaaacatccagacggccattaatcaagttcgctccctcatcggaaacgagggctacaccgattatatgcctagcatgaagcggttcagacgggaagaggaagaggctggggtgctgtggtga

SEQ ID NO: 19841 - RNA, 9876 nt, synthetic construct
  misc_feature 1..9876: note = derived and/or modified CDS sequence (opt5) from DENV-2__KC294209__SS-prME
  source 1..9876: mol_type = other RNA
accgccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggagtgggcaagatgacactgggcatgtgctgcattatcaccgctagcattctcctgtggtatgcccaaatccagcctcactggatcgcggcctctattatccttgagttctttctgattgttctcctgatccccgaacccgagaaacagcggacccctcaggataaccaactgacatacgtggtcattgctatcctcaccgtggtcgccgctacaatggccaatgaaatggggttccttgagaagacgaagaaagacctgggatttggctccatcaccacacaggagagcgaatccaacattctggacatcgatctcagaccggcgtctgcctggaccctgtatgctgtggccacaaccttcgttacgcccatgcttcggcatagcattgaaaatagctctgtgaacgtgagcctgaccgctatcgccaatcaggctacagtcctcatggggctgggaaagggctggcctctgtccaaaatggacattggggttcccctccttgccatcggatgttacagccaggtgaaccctattaccctgacagcggccctgctcctgcttgtggctcactacgccatcatcggccccggcctgcaagctaaggccacccgcgaagcccagaaaagagcggctgccgggattatgaagaatcctacggtcgatggaatcacagtgattgacctcgagccgatcccctatgatcctaagtttgaaaaacagctgggccaggttatgctgctcattctttgcgtgacccaagtcctgatgatgcggacaacctgggctctgtgtgaggccctcaccctggccacagggcccatctctacgctttgggagggaaaccctggccgcttctggaataccacaatcgctgtgtccatggccaacatttttagagggagctacctggcgggagccggcctcctgttctctatcatgaagaataccacaaacacccggcgcggcacggggaatgtcggagaaacactgggcgagaaatggaagtccagactcaacgctcttgggaaaagcgaatttcagatttataagaaatctggaatccaggaggtggaccggaccctggccaaggagggcattaagcgcggggaaaccgatcatcacgctgttagcagaggatccgccaaactgcggtggttcgtggagagaaacatggtcacacccgaaggcaaggtggttgacctcggctgcgggcgcggaggctggtcttactattgtgggggactgaaaaatgtgcgggaggtcaagggccttaccaaagggggaccgggccatgaggaacctatccccatgagcacatacggctggaacctggtgagactccaatccggggtggatgttttctttacgccccctgagaagtgcgacaccctgctgtgtgatatcggagaaagctcccccaatcctacaattgaggcgggccgcaccctccgggtccttaacctggtggaaaattggctgaacaataacacacagttctgcatcaaggtgctcaatccgtatatgccctctgtcattgagaaaatggaaaccctgcagagaaagtacgggggagcccttgttcgcaaccctctgagcagaaattccacgcacgagatgtactgggtgtctaacgctaccggcaatatcgtgagctccgtcaacatgatttctagaatgctcatcaatcgctttacaatgaaacacaagaaagccacctatgagcccgacgtggatctggggagcggaacacggaacatcggcattgaatccgagatccctaacctggacattgttggcaagagaatcgaaaagattaaacaggagcatgaaaccagctggcactacgaccaagatcatccctataagacatgggcttaccacgggtcttatgagaccaaacagacgggatccgccagctctatggtgaatggcgtcgtgcgcctccttacaaagccgtgggacgttgtgcctatggtcacccagatggctatgaccgatacaacgcccttcgggcagcaacgggtgtttaaagagaaggtggacaccagaacacaggaacctaaggagggaaccaaaaagctgatgaaaatcacagccgaatggctgtggaaggagctcggcaaagagaagacaccccgcatgtgtacaagagaagagttcacccggaaagtccgctccaacgcggccctgggggctgtttttacggatgaaaataagtggaaaagcgccagagaggctgtggaagacggacggttctgggagcttgtggatagagagcggaacctgcacctcgaaggcaaatgcgagacctgtgtctacaatatgatgggcaagcgcgagaagaagctgggggagtttggaaaagccaagggctctagagccatttggtatatgtggctgggggcgcggttcctcgaatttgaggctctgggattccttaacgaggaccattggttttcccgcggcaatagcctgtccggggtggaaggcgagggactccacagactgggctacatccttcgggaagttgggaagaaagagggaggcgccatgtacgccgatgacacagctgggtgggatacccgcatcacactggaagacctcaagaacgaggagatggtgaccaatcatatgaaaggagaacacaagaaactggccgaggctattttcaagctgacgtatcagaacaaggtcgtgagagttcagcggcctacaccccgcggcaccgtgatggacatcattagcagaaaagatcaacgggggtctggccaggtcggaacatacggcctcaataccttcacgaacatggaagcccagctgatccgccaaatggagggggagggaatttttaagagcatccagcatcttaccgcgacagaagagatcgccgtgcagaattggctggctagagttggccgggaacgcctctccagaatggccatttctggggacgattgcgtggtcaaaccgatcgacgatcggttcgctagcgccctgaccgcgcttaacgacatgggaaaggtgagaaaagatattcagcaatgggagccttcccgcggctggaatgactggacacaggtccccttttgctctcaccacttccatgaactggtgatgaaggatgggcgggttctcgtggtcccctgtagaaaccaggacgagctgatcggccgcgcccggattagccagggagctggctggtccctgaaggagaccgcctgcctcgggaaatcttatgctcaaatgtggacactgatgtactttcacagacgcgatcttcggctggccgctaacgccatctgtagcgcggtgccttcccattgggtgccgaccagcagaacgacatggtctatccacgccaagcacgaatggatgaccaccgaggacatgctcgttgtgtggaatcgcgtctggattcaggaaaacccctggatggaggataaaacacctgtggaatcctgggaggaggttccctatctgggaaagcgggaagaccagtggtgcggcagccttatcgggctgacctctagagctacatgggccaaaaatattcagacggccatcaaccaagtgcgctccctcattggaaatgagggctacaccgactatatgcctagcatgaagcggttcagacgggaagaggaagaggctggggtcctgtggtga

SEQ ID NO: 19842 - RNA, 9876 nt, synthetic construct
  misc_feature 1..9876: note = derived and/or modified CDS sequence (opt5) from DENV-2__KC294214__SS-prME
  source 1..9876: mol_type = other RNA
acagccggagtgatcgtgatgctgattcccacagctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggagaaataaggaactcaaatgcggctccgggatcttcattacggataacgttcacacctggacagagcagtacaagtttcaacctgaaagcccctccaagctggcttctgccatccagaaagctcatgaggaaggcatttgtggaatccgcagcgtgacccggcttgagaatctgatgtggaagcagatcacaccggagctcaaccacattctgtccgaaaatgaggtcaaactgaccatcatgacgggcgacattaaggggatcatgcaggccggaaaaagatctcttcgccctcaacccaccgaactcaagtatagctggaaaacatggggcaaggcgaagatgctgtccaccgagagccataaccagacattcctgattgatgggcctgaaaccgccgagtgccccaatacaaaccgggcttggaactctctcgaggtggaagactacggatttggcgttttcaccacgaacatctggctgaaacttagagagaagcaggacgtgttttgtgattccaaactgatgagcgccgctatcaaggacaatcgcgccgtccacgcggatatgggctattggattgaatctgccctcaacgacacatggaaaatggagaaggcttccttcatcgaggtcaagagctgccactggcctaaatctcataccctgtggagcaatggggttctggaatccgagatgattatccccaagaacttcgccggaccggtgagccagcacaactaccggcctggctatcatacccaaacagctgggccctggcaccttggaaaactcgaaatggattttgacttctgtgagggcaccacggtcgtggtgacagaagattgcgggaatagaggaccctctctgcggaccacaaccgcctccggcaagctgattacagagtggtgctgtcgcagctgcaccctccctccgctgagataccggggcgaggacgggtgttggtacggaatggaaatcagaccccttaaagagaaggaagagaacctggtcaattccctcgttacggccggccatgggcagattgataacttttctctgggagtgctgggcatggctcttttcctcgaagagatgctgcgcacccgggtggggacaaagcacgcgatcctgctcgtcgccctgagctttgtgacccttatcacaggaaatatgtccttcagagacctgggccgcgttatggtgatggtcggcgctaccatgacggatgacattgggatgggagtgacatatctcgccctgctggccgcttttaaagttagacctaccttcgccgcgggccttctgctccggaagctgacatctaaagagctcatgatggctaccatcgggattgccctgcttagccagtccaccctgcccgaaacaatcctcgagctgacggatgccctggctcttggaatgatggccctgaagattgtgcgcaacatggaaaaataccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaggctgactggattcctctcgccctgacaatcaaaggcctgaatcccaccgcgatttttcttacgacactgagcagaacctctaagaaacggtcctggccgctcaacgaggccatcatggctgtggggatggtcagcatcctggcctcttccctcctgaagaatgacattcctatgaccggaccccttgttgctggcggcctgctgacagtgtgctatgtgctcaccgggcgcagcgccgatctggaacttgagagagccgctgacgtcaaatgggaggatcaagcggaaatctccggaagctctcctattctgagcatcacaatttccgaggacggctctatgagcatcaagaacgaagaggaggaacagacgctcaccattctgatccggacagggctcctggtgatctccggagttttccccgtgtctattccgatcaccgccgctgcctggtacctttgggaggtcaaaaagcagcgcgccggcgtgctgtgggatgttccttctccccctcccgtggggaaggctgaactggaggacggagcctatagaattaaacagcggggcatcctcggctactcccaaattggggcgggagtctataaggaaggcacatttcacaccatgtggcatgtgacgcgcggggctgtcctgatgcacagaggaaaacggatcgagccctcctgggccgatgtgaagaaagaccttatcagctacggcgggggatggaagctggagggcgaatggaaggagggcgaagaggttcaggtgctcgccctggaacctgggaaaaatccgagagctgtccagaccaagcccggaattttcaaaacaaacaccggcacaatcggggccgtgtccctcgattttagccctggaacctctggctcccccattgttgaccgcaaggggaaagtggtcggactgtacggcaatggcgtggtgacacggagcggggcgtatgtttctgctatcgcccagacggagaagtccattgaggataaccctgaaatcgaggacgatatcttcagaaagaaacgccttaccattatggacctgcatcccggagccggcaagacaaaacggtacctgcctgctatcgtcagagaagccattaagcgcgggctccggaccctgatccttgctccgaccagagtggtggccgcggagatggaagaggccctgcgcggactccccattcggtatcaaacccctgctatcagagccgagcacacgggccgggaaattgtcgacctgatgtgtcatgctaccttcacaatgcgcctcctgagccccgtgagagttcctaactacaatcttatcatcatggatgaggcccactttaccgaccccgcctccattgctgcgcgggggtatatctctacacgcgtggaaatgggcgaggccgctggaattttcatgaccgccacgccgcctggcagcagagatccctttccccagtccaacgcccctatcatggacgaggaacgggagattcccgaaagaagctggaactctgggcacgagtgggtcacagatttcaaaggaaagaccgtgtggtttgttccttccatcaaggctggcaacgacatcgccgcgtgcctgcgcaaaaatgggaagaaagtgattcagctgagccggaagaccttcgattctgaatacgtcaaaacaagagctaacgactgggattttgtggttaccacagacatcagcgagatgggagccaatttcaaggccgagcgcgtgattgatccgcggagatgtatgaagcccgtcatcctcaccgacggcgaagaaagagtgattctggctgggcctatgcccgtgacgcattcctctgccgcgcaacggagaggccgcatcggaagaaaccctaaaaatgaaaacgaccagtatatctacatgggcgagccccttgaaaatgatgaggactgcgcccactggaaggaggctaaaatgctgctcgataacattaatacaccggaagggatcattcctagcatgtttgagcccgaacgggagaaggtcgacgccatcgatggagaataccgcctgagaggcgaggctcggaaaaccttcgttgacctgatgcgcagaggggatctccctgtgtggcttgcctataaggtggctgccgagggaattaactacgcggaccggaaatggtgttttgatggcatcaagaataaccagattctggaagagaacgtcgaagtggagatctggacaaaggagggggaacgcaagaagctgaaaccccgctggctcgacgcccggatctattccgatcctctggctcttaaggagttcaaagagttcgccgctggcagaaagtctctgaccctcaatctgattacggagatgggacgcctgcccacctttatgacacagaaggcccggaacgccctcgacaatcttgctgttctgcataccgcggaagtgggcgggaaagcctacacacacgctctgagcgagctcccggagaccctggaaacacttctgctcctgaccctgctcgccgccgtcacgggaggcatcttcctttttctgatgtccgggaagggaattggcaaaatgacactgggcatgtgctgcatcattaccgctagcatcctcctgtggtatgcccaaatccagcctcactggattgcggcctctatcattcttgagttctttctgatcgtgctcctgattcccgaacccgagaagcagagaacccctcaggataaccaactgacatacgttgtgatcgctatcctcaccgtcgtggccgctacaatggccaatgaaatggggttccttgagaaaacgaagaaggacctgggatttggctccattaccacacaggagagcgaatccaacatcctggacattgatctccggccggcgtctgcctggaccctgtatgctgtcgccacaaccttcgtgacgcccatgcttcgccatagcatcgagaatagctctgttaacgtgagcctgaccgctattgccaatcaggctacagtgctcatggggctgggaaaaggctggcctctgtccaagatggacatcggggtccccctccttgccattggatgttacagccaggttaaccctatcaccctgacagcggccctgctcctgcttgtggctcactacgccatcattggccccggcctgcaagctaaagccaccagagaagcccagaagcgggcggctgccgggatcatgaaaaatcctacggtggatggaattacagtcatcgacctcgagccgattccctatgatcctaagtttgaaaagcagctgggccaggtgatgctgctcatcctttgcgttacccaagtgctgatgatgcgcacaacctgggctctgtgtgaggccctcaccctggccacagggcccatctctacgctttgggagggaaaccctggcagattctggaataccacaattgctgtctccatggccaacatctttcgggggagctacctggcgggagccggcctcctgttctctattatgaaaaataccacaaacacccgcagaggcacggggaatgtgggagaaacactgggcgagaagtggaaatcccggctcaacgctcttggaaagagcgaatttcagatctataaaaagtctggcattcaggaggtcgaccgcaccctggccaaagagggcatcaagagaggggaaaccgatcatcacgctgtgagccggggatccgccaagctgagatggttcgttgagcgcaacatggtgacacccgaaggcaaagtcgtggacctcggctgcgggcggggaggctggtcttactattgtgggggactgaagaatgttagagaggtgaaaggccttaccaaagggggaccgggccatgaggagcctatccccatgagcacatacggctggaacctggtccgcctccaatccggggtggatgtgttctttacgccccctgagaaatgcgacaccctgctgtgtgatattggagaaagctcccccaatcctacaatcgaggcgggccggaccctcagagttcttaacctggtcgaaaattggctgaacaataacacacagttctgcattaaggtgctcaatccgtatatgccctctgtgatcgagaagatggaaaccctgcagcgcaaatacgggggagcccttgtccggaaccctctgagcagaaattccacgcacgagatgtactgggtttctaacgctaccggcaatattgtgagctccgtgaacatgatctctcgcatgctcatcaatcggtttacaatgaagcacaaaaaggccacctatgagcccgacgtcgatctggggagcggaacaagaaacattggcatcgaatccgagattcctaacctggacatcgtgggcaaacgcattgaaaagatcaagcaggagcatgaaaccagctggcactacgaccaagatcatccctataaaacatgggcttaccacgggtcttatgagaccaagcagacgggatccgccagctctatggttaatggcgtggtccggctccttacaaaaccgtgggacgtggttcctatggtgacccagatggctatgaccgatacaacgcccttcgggcagcaaagagtctttaaggagaaagtggacacccgcacacaggaacctaaggagggaaccaagaaactgatgaagattacagccgaatggctgtggaaagagctcggcaaggagaaaacccccagaatgtgtacacgggaagagttcacccgcaaggtgagatccaacgcggccctgggggctgtctttacggatgaaaataaatggaaaagcgcccgggaggctgttgaagacggaagattctgggagcttgtggatcgggagcgcaacctgcacctcgaaggcaagtgcgagacctgtgtgtacaatatgatgggcaaaagagaaaagaaactgggggagtttggaaaggccaaaggctctcgggccatctggtatatgtggctgggggcgcgcttcctcgaatttgaggctctgggattccttaacgaggaccattggttttccagaggcaatagcctgtccggggtcgaaggcgagggactccaccggctgggctacatccttcgcgaagtggggaagaaggagggaggcgccatgtacgccgatgacacagctgggtgggataccagaattacactggaagacctcaaaaacgaggagatggttaccaatcatatgaagggagaacacaaaaagctggccgaggctatcttcaaactgacgtatcagaacaaggtggtccgggtgcagcgccctacacccagaggcaccgttatggacattatcagccggaaggatcaacgcgggtctggccaggtgggaacatacggcctcaataccttcacgaacatggaagcccagctgattagacaaatggagggggagggaatctttaaaagcatccagcatcttaccacaaccgaagagattgcggtccagaattggctggcccgggtgggccgcgaaagactctcccggatggctatctctggggacgattgcgttgtgaagccgattgacgatagattcgccagcgctctgacagcccttaacgacatgggaaaagtccgcaaggatatccagcaatgggagccttcccggggctggaatgactggacccaggtgcccttttgctctcaccacttccatgaactggtcatgaaagatgggagagtgctcgttgtgccctgtcgcaaccaggacgagctgattggccgggcgagaatcagccagggagccggctggtccctgaaggagacagcttgcctcgggaagtcttatgcccaaatgtggaccctgatgtactttcaccgccgggatcttagactggctgccaacgctatctgtagcgccgtcccttcccattgggtgccgacgagccgcacaacctggtctattcacgcgaaacacgaatggatgaccacagaggacatgctcgtggtttggaatcgggtgtggatccaggaaaacccctggatggaggataagacccctgtcgaatcctgggaggaggtgccctatctgggaaaaagagaagaccagtggtgcggcagccttattgggctgacatctcgcgccacgtgggctaagaatatccagaccgccattaaccaagttcggtccctcatcggaaatgagggctacacagactatatgcctagcatgaaaagattccggagagaagaggaagaggccggggtgctgtggtga

SEQ ID NO: 19843 - RNA, 9876 nt, synthetic construct
  misc_feature 1..9876: note = derived and/or modified CDS sequence (opt5) from DENV-2__KC294205__SS-prME
  source 1..9876: mol_type = other RNA
acagccggagtgatcgtcatgctgattcccacagctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaagacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccaccagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaggcggaaatctccggaagctctcctattctgagcatcacaatttccgaggacggctctatgagcatcaaaaacgaagaggaggaacaaacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccagattggggcgggagtctataaagaaggcacatttcataccatgtggcacgtgacgagaggggctgtcctgatgcatcgcggaaagagaatcgagccctcctgggccgatgtgaaaaaggaccttatcagctacggcgggggatggaagctggagggcgaatggaaagagggcgaagaggttcaagtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcaccccggagccggcaaaacaaagcgctacctgcctgctatcgtccgggaagccattaaaagagggctccgcaccctgatccttgctccgacccgggtggtggccgcggagatggaagaggccctgagaggactccccattcgctatcagacccctgctatccgggccgagcatacgggcagagaaattgtcgacctgatgtgtcacgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccaatccaacgcccctatcatggacgaggaaagagagattcccgaacggagctggaactctgggcatgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcactcctctgccgcgcagcgccggggcagaatcggacgcaaccctaagaatgaaaacgaccaatatatctacatgggcgagccccttgaaaatgatgaggactgcgcccattggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcacaccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccagatccaacctcattggattgcggcctctatcattcttgagttctttctgatcgtgctcctgattcccgaacccgagaaacagcggacccctcaggataaccagctgacatacgttgtgatcgctatcctcaccgtcgtggccgctacaatggccaatgaaatggggttccttgagaagacgaagaaagacctgggatttggctccattaccacacaagagagcgaatccaacatcctggacattgatctcagaccggcgtctgcctggaccctgtatgctgtcgccacaaccttcgtgacgcccatgcttcggcacagcatcgaaaatagctctgttaacgtgagcctgaccgctattgccaatcaggctacagtgctcatggggctgggaaagggctggcctctgtccaaaatggacatcggggtccccctccttgccattggatgttacagccaggttaaccctatcaccctgacagcggccctgctcctgcttgtggctcattacgccatcattggccccggcctgcaggctaaggccacccgcgaagcccagaagcgggcggctgccgggatcatgaagaatcctacggtggatggaattacagtcatcgacctcgagccgattccctatgatcctaagtttgaaaaacagctgggccaggtgatgctgctcatcctttgcgttacccaggtgctgatgatgcggacaacctgggctctgtgtgaggccctcaccctggccacagggcccatctctacgctttgggagggaaaccctggccgcttctggaataccacaattgctgtctccatggccaacatctttagagggagctacctggcgggagccggcctcctgttctctattatgaagaataccacaaacacccggcgcggcacggggaatgtgggagaaacactgggcgagaaatggaagtccagactcaacgctcttgggaaaagcgaatttcaaatctataagaaatctggcattcaggaggtcgaccggaccctggccaaggagggcatcaagcgcggggaaaccgatcaccatgctgtgagcagaggatccgccaaactgcggtggttcgttgagagaaacatggtgacacccgaaggcaaggtcgtggacctcggctgcgggcgcggaggctggtcttactattgtgggggactgaaaaatgttcgggaggtgaagggccttaccaaagggggaccgggccacgaggaacctatccccatgagcacatacggctggaacctggtcagactccagtccggggtggatgtgttctttacgccccctgagaagtgcgacaccctgctgtgtgatattggagaaagctcccccaatcctacaatcgaggcgggccgcaccctccgggttcttaacctggtcgaaaattggctgaacacaaatacccaattctgcattaaggtgctcaacccgtatatgccctctgtgatcgagaaaatggaaacgctgcagagaaagtacgggggagcccttgtccgcaatcctctgagccggaactccacccacgagatgtactgggtttctaatgctacaggcaacattgtgagctccgtgaatatgatctctagaatgctcatcaaccgctttaccatgaaacataagaaagccacatatgagcccgacgtcgatctggggagcggaacccggaatattggcatcgaatccgagattcctaacctggacatcgtgggcaagagaattgaaaagatcaaacaggagcacgaaacaagctggcattacgaccaggatcacccctataagacctgggcttaccacgggtcttatgagacgaaacaaacaggatccgccagctctatggttaacggcgtggtccgcctccttaccaagccgtgggacgtggttcctatggtgacccagatggctatgacagatacgacccccttcgggcagcagcgggtctttaaagagaaggtggacacaagaacccaagaacctaaggagggaaccaagaagctgatgaaaattaccgccgaatggctgtggaaggagctcggcaaagagaagacaccccgcatgtgtaccagagaagagttcacgcggaaagtgcgctccaatgcggccctgggggctgtctttaccgatgaaaacaagtggaaaagcgccagagaggctgttgaagacggacggttctgggagcttgtggatagagagcggaatctgcatctcgaaggcaaatgcgagacatgtgtgtacaacatgatgggcaagcgcgagaagaagctgggggagtttggaaaagccaagggctctagagccatctggtatatgtggctgggggcgcggttcctcgaatttgaggctctgggattccttaatgaggaccactggttttcccgcggcaacagcctgtccggggtcgaaggcgagggactccatagactgggctacatccttcgggaagtggggaagaaagagggaggcgccatgtacgccgatgacaccgctgggtgggatacacgcattaccctggaagacctcaagaatgaggagatggttacgaaccacatgaaaggagaacataagaaactggccgaggctatcttcaagctgacatatcagaataaggtggtcagagtgcagcggcctacaccccgcggcacagttatggacattatcagcagaaaagatcagcgggggtctggccaagtgggaacctacggcctcaacacgttcaccaatatggaagcccagctgattcgccagatggagggggagggaatctttaagagcatccaacaccttacagcgaccgaagagattgccgtccagaactggctggctagagtgggccgggaacgcctctccagaatggccatctctggggacgattgcgttgtgaaaccgattgacgatcggttcgctagcgccctgacagcgcttaatgacatgggaaaggtcagaaaagatatccagcagtgggagccttcccgcggctggaacgactggacccaagtgcccttttgctctcaccatttccacgaactggtcatgaaggatgggcgggtgctcgttgtgccctgtagaaatcaggacgagctgattggccgcgcccggatcagccagggagctggctggtccctgaaggagacagcctgcctcgggaaatcttatgctcagatgtggaccctgatgtactttcatagacgcgatcttcggctggccgctaacgccatctgtagcgcggtcccttcccactgggtgccgacgagcagaacaacctggtctattcacgccaagcatgaatggatgaccacagaggacatgctcgtggtttggaaccgcgtgtggatccaagaaaatccctggatggaggataaaacccctgtcgaatcctgggaggaggtgccctatctgggaaagcgggaagaccagtggtgcggcagccttattgggctgacatctagagctacgtgggccaaaaacatccagaccgccattaatcaggttcgctccctcatcggaaacgagggctacacagactatatgcctagcatgaagcggttcagacgggaagaggaagaggctggggtgctgtggtga

SEQ ID NO: 19844 - RNA, 9876 nt, synthetic construct
  misc_feature 1..9876: note = derived and/or modified CDS sequence (opt5) from DENV-2__KC294210__SS-prME
  source 1..9876: mol_type = other RNA
acagccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcatgatggagagctctccccggaccggccttgatttcaacgaaatggtgctgctccaaatggaggacaaggcttggctggttcaccgccagtggtttcttgatctgccgctcccttggctgcccggggccgacacacagggatccaattggatccagaaggagaccctggtgacgttcaagaaccctcatgctaaaaagcaagacgtcgtggttctcggcagccaggaaggggccatgcacacagccctgaccggcgctacagagattcagatgtcctctggaaatcttctgtttaccggccatctcaaatgtagactgcggatggataaacttcaactgaaagggatgagctactccatgtgcaccggaaagttcaagatcgtgaaagaaattgcggagacacagcacggcacgatcgtcatcagagtgcagtatgagggggacggaagcccctgtaagattcccttcgaaatcaccgatctcgagaaacgccatgtcctgggccggctgattacagtgaaccctatcgttaccgaaaaggactctccggtgaacattgaggccgaacccccttttggggattcctacatcattgtcggcgtggagcccggacagctcaaactgaattggttcaagaagggcagctctatcgggcaaatgtttgagacaaccatgagaggagctaaacgcatggccatccttggcgacacggcctgggatttcgggagcctgggaggcgtttttacatccattgggaaggctctccaccaggtgttcggcgccatctacggagcggctttttctggcgtcagctggaccatgaaaattctgatcggggtgattatcacctggatcggaatgaactcccggagcacatctctgtccgtgagccttgttctcgtcggcgtggtgaccctgtatctgggggccatggtccaggccgactctggatgcattgtgtcctggaagaataaagaactcaagtgtggcagcgggatcttcattacagataacgttcacacgtggaccgagcagtacaagtttcaacctgaatccccctctaaactggctagcgccatccagaaggctcatgaggaaggcatttgcggaatcagatccgtgacacgccttgagaatctgatgtggaaacagatcaccccggagctcaaccacattctgtctgaaaatgaggtcaagctgacaatcatgaccggcgacattaaagggatcatgcaggccggaaagcggagccttagacctcaacccacggaactcaaatattcctggaagacctggggcaaggcgaaaatgctgagcacagagtctcataaccagaccttcctgattgatgggcctgaaacagccgagtgtcccaataccaaccgcgcttggaactccctcgaggtggaagactacggatttggcgttttcacaaccaacatctggctgaaacttcgggagaaacaggacgtgttttgcgatagcaagctgatgtctgccgctatcaaagacaatagagccgtccacgcggatatgggctattggattgaatccgccctcaacgacacgtggaagatggagaaggctagcttcatcgaggtgaaatcttgtcactggcctaagagccatacactgtggtccaatggggttctggaaagcgagatgattatccccaaaaacttcgccggaccggtgtctcagcacaactaccgccctggctatcatacccaaaccgctgggccctggcaccttggaaagctcgaaatggattttgacttctgcgagggcacaaccgtcgtggtgacggaagattgtgggaatcggggaccctccctgagaacaaccacagccagcggcaaactgattaccgagtggtgctgccggtcctgtacactccctccgctgcgctacagaggcgaggacgggtgctggtacggaatggaaatccggccccttaaggagaaggaagagaacctggtcaattctctcgttaccgccggccatgggcagattgataactttagcctgggagtgctgggcatggctcttttcctcgaagagatgctgagaacgcgcgtggggaccaaacacgcgatcctgctcgtcgccctgtcctttgtgacacttatcaccggaaatatgtctttccgggacctgggcagagttatggtgatggtcggcgctacaatgaccgatgacattgggatgggagtgacgtatctcgccctgctggccgcttttaaggttcgccctacattcgccgcgggccttctgctcagaaaactgaccagcaaggagctcatgatggctacaatcgggattgccctgctttcccagtctaccctgcccgaaaccatcctcgagctgacagatgccctggctcttggaatgatggccctgaaaattgtgcggaacatggaaaagtaccaactcgcggtcacgatcatggctatcagctgtgtgcctaatgccgttattctgcagaacgcctggaaggtgtcctgcaccatcctcgctgccgtcagcgtgtctcccctgcttctgacatccagccagcagaaagctgactggattcctctcgccctgaccatcaagggcctgaatcccacagcgatttttcttaccacgctgtctcgcacatccaaaaagagaagctggccgctcaacgaggccatcatggctgtggggatggtctctatcctggcctccagcctcctgaaaaatgacattcctatgaccggaccccttgttgctggcggcctgctgaccgtgtgttatgtgctcacagggcggtccgccgatctggaacttgagcgcgccgctgacgtcaagtgggaggatcaagcggaaatcagcggatctagccctattctgtccatcaccatttctgaggacggcagcatgtccatcaaaaacgaagaggaggaacagacactcacgattctgatcagaaccgggctcctggtgatctctggagttttccccgtgagcattccgatcacagccgctgcctggtacctttgggaggtcaagaagcagcgggccggcgtgctgtgggatgttccttctccccctcccgtggggaaagctgaactggaggacggagcctatcgcattaagcagagaggcatcctcggctacagccaaattggggcgggagtctataaagaaggcacctttcacacaatgtggcatgtgaccagaggggctgtcctgatgcaccgcggaaagagaatcgagcccagctgggccgatgtgaaaaaggaccttatctcctacggcgggggatggaagctggagggcgaatggaaagagggcgaagaggttcaggtgctcgccctggaacctgggaagaatccgcgggctgtccagacgaaacccggaattttcaagaccaacacaggcaccatcggggccgtgagcctcgatttttctcctggaacatccggcagccccattgttgacagaaaagggaaggtggtcggactgtacggcaatggcgtggtgacccgctctggggcgtatgtttccgctatcgcccagacagaaaagagcattgaggataaccctgaaatcgaggacgatatcttccggaaaaagagacttacgattatggacctgcatcccggagccggcaaaaccaagcgctacctgcctgctatcgtccgggaagccattaaaagagggctccgcacactgatccttgctccgacccgggtggtggccgcggagatggaagaggccctgagaggactccccattcgctatcaaacccctgctatccgggccgagcacacaggcagagaaattgtcgacctgatgtgccatgctacgttcaccatgcggctcctgtcccccgtgcgcgttcctaactacaatcttatcatcatggatgaggcccactttacagaccccgcctctattgctgcgagagggtatatcagcacccgggtggaaatgggcgaggccgctggaattttcatgacagccaccccgcctggctcccgcgatccctttccccagagcaacgcccctatcatggacgaggaaagagagattcccgaacggtcttggaactccgggcacgagtgggtcacggatttcaagggaaagacagtgtggtttgttcctagcatcaaagctggcaacgacatcgccgcgtgtctgagaaagaatgggaaaaaggtgattcagctgtctcgcaaaaccttcgatagcgaatacgtcaagacccgggctaacgactgggattttgtggttacaaccgacatctccgagatgggagccaatttcaaggccgagagagtgattgatccgcgccggtgcatgaaacccgtcatcctcacagacggcgaagagagagtgattctggctgggcctatgcccgtgacccattctagcgccgcgcaacgccggggcagaatcggacgcaaccctaagaatgaaaacgaccagtatatctacatgggcgagccccttgaaaatgatgaggactgtgcccactggaaagaggctaagatgctgctcgataacattaatacgccggaagggatcattccttccatgtttgagcccgaaagagagaaagtcgacgccatcgatggagaataccggctgcgcggcgaggctagaaagacattcgttgacctgatgcggcgcggggatctccctgtgtggcttgcctataaagtggctgccgagggaattaactacgcggacagaaagtggtgctttgatggcatcaagaataaccagattctggaagagaacgtcgaagtggagatctggaccaaagagggggaacggaagaaactgaagcccagatggctcgacgcccgcatctattctgatcctctggctcttaaagagttcaaggagttcgccgctggccggaagtccctgacactcaatctgattaccgagatgggaagactgcccacgtttatgacccagaaagcccgcaacgccctcgacaatcttgctgttctgcatacagcggaagtgggcgggaaggcctacacccacgctctgtccgagctcccggagacactggaaacccttctgctcctgacactgctcgccgccgtcaccggaggcatcttcctttttctgatgagcgggaaaggaattggcaagatgacgctgggcatgtgttgcatcattacagcttctatcctcctgtggtatgcccaaatccagcctcactggattgcggcctccatcattcttgagttctttctgatcgtgctcctgattcccgaacccgagaaacagcggacccctcaggataaccaactgacctacgttgtgatcgctatcctcacagtcgtggccgctaccatggccaatgaaatggggttccttgagaagacaaagaaagacctgggatttggcagcattacgacccaggagtccgaatctaacatcctggacattgatctcagaccggcgagcgcctggacactgtatgctgtcgccaccacattcgtgacccccatgcttcggcattccatcgaaaattctagcgttaacgtgtccctgacggctattgccaatcaggctaccgtgctcatggggctgggaaagggctggcctctgagcaaaatggacatcggggtccccctccttgccattggatgctactctcaggttaaccctatcacactgaccgcggccctgctcctgcttgtggctcactacgccatcattggccccggcctgcaagctaaggccacacgcgaagcccagaaaagagcggctgccgggatcatgaagaatcctaccgtggatggaattacggtcatcgacctcgagccgattccctatgatcctaagtttgaaaaacagctgggccaggtgatgctgctcatcctttgtgttacacaagtgctgatgatgcggaccacatgggctctgtgcgaggccctcaccctggccaccgggcccatctccacactttgggagggaaaccctggccgcttctggaatacgaccattgctgtcagcatggccaacatctttagagggtcttacctggcgggagccggcctcctgttctccattatgaagaatacaaccaacacacggcgcggcaccgggaatgtgggagaaacgctgggcgagaaatggaaaagcagactcaacgctcttgggaaatctgaatttcagatctataagaaaagcggcattcaggaggtcgaccggacactggccaaggagggcatcaagcgcggggaaaccgatcatcacgctgtgtccagaggatctgccaaactgcggtggttcgttgagagaaacatggtgacccccgaaggcaaggtcgtggacctcggctgtgggcgcggaggctggagctactattgcgggggactgaaaaatgttcgggaggtgaagggccttacaaaagggggaccgggccatgaggaacctatccccatgtccacctacggctggaacctggtcagactccaaagcggggtggatgtgttctttacaccccctgagaagtgtgacacgctgctgtgcgatattggagaatcctctcccaatcctaccatcgaggcgggccgcacactccgggttcttaacctggtcgaaaattggctgaacaataacacccagttctgtattaaggtgctcaatccgtatatgcccagcgtgatcgagaaaatggaaacactgcagagaaagtacgggggagcccttgtccgcaaccctctgtccagaaattctacccacgagatgtactgggttagcaacgctacgggcaatattgtgtcctctgtgaacatgatcagcagaatgctcatcaatcgctttaccatgaaacacaagaaagccacatatgagcccgacgtcgatctggggtccggaacccggaacattggcatcgaaagcgagattcctaacctggacatcgtgggcaagagaattgaaaagatcaaacaggagcatgaaacatcttggcactacgaccaagatcatccctataagacctgggcttaccacgggtcctatgagacaaaacagaccggaagcgcctcttccatggttaatggcgtggtccgcctccttacgaagccgtgggacgtggttcctatggtgacacagatggctatgaccgataccacacccttcgggcagcaacgggtctttaaagagaaggtggacacgagaacccaggaacctaaggagggaaccaagaagctgatgaaaattaccgccgaatggctgtggaaggagctcggcaaagagaagacaccccgcatgtgcaccagagaagagttcacacggaaagtgcgcagcaacgcggccctgggggctgtctttaccgatgaaaataagtggaagtctgccagagaggctgttgaagacggacggttctgggagcttgtggatagagagcggaacctgcacctcgaaggcaaatgtgagacgtgcgtgtacaatatgatgggcaagcgcgagaagaagctgggggagtttggaaaagccaagggctccagagccatctggtatatgtggctgggggcgcggttcctcgaatttgaggctctgggattccttaacgaggaccattggtttagccgcggcaattccctgagcggggtcgaaggcgagggactccacagactgggctacatccttcgggaagtggggaagaaagagggaggcgccatgtacgccgatgacaccgctgggtgggatacacgcattaccctggaagacctcaagaacgaggagatggttacaaatcatatgaaaggagaacacaagaaactggccgaggctatcttcaagctgacctatcagaacaaggtggtcagagtgcagcggcctacgccccgcggcacagttatggacattatctctagaaaagatcaacgggggagcggccaggtgggaacctacggcctcaatacattcaccaacatggaagcccagctgattcgccaaatggagggggagggaatctttaagtccatccagcatcttacggcgaccgaagagattgccgtccagaattggctggtgagagttggccgggaacgcctctctagaatggctatcagcggggacgattgtgtggtcaaaccgattgacgatcggttcgcctccgctctgacagcccttaacgacatgggaaaggtgagaaaagatatccagcaatgggagccttctcgcggctggaatgactggacccaggtccccttttgcagccaccacttccatgaactggtgatgaaggatgggcgggttctcgtggtcccctgcagaaaccaggacgagctgattggccgcgcgcggatctcccagggagccggctggtctctgaaggagacagcttgtctcgggaaaagctatgcccaaatgtggaccctgatgtactttcacagacgcgatcttcggctggctgccaacgctatctgctccgccgtgcctagccattgggtgccgacatctagaaccacgtggtccattcacgcgaagcacgaatggatgacaaccgaggacatgctcgttgtgtggaatcgcgtctggatccaggaaaacccctggatggaggataaaacccctgtggaaagctgggaggaggttccctatctgggaaagcgggaagaccagtggtgtggctctcttattgggctgacatccagagccacctgggctaaaaatatccagacagccattaaccaagtgcgcagcctcatcggaaatgagggctacacggactatatgccttccatgaagcggttcagacgggaagaggaagaggccggggtcctgtggtga

SEQ ID NO: 19845 - RNA, 9876 nt, synthetic construct
  misc_feature 1..9876: note = derived and/or modified CDS sequence (opt5) from DENV-2__KC294215__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccaaatccagcctcactggattgcggcctctatcattcttgagttctttctgatcgtgctcctgattcccgaacccgagaaacagcggacccctcaggataaccaactgacatacgttgtgatcgctatcctcaccgtcgtggccgctacaatggccaatgaaatggggttccttgagaagacgaagaaagacctgggatttggctccattaccacacaggagagcgaatccaacatcctggacattgatctcagaccggcgtctgcctggaccctgtatgctgtcgccacaaccttcgtgacgcccatgcttcggcatagcatcgaaaatagctctgttaacgtgagcctgaccgctattgccaatcaggctacagtgctcatggggctgggaaagggctggcctctgtccaaaatggacatcggggtccccctccttgccattggatgttacagccaggttaaccctatcaccctgacagcggccctgctcctgcttgtggctcactacgccatcattggccccggcctgcaagctaaggccacccgcgaagcccagaaaagagcggctgccgggatcatgaagaatcctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctctacgctttgggagggaaaccctggccgcttctggaataccacaattgctgtctccatggccaacatctttagagggagctacctggcgggagccggcctcctgttctctattatgaagaataccacaaacacccggcgcggcacggggaatgtgggagaaacactgggcgagaaatggaagtccagactcaacgctcttgggaaaagcgaatttcagatctataagaaatctggcattcaggaggtcgaccggaccctggccaaggagggcatcaagcgcggggaaaccgatcatcacgctgtgagcagaggatccgccaaactgcggtggttcgttgagagaaacatggtgacacccgaaggcaaggtcgtggacctcggctgcgggcgcggaggctggtcttactattgtgggggactgaaaaatgttcgggaggtgaagggccttaccaaagggggaccgggccatgaggaacctatccccatgagcacatacggctggaacctggtcagactccaatccggggtggatgtgttctttacgccccctgagaagtgcgacaccctgctgtgtgatattggagaaagctcccccaatcctacaatcgaggcgggccgcaccctccgggttcttaacctggtcgaaaattggctgaacaataacacacagttctgcattaaggtgctcaatccgtatatgccctctgtgatcgagaaaatggaaaccctgcagagaaagtacgggggagcccttgtccgcaaccctctgagcagaaattccacgcacgagatgtactgggtttctaacgctaccggcaatattgtgagctccgtgaacatgatctctagaatgctcatcaatcgctttacaatgaaacacaagaaagccacctatgagcccgacgtcgatctggggagcggaacacggaacattggcatcgaatccgagattcctaacctggacatcgtgggcaagagaattgaaaagatcaaacaggagcatgaaaccagctggcactacgaccaagatcatccctataagacatgggcttaccacgggtcttatgagaccaaacagacgggatccgccagctctatggttaatggcgtggtccgcctccttacaaagccgtgggacgtggttcctatggtgacccagatggctatgaccgatacaacgcccttcgggcagcaacgggtctttaaagagaaggtggacaccagaacacaggaacctaaggagggaaccaaaaagctgatgaaaattacagccaagtggctgtggaaagaactcggcaaggagaaaacaccccgcatgtgtacaagagaggagttcacccggaaggtgcgctccaacgcggccctgggggctgtctttacggatgagaataagtggaaaagcgccagagaagctgttgaggacggacggttctgggaacttgtggatagagagcggaacctgcacctcgagggcaagtgcgaaacctgtgtgtacaatatgatgggcaaacgcgagaagaaactgggggaatttggaaaggccaagggctctagagccatctggtatatgtggctgggggcgcggttcctcgagtttgaagctctgggattccttaacgaggaccattggttttcccgcggcaatagcctgtccggggtcgagggcgaaggactccacagactgggctacatccttcgggaggtggggaaaaaggaaggaggcgccatgtacgccgatgacacagctgggtgggatacccgcattacactggaggacctcaaaaacgaagagatggttaccaatcatatgaagggagagcacaaaaagctggccgaagctatcttcaagctgacgtatcagaacaaagtggtcagagtgcagcggcctacaccccgcggcaccgttatggacattatcagcagaaaggatcaacgggggtctggccaggtgggaacatacggcctcaataccttcacgaacatggaggcccagctgattcgccaaatggaaggggagggaatctttaaaagcatccagcatcttaccgcgacagaggaaattgccgtccagaattggctggctagagtgggccgggagcgcctctccagaatggccatctctggggacgattgcgttgtgaagccgattgacgatcggttcgctagcgccctgaccgcgcttaacgacatgggaaaagtcagaaaggatatccagcaatgggaaccttcccgcggctggaatgactggacacaggtgcccttttgctctcaccacttccatgagctggtcatgaaggatgggcgggtgctcgttgtgccctgtagaaaccaggacgaactgattggccgcgcccggatcagccagggagctggctggtccctgaaagagaccgcctgcctcgggaagtcttatgctcaaatgtggacactgatgtactttcacagacgcgatcttcggctggccgctaacgccatctgtagcgcggtcccttcccattgggtgccgaccagcagaacgacatggtctattcacgccaaacacgagtggatgaccaccgaagacatgctcgtggtttggaatcgcgtgtggatccaggagaacccctggatggaagataagacacctgtcgagtcctgggaagaggtgccctatctgggaaaacgggaggaccagtggtgcggcagccttattgggctgacctctagagctacatgggccaagaatatccagacggccattaaccaagttcgctccctcatcggaaatgaaggctacaccgactatatgcctagcatgaagcggttcagacgggaggaagaggaagctggggtgctgtggtga

SEQ ID NO: 19846 - RNA, 9876 nt, synthetic construct
  misc_feature 1..9876: note = derived and/or modified CDS sequence (opt5) from DENV-2__KC294216__SS-prME
  source 1..9876: mol_type = other RNA
accgccggagtgatcattatgctgatccccaccgctatggccttccacctcacgaccagaaatggggagcctcatatgattgtgggacggcaggaaaagggaaagagcctgctttttaagacggaggacggggttaatatgtgcaccctgatggcgatcgatctcggagaactgtgtgaggacacaattacctacaaatgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatcttgaactgattaaaacagaggccaagcagcctgctaccctcagaaaatattgcatcgaagccaagctgacgaacacaaccaccgagagccggtgtccgacacaaggagagccctctctgaatgaggaacaggacaaacgcttcatttgcaagcattccatggtggatagaggctggggcaacgggtgtggactctttggcaaagggggaatcgtgacctgcgcgatgttcacatgcaaaaagaatatggaaggcaaagtcgttctgcctgagaaccttgaatacacgattgtgatcacaccccacagcggggaggagcatgccgtgggaaatgacacaggcaagcacggcgaagagatcaaaattacccctcagtcttccatcacagaagctgagctgaccgggtatggaacggtcaccatggaatgtagcccccggacaggcctcgattttaacgagatggtgctgcttcagatggaggaaaaggcctggctggttcaccgccaatggttcctcgacctgccgctgccttggctccccggggctgatacccagggatctaattggattcagaaagagacactggtgacctttaagaaccctcatgccaagaaacaggacgtcgtggttcttggctcccaagaaggggccatgcacacggctctgacaggcgcgaccgagatccagatgagctccggaaatctcctgttcacaggccatcttaagtgcagactgcggatggacaaactccagctgaaggggatgtcttacagcatgtgtaccggaaaatttaagattgtgaaggagatcgccgaaacccaacacggcacaatcgtcattagagtgcagtatgagggggatggatccccctgcaaaatccccttcgaaattatggacctggagaagcgccatgtcctcggccggctgatcacggtgaaccctattgttaccgaaaaagatagcccggtgaacatcgaggctgagccccctttcggggactcttacattatcatcggcgtcgaacccggacagcttaagctgaattggtttaaaaagggctccagcattgggcagatgttcgagacaaccatgagaggagccaagcgcatggccatcctcggcgatacagcttgggactttgggtctctgggaggcgtgttcaccagcattgggaaagccctgcaccaagtttttggcgcgatctacggagctgccttctccggcgtgtcttggacgatgaagattcttatcggggtcatcattacatggatcggaatgaacagccggtccaccagcctctctgtgtccctggtgctggttggcgtcgtgaccctctatctgggggccatggtgcaggctgatagcggatgtgtcgtgtcttggaaaaataaggaacttaaatgcggctccgggatttttatcacagacaacgttcacacctggacagagcagtacaagttccagcctgaaagcccctccaagctggcctctgctattcaaaaagcccatgaggagggcatctgtggaatcagaagcgtgacgcgcctcgaaaatctgatgtggaagcagattaccccggagctgaaccacatcctttccgaaaatgaggtcaaactcacaattatgaccggcgatatcaaggggattatgcaggcgggaaaacggtctctgagacctcagcccacagaactgaagtatagctggaaaacctggggcaaggccaagatgctctccacggagagccataaccaaacctttctgatcgacgggcctgagacagctgaatgccccaataccaaccgcgcctggaactctcttgaggtggaagattacggattcggcgtttttacaaccaacatctggctgaaactccgggagaagcaggacgtgttctgtgactccaaactgatgagcgctgccattaaggataatagagcggtccacgccgacatgggctattggatcgagtctgctctgaacgatacatggaaaatggaaaaggcctcctttattgaggtcaagagctgccactggcctaaatctcataccctttggagcaatggggttctcgaatccgagatgatcattcccaagaacttcgctggaccggtgagccagcacaactaccgccctggctatcatacgcagacagccgggccctggcacctgggaaaactggaaatggacttcgatttttgtgagggcaccaccgtcgtggtgacagaggactgcgggaatcggggaccctctctcagaaccacgacagcctccggcaagctgatcaccgaatggtgctgtcggagctgcacacttcctccgctgcgctacagaggcgaggatgggtgttggtacggaatggaaattcggcccctcaaagagaaggaagagaacctggtcaattccctggttaccgctggccatgggcaaatcgacaacttctctcttggagtgctcggcatggcgctgtttctggaggaaatgctcagaacacgcgtggggaccaagcacgccatcctgcttgtcgctgtgagcttcctgacgctcattaccggaaatatgtcctttcgggatctgggcagagttatggtgatggtcggcgtggccatgacagacgatatcgggatgggagttacctatctggcccttctggctgccttcaaagtgcgccctacatttgcggctggcctcctgctcagaaagctgacctctaaagagcttatgatggccacgattgggatcacactgctcagccagtccaccacacccgaaaccattctggagctgaccgacgcccttgctctgggaatgatggtcctcaagatcgtgcggaacatggaaaaataccagctggccgttacaatcatgacgatttcttgcgtgcctaatgcgatgatcctcattaacgcttggaaggtcagctgtaccatcctggccgtggtgtccgtcagcccccttctgctcacatcttcccaacagaagaccgattggattcctctggccctgacaatcaaaggccttaatcccaccgctatcttcctgacgacactcagccgcacctctaagaaaagatcctggccgctgaacgaggccgttatggctgtggggatggtgagcattctcgcctcttccctgcttaagaatgacatccctatgaccggacccctggtcgcgggcggcctgctcacagtgtgctatgttctgaccgggcggagcgccgaccttgagctggaacgcgctgccgatgtgaaatgggaggaccaggctgaaatttccggaagctctcctatcctcagcattacaatctccgaggatggctctatgagcattaagaacgaggaagaggaacagacgctgaccatcctcatcagaacagggctgcttgtcatttccggagtgtttcccgtttctatcccgattaccgccgccgcttggtacctgtgggaggtgcggaaacaacgcgcgggcgtcctgtgggacgtgccttctccccctcccgtcgaaaaggccgagctcgaggatggggcttatagaatcaagcagcggggcattctgggctactcccagatcggcgccggggtgtataaagaaggaacattccacaccatgtggcatgttacgcgcggcgccgtgcttatgcacagagggaagcggatcgagccctcctgggctgacgtcaaaaaggatctgattagctacggaggcgggtggaaactcgaaggagagtggaaggaaggcgaggaggtgcaggttctggccctcgaacctggcaagaatccgagagcggtgcaaaccaaacccgggctgtttaagacaaacaccggaacaatcggcgctgtctcccttgacttcagccctgggacctctggatcccccattgtggatcgcaaaggcaaggtggttgggctgtacggaaatggcgtcgtgacacggagcggcgcctatgtgtctgccatcgctcagacggagaaatccattgaagacaaccctgagatcgaagatgacatctttagaaagaagcgcctgaccattatggatctccatcccggggccggaaaaacaaagcggtacctgcctgcgatcgtcagagaggctattaaacgcggccttcggaccctgatcctcgccccgaccagagtggttgccgctgagatggaagaggccctgcgcgggctccccattcggtatcagacccctgctatcagagccgaacacacgggacgggagattgtggacctgatgtgtcatgcgaccttcacaatgcgccttctgagccccgtcagagtgcctaactacaatctgatcatcatggacgaggcccacttcaccgatcccgcttccattgccgctcggggctatatctctacacgcgttgaaatgggggaggccgccggcatttttatgaccgctacgccgcctggaagcagagaccccttcccccagtccaacgcgcctatcatggatgaggaacgggaaattcccgagagaagctggaactctggccacgagtgggtgacagactttaaggggaaaaccgtctggttcgtgccttccatcaaggccggaaacgatatcgctgcctgcctccgcaagaatggcaaaaaggttattcaactgagccggaaaacctttgactctgaatacgtgaagacaagagccaacgattgggacttcgtcgtgaccacagatatcagcgagatgggggctaattttcgcgccgaacgggtgattgacccgagacgctgtatgaaacccgtcatccttaccgatggagaggaacgggttattctggcgggccctatgcccgtgacgcattcctctgctgcccagagacgcgggagagtgggccggaaccctaagaatgagaacgaccagtatatctacatgggagagcccctcgaaaatgacgaggattgcgcccactggaaggaagctaaaatgctgctggacaacatcaatacaccggagggcattatccctagcatgttcgaacccgagcgcgagaaggtcgatgccattgacggggaatacagactccggggagaggcgcgcaaaacctttgtggatcttatgagacggggcgacctgcctgtttggctggcctatagagtggctgccgaagggatcaactacgctgatcgccggtggtgtttcgacggaattaagaataaccaaatcctcgaggagaacgtcgaagtggagatttggacaaaagaaggcgagagaaagaaactgaagccccgctggcttgatgcccggatctattccgaccctctggctctcaaggaatttaaagagttcgccgcggggagaaagtctctgaccctgaatctcatcacggagatgggccggcttcccaccttcatgacacagaaagcccgcaacgctctggataatctggccgttctccataccgctgaagccggaggcagagcctacaaccacgctctgagcgagcttccggaaacactggagaccctcctgctgctcacacttctggcgaccgtgacagggggaatttttctgttcctcatgtccggcaaggggatcggaaaaatgacactgggcatgtgctgcattatcaccgccagcattcttctgtggtatgctcagatccagcctcactggatcgccgcctctattatcctcgaatttttcctgattgtcctgctcatccccgagcccgagaagcaacggacccctcaggacaatcagcttacatacgtggtcattgctatcctgaccgtggttgccgcgacaatggccaacgaaatgggctttctggagaagacgaaacgcgatctcgggctgggatccatcaccacacaggaaagcgagtccaatattcttgacatcgacctgagaccggcttctgcctggaccctctatgctgtggccacaaccttcgtgacgcccatgctgcggcatagcattgaaaactcctctgtcaatgttagcctgaccgcgatcgccaaccaagctacagtgctcatgggccttgggaagggatggcctctgtccaaaatggatattggcgtgcccctgctcgccatcgggtgttacagccaggtcaatcctattaccctgacagctgcccttctgctcctggtggctcactacgccatcatcggacccggcctgcaggcgaaggccacccgcgaggctcagaaaagagccgctgccggcattatgaagaaccctacggttgacgggatcacagtgattgatctcgagccgatcccctatgaccctaagtttgaaaaacaacttggacaggtcatgctgctgattctctgcgtgacccaggtcctgatgatgcggacaacctgggccctttgtgaggcgctgaccctcgctacaggccccatctctacgctgtgggaagggaatcctggacgcttctggaacaccacaatcgccgtgtccatggctaatatttttagaggcagctacctggccggggccggactccttttctctatcatgaagaacaccacaaatacccggagaggcacgggcaacattggggagacactgggagagaaatggaagtcccgcctgaacgctctcggcaaaagcgaatttcagatctataagcggtctgggattcaagaggttgatagaaccctggccaaggaaggaatcaaacgcggcgagaccgaccatcacgcggtgagccgggggtccgccaaacttagatggttcgtcgaacgcaatatggtgacacccgagggaaaagttgtggatctgggctgcggcagagggggatggtcttactattgtggcgggctcaagaacgtccgggaggtgaaaggactgaccaagggcgggccgggacatgaggaacctatccccatgagcacatacggctggaatctggtgcgcctccagtccggcgttgacgtctttttcacgccccctgaaaaatgcgatacccttctgtgtgacattggggagagctcccccaaccctacaatcgaagctggacggaccctgagagtgctcaatctggtggagaactggcttaataacaatacacagttctgcattaaggtcctgaacccgtatatgccctctgttatcgagaagatggaaaccctccaacgcaaatacggcggggccctggtgcggaatcctctgagcagaaactccacgcacgagatgtactgggtgtctaatgctaccggaaacattgtcagctccgtgaatatgatctctcgcatgctcatcaacagatttacaatgaagcacaaaaaggccacctatgaacccgatgttgaccttggcagcgggacacggaacattggaatcgagtccgaaattcctaatctggcgatcattggcaaacgcatcgagaagattaagcaggagcatgaaaccagctggcactacgatcaggaccatccctataaaacatgggcctaccacggctcttatgagaccaagcagacggggtccgctagctctatggtgaacggagtcgtgagactgctcacaaaaccgtgggacgttgtgcctatggtcacccaaatggccatgaccgatacaacgcccttcggccagcagcgggtgtttaaggaaaaagtggacaccagaacacaggagcctaaggaggggaccaagaaactgatgcggatcacagctgaatggctttggaaggagctgggcaagaagaaaacaccccgcatgtgtacaagagaagagttcacccggaaggtccgctccaatgccgctctcggcgccatctttacggatgaaaacaagtggaaaagcgcgagagaggccgttgaggactctcggttctgggaactggtggatcgcgagagaaatctgcacctcgaagggaagtgcgagacctgtgtgtacaacatgatgggaaaacgggaaaagaaactgggcgagtttggcaaggctaaagggtcccgcgccatttggtatatgtggcttggagctagattcctggagtttgaagccctcggcttcctgaatgaggaccattggtttagccgggggaactcccttagcggagtcgaaggcgaggggctgcaccgcctcggctacatcctgagagatgtgtctaagaaggaaggaggcgccatgtacgcggacgatacagctgggtgggacacccggattacactggaggatctcaaaaatgaggaaatggttaccaaccatatgaagggagagcacaaaaagctggccgaagccgtgttcaaacttacgtatcaaaataaggtcgtgcgcgttcagagacctacaccccggggcaccgtgatggacatcattagcagacgcgaccagcgggggtccggacaggtcggcacatacgggctgaacacctttacgaatatggaggctcaactcatcagacagatggagggcgaaggaatcttcaagtctattcagcatctgaccgccacagaggaaatcgctgtgcaaaactggcttgcccgcgttggccgggagagactgagccgcatggcgatttccggggatgactgcgtggtcaaaccgctcgatgaccggttcgcctctgctctgaccgccctgaatgatatgggaaaggtgagaaaagacatccagcagtgggaacctagccgcggctggaacgattggacacaggtccccttttgctcccaccacttccatgagctcgtgatgaaggacgggcgggttctggtggtcccctgtagaaaccaagatgagcttattggacgcgctcggatctctcagggcgccgggtggagcctgaaagaaaccgcgtgcctcggcaagtcctatgcccagatgtggacactgatgtactttcacagacgggaccttagactggctgccaatgctatctgtagcgccgtgccttctcattgggtgccgacctcccgcacgacatggagcattcacgctaagcacgagtggatgaccaccgaagatatgctcgccgtttggaaccgggtgtggatccaggagaatccctggatggaagacaaaacacctgtcgagtcttgggaggaagtgccctatctgggaaagagagaggatcaatggtgcggctccctgattgggctcaccagccgcgcgacatgggccaaaaacatccagacggctattaatcaggttagatccctgatcggaaacgaagagtacaccgactatatgccttctatgaagcggttccgcagagaagaggaggaagccggcgtgctttggtga

SEQ ID NO: 19847 - RNA, 9876 nt, synthetic construct
  misc_feature 1..9876: note = derived and/or modified CDS sequence (opt5) from DENV-2__KC294218__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatccttattctgctcacggccgtcgcgcctagcatgaccatgcggtgcatcggcatttccaaccgcgatttcgtggaaggggtttctggaggcagctgggtggacatcgtcctggagcacgggtcctgtgtgacaaccatggccaagaataagcccacacttgattttgaactgatcaaaaccgaggctaagcagcctgccacgctcagaaaatattgcattgaagctaagctgacaaacaccaccacagagagccggtgtccgacccaaggagagccctctctgaatgaagaacaggacaaacgcttcatctgcaagcattccatggtggatagaggctggggcaacgggtgtggactctttggcaaagggggaattgtcacatgcgccatgttcacgtgcaaaaagaatatggaaggcaaaatcgttcagcctgagaacctggaatacaccattgtgatcacaccccacagcggggaggagcatgcggtgggaaatgacaccggcaagcacggcaaagaaatcaagattacacctcagtcttccaccacggaggccgaacttaccgggtatggaacagtcaccatggagtgtagcccccggacaggcctggattttaacgaaatggtgctcctgcaaatggaggacaaggcttggcttgttcaccgccagtggttcctggatctcccgctgccttggctgcccggggccgacacccagggatctaattggatccagaaggagacgctcgtgacatttaagaaccctcatgctaaaaagcaagacgtcgtggttctgggctcccaggaaggggccatgcacaccgcccttacaggcgctaccgagattcagatgagctccggaaatctcctgttcaccggccatctgaaatgcagacttcggatggataagctgcaactcaaagggatgtcttacagcatgtgtacaggaaagtttaagatcgtgaaagaaattgcggagacgcagcacggcaccatcgtcatcagagtgcagtatgagggggacggatccccctgcaagattcccttcgaaatcacagatctggagaaacgccatgtcctgggccggctcattaccgtgaaccctatcgttacagaaaaggacagcccggtgaacattgaggccgaaccccctttcggggattcttacatcattgtcggcgtggagcccggacagctgaaacttaattggtttaagaagggctccagcatcgggcaaatgttcgagaccacgatgagaggagctaaacgcatggccatcctgggcgacacagcctgggattttgggtctctcggaggcgttttcaccagcattgggaaggctctgcaccaggtgtttggcgccatctacggagcggctttctccggcgtctcttggaccatgaaaattctgatcggggtgattatcacatggatcggaatgaacagccggtccaccagcctttctgtgtccctcgttctggtcggcgtggtgacactgtatctcggggccatggtccaggccgacagcggatgtattgtgtcttggaagaataaagaactgaagtgcggctccgggatctttattacggataacgttcacacctggacagagcagtacaagttccaacctgaaagcccctccaaacttgcttctgccatccagaaggctcatgaggaaggcatttgtggaatcagaagcgtgacccgcctggagaatctcatgtggaaacagatcacaccggagctgaaccacattctgtccgaaaatgaggtcaaacttaccatcatgacgggcgacattaaagggatcatgcaggccggaaagcggtctctcagacctcaacccaccgaactgaaatatagctggaagacatggggcaaggcgaaaatgctgtccaccgagagccataaccagacatttctcattgatgggcctgaaaccgccgagtgccccaatacaaaccgcgcttggaactctctggaggtggaagactacggattcggcgtttttaccacgaacatctggcttaagctgcgggagaaacaggacgtgttctgtgattccaagctcatgagcgccgctatcaaagacaatagagccgtccacgcggatatgggctattggattgaatctgccctgaacgacacatggaagatggagaaggcttcctttatcgaggtgaaaagctgccactggcctaagtctcataccctgtggagcaatggggttcttgaatccgagatgattatccccaaaaacttcgccggaccggtgagccagcacaactaccgccctggctatcatacccaaacagctgggccctggcacctcggaaagctggaaatggatttcgacttttgtgagggcaccacggtcgtggtgacagaagattgcgggaatcggggaccctctctgagaaccacaaccgcctccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacggccggccatgggcagattgataacttctctctgggagtgcttggcatggctctctttctggaagagatgctgagaacccgcgtggggacaaaacacgcgatcctcctggtcgcccttagcttcgtgaccctgatcacaggaaatatgtcctttcgggacctcggcagagttatggtgatggtcggcgctaccatgacggatgacattgggatgggagtgacatatctggccctgcttgccgctttcaaggttcgccctacctttgccgcgggcctgctcctgagaaaactcacatctaaggagctgatgatggctaccatcgggattgcccttctgagccagtccaccctccccgaaacaatcctggagctgacggatgcccttgctctgggaatgatggccctcaaaattgtgcggaacatggaaaagtaccaactggcggtcaccatcatggctatctcttgcgtgcctaatgccgttattctccagaacgcctggaaggtgagctgtacaatcctggctgccgtctccgtgagcccccttctgctcacctcttcccagcagaaagctgactggattcctctggccctgacaatcaagggccttaatcccaccgcgattttcctgacgacactcagccgcacctctaaaaagagatcctggccgctgaacgaggccatcatggctgtggggatggtcagcatcctcgcctcttccctgcttaaaaatgacattcctatgaccggacccctggttgctggcggcctgctcacagtgtgctatgtgctgaccgggcggagcgccgatcttgaactggagcgcgccgctgacgtcaagtgggaggatcaagcggaaatctccggaagctctcctattctcagcatcacaatttccgaggacggctctatgagcatcaaaaacgaagaggaggaacagacgctgaccattctcatcagaacagggctgcttgtgatctccggagtttttcccgtgtctattccgatcaccgccgctgcctggtacctgtgggaggtcaagaagcagcgggccggcgtgctgtgggatgttccttctccccctcccgtggggaaagctgaactcgaggacggagcctatcgcattaagcagagaggcatcctgggctactcccaaattggggcgggagtctataaagaaggcacattccacaccatgtggcatgtgacgagaggggctgtccttatgcaccgcggaaagagaatcgagccctcctgggccgatgtgaaaaaggacctgatcagctacggcgggggatggaagctcgagggcgaatggaaagagggcgaagaggttcaggtgctggccctcgaacctgggaagaatccgcgggctgtccagaccaaacccggaatttttaagacaaacaccggcacaatcggggccgtgtccctggatttcagccctggaacctctggctcccccattgttgacagaaaagggaaggtggtcggactttacggcaatggcgtggtgacacgcagcggggcgtatgtttctgctatcgcccagacggagaagtccattgaggataaccctgaaatcgaggacgatatctttcggaaaaagagactgaccattatggacctgcatcccggagccggcaaaacaaagcgctacctccctgctatcgtccgggaagccattaaaagagggctgcgcacccttatcctggctccgacccgggtggtggccgcggagatggaagaggccctcagaggactgcccattcgctatcaaacccctgctatccgggccgagcacacgggcagagaaattgtcgacctcatgtgtcatgctaccttcacaatgcggctgcttagccccgtgcgcgttcctaactacaatctgatcatcatggatgaggcccacttcaccgaccccgcctccattgctgcgagagggtatatctctacacgggtggaaatgggcgaggccgctggaatttttatgaccgccacgccgcctggcagccgcgatcccttcccccagtccaacgcccctatcatggacgaggaaagagagattcccgaacggagctggaactctgggcacgagtgggtcacagattttaagggaaagaccgtgtggttcgttccttccatcaaagctggcaacgacatcgccgcgtgcctgagaaagaatgggaaaaaggtgattcagctcagccgcaaaacctttgattctgaatacgtcaagacacgggctaacgactgggatttcgtggttaccacagacatcagcgagatgggagccaattttaaggccgagagagtgattgatccgcgccggtgtatgaaacccgtcatcctgaccgacggcgaagagagagtgattcttgctgggcctatgcccgtgacgcattcctctgccgcgcaacgccggggcagaatcggacgcaaccctaagaatgaaaacgaccagtatatctacatgggcgagcccctggaaaatgatgaggactgcgcccactggaaagaggctaagatgctcctggataacattaatacaccggaagggatcattcctagcatgttcgagcccgaaagagagaaagtcgacgccatcgatggagaataccggctgcgcggcgaggctagaaagacctttgttgacctcatgcggcgcggggatcttcctgtgtggctggcctataaagtggctgccgagggaattaactacgcggacagaaagtggtgtttcgatggcatcaagaataaccagattctggaagagaacgtcgaagtggagatctggacaaaagagggggaacggaagaaactcaagcccagatggctggacgcccgcatctattccgatcctcttgctctgaaagagtttaaggagttcgccgctggccggaagtctctcaccctgaatctgattacggagatgggaagactccccaccttcatgacacagaaagcccgcaacgcccttgacaatctggctgttctgcataccgcggaagtgggcgggaaggcctacacacacgctctcagcgagctgccggagacccttgaaacactgctcctgctgaccctccttgccgccgtcacgggaggcatctttctgttcctgatgtccgggaaaggaattggcaagatgacactcggcatgtgctgcatcattaccgctagcatcctgctttggtatgcccaaatccagcctcactggattgcggcctctatcattctggagtttttcctcatcgtgctgctgattcccgaacccgagaaacagcggacccctcaggataaccaactcacatacgttgtgatcgctatccttaccgtcgtggccgctacaatggccaatgaaatggggtttctggagaagacgaagaaagacctgggattcggctccattaccacacaggagagcgaatccaacatcctcgacattgatctgagaccggcgtctgcctggaccctttatgctgtcgccacaacctttgtgacgcccatgctgcggcatagcatcgaaaatagctctgttaacgtgagcctcaccgctattgccaatcaggctacagtgctgatggggctgggaaagggctggcctctctccaaaatggacatcggggtcccccttctggccattggatgttacagccaggttaaccctatcaccctgacagcggccctcctgcttctggtggctcactacgccatcattggccccggcctccaagctaaggccacccgcgaagcccagaaaagagcggctgccgggatcatgaagaatcctacggtggatggaattacagtcatcgacctggagccgattccctatgatcctaagttcgaaaaacagctgggccaggtgatgctccttatcctgtgcgttacccaagtgctgatgatgcggacaacctgggctctctgtgaggccctgacccttgccacagggcccatctctacgctgtgggagggaaaccctggccgcttttggaataccacaattgctgtctccatggccaacatcttcagagggagctacctcgcgggagccggcctgctgttttctattatgaagaataccacaaacacccggcgcggcacggggaatgtgggagaaacactcggcgagaaatggaagtccagacttaacgctctggggaaaagcgagttccagatctataagaaatctggcattcaggaggtcgaccggaccctggccaaggagggcatcaagcgcggggaaaccgatcatcacgctgtgagcagaggatccgccaaactccggtggtttgttgagagaaacatggtgacacccgaaggcaaggtcgtggacctgggctgcgggcgcggaggctggtcttactattgtgggggacttaaaaatgttcgggaggtgaagggcctgaccaaagggggaccgggccatgaagaacctatccccatgagcacatacggctggaacctcgtcagactgcaatccggggtggatgtgttcttcacgccccctgagaagtgcgacaccctgctctgtgatattggagaaagctcccccaatcctacaatcgaggcgggccgcacccttcgggttctgaacctggtcgaaaattggctcaacaataacacacagttttgcattaaggtgctgaatccgtatatgccctctgtgatcgagaaaatggaaacccttcagagaaagtacgggggagccctggtccgcaaccctctcagcagaaattccacgcacgagatgtactgggtttctaacgctaccggcaatattgtgagctccgtgaacatgatctctagaatgctgatcaatcgcttcacaatgaaacacaagaaagccacctatgagcccgacgtcgatctggggagcggaacacggaacattggcatcgaatccgagattcctaacctcgacatcgtgggcaagagaattgaaaagatcaaacaggagcatgaaaccagctggcactacgaccaagatcatccctataagacatgggcttaccacgggtcttatgagaccaaacagacgggatccgccagctctatggttaatggcgtggtccgccttctgacaaagccgtgggacgtggttcctatggtgacccagatggctatgaccgatacaacgccctttgggcagcaacgggtcttcaaagagaaggtggacaccagaacacaggaacctaaggagggaaccaaaaagctgatgaaaattacagccgaatggctctggaaggagctgggcaaagagaagacaccccgcatgtgtacaagagaagagtttacccggaaagtgcgctccaacgcggcccttggggctgtcttcacggatgaaaataagtggaaaagcgccagagaggctgttgaagacggacggttttgggagctggtggatagagagcggaacctccacctggaaggcaaatgcgagacctgtgtgtacaatatgatgggcaagcgcgagaagaagctgggggagttcggaaaagccaagggctctagagccatctggtatatgtggctcggggcgcggtttctggagttcgaggctcttggatttctgaacgaggaccattggttctcccgcggcaatagcctctccggggtcgaaggcgagggactgcacagacttggctacatcctgcgggaagtggggaagaaagagggaggcgccatgtacgccgatgacacagctgggtgggatacccgcattacactcgaagacctgaagaacgaggagatggttaccaatcatatgaaaggagaacacaagaaactggccgaggctatctttaagctcacgtatcagaacaaggtggtcagagtgcagcggcctacaccccgcggcaccgttatggacattatcagcagaaaagatcaacgggggtctggccaggtgggaacatacggcctgaataccttcacgaacatggaagcccagcttattcgccaaatggagggggagggaatcttcaagagcatccagcatctgaccgcgacagaagagattgccgtccagaattggctcgctagagtgggccgggaacgcctgtccagaatggccatctctggggacgattgcgttgtgaaaccgattgacgatcggtttgctagcgcccttaccgcgctgaacgacatgggaaaggtcagaaaagatatccagcaatgggagccttcccgcggctggaatgactggacacaggtgcccttctgctctcaccactttcatgaactcgtcatgaaggatgggcgggtgctggttgtgccctgtagaaaccaggacgagctgattggccgcgcccggatcagccagggagctggctggtccctcaaggagaccgcctgcctggggaaatcttatgctcaaatgtggacacttatgtacttccacagacgcgatctgcggctcgccgctaacgccatctgtagcgcggtcccttcccattgggtgccgaccagcagaacgacatggtctattcacgccaagcacgaatggatgaccaccgaggacatgctggtggtttggaatcgcgtgtggatccaggaaaacccctggatggaggataaaacacctgtcgaatcctgggaggaggtgccctatcttggaaagcgggaagaccagtggtgcggcagcctgattgggctcacctctagagctacatgggccaaaaatatccagacggccattaaccaagttcgctccctgatcggaaatgagggctacaccgactatatgcctagcatgaagcggtttagacgggaagaggaagaggctggggtgctgtggtga

SEQ ID NO: 19848 - RNA, 9876 nt, synthetic construct
  misc_feature 1..9876: note = derived and/or modified CDS sequence (opt5) from DENV-2__KC294220__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccaaatccagcctcactggattgcggcctctatcattcttgagttctttctgatcgtgctcctgattcccgaacccgagaaacagcggacccctcaggataaccaactgacatacgttgtgatcgctatcctcaccgtcgtggccgctacaatggccaatgaaatggggttccttgagaagacgaagaaagacctgggatttggctccattaccacacaggagagcgaatccaacatcctggacattgatctcagaccggcgtctgcctggaccctgtatgctgtcgccacaaccttcgtgacgcccatgcttcggcatagcatcgaaaatagctctgttaacgtgagcctgaccgctattgccaatcaggctacagtgctcatggggctgggaaagggctggcctctgtccaaaatggacatcggggtccccctccttgccattggatgttacagccaggttaaccctatcaccctgacagcggccctgctcctgcttgtggctcactacgccatcattggccccggcctgcaagctaaggccacccgcgaagcccagaaaagagcggctgccgggatcatgaagaatcctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctctacgctttgggagggaaaccctggccgcttctggaataccacaattgctgtctccatggccaacatctttagagggagctacctggcgggagccggcctcctgttctctattatgaagaataccacaaacacccggcgcggcacggggaatgtgggagaaacactgggcgagaaatggaagtccagactcaacgctcttgggaaaagcgaatttcagatctataagaaatctggcattcaggaggtcgaccggaccctggccaaggagggcatcaagcgcggggaaaccgatcatcacgctgtgagcagaggatccgccaaactgcggtggttcgttgagagaaacatggtgacacccgaaggcaaggtcgtggacctcggctgcgggcgcggaggctggtcttactattgtgggggactgaaaaatgttcgggaggtgaagggccttaccaaagggggaccgggccatgaggagcctatccccatgagcacatacggctggaacctggtcagactccaatccggggtggatgtgttctttacgccccctgagatgtgcgacaccctgctgtgtgatattggagaaagctcccccaatcctacaatcgaggcgggccgcaccctccgggttcttaacctggtcgaaaattggctgaacaataacacacagttctgcattaaggtgctcaatccgtatatgccctctgtgatcgagaagatggaaaccctgcagagaaaatacgggggagcccttgtccgcaaccctctgagcagaaattccacgcacgagatgtactgggtttctaacgctaccggcaatattgtgagctccgtgaacatgatctctagaatgctcatcaatcgctttacaatgaagcacaaaaaggccacctatgagcccgacgtcgatctggggagcggaacacggaacattggcatcgaatccgagattcctaacctggacatcgtgggcaaaagaattgaaaagatcaagcaggagcatgaaaccagctggcactacgaccaagatcatccctataaaacatgggcttaccacgggtcttatgagaccaagcagacgggatccgccagctctatggttaatggcgtggtccgcctccttacaaaaccgtgggacgtggttcctatggtgacccagatggctatgaccgatacaacgcccttcgggcagcaacgggtctttaaggagaaagtggacaccagaacacaggaacctaaggagggaaccaagaaactgatgaagattacagccgaatggctgtggaaagagctcggcaaggagaaaacaccccgcatgtgtacaagagaagagttcacccggaaggtgcgctccaacgcggccctgggggctgtctttacggatgaaaataaatggaaaagcgccagagaggctgttgaagacggacggttctgggagcttgtggatagagagcggaacctgcacctcgaaggcaagtgcgagacctgtgtgtacaatatgatgggcaaacgcgaaaagaaactgggggagtttggaaaggccaaaggctctagagccatctggtatatgtggctgggggcgcggttcctcgaatttgaggctctgggattccttaacgaggaccattggttttcccgcggcaatagcctgtccggggtcgaaggcgagggactccacagactgggctacatccttcgggaagtggggaagaaggagggaggcgccatgtacgccgatgacacagctgggtgggatacccgcattacactggaagacctcaaaaacgaggagatggttaccaatcatatgaagggagaacacaaaaagctggccgaggctatcttcaaactgacgtatcagaacaaggtggtcagagtgcagcggcctacaccccgcggcaccgttatggacattatcagcagaaaggatcaacgggggtctggccaggtgggaacatacggcctcaataccttcacgaacatggaagcccagctgattcgccaaatggagggggagggaatctttaaaagcatccagcatcttaccgcgacagaagagattgccgtccagaattggctggctagagtgggccgggaacgcctctccagaatggccatctctggggacgattgcgttgtgaagccgattgacgatcggttcgctagcgccctgaccgcgcttaacgacatgggaaaagtcagaaaggatatccagcaatgggagccttcccgcggctggaatgactggacacaggtgcccttttgctctcaccacttccatgaactggtcatgaaagatgggcgggtgctcgttgtgccctgtagaaaccaggacgagctgattggccgcgcccggatcagccagggagctggctggtccctgaaggagaccgcctgcctcgggaagtcttatgctcaaatgtggacactgatgtactttcacagacgcgatcttcggctggccgctaacgccatctgtagcgcggtcccttcccattgggtgccgaccagcagaacgacatggtctattcacgccaaacacgaatggatgaccaccgaggacatgctcgtggtttggaatcgcgtgtggatccaggaaaacccctggatggaggataagacacctgtcgaatcctgggaggaggtgccctatctgggaaaacgggaagaccagtggtgcggcagccttattgggctgacctctagagctacatgggccaagaatatccagacggccattaaccaagttcgctccctcatcggaaatgagggctacaccgactatatgcctagcatgaaacggttcagacgggaagaggaagaggctggggtgctgtggtga

SEQ ID NO: 19849 - RNA, 9876 nt, synthetic construct
  misc_feature 1..9876: note = derived and/or modified CDS sequence (opt5) from DENV-2__KC294221__SS-prME
  source 1..9876: mol_type = other RNA
acagccggagtgatcgtcatgctgattcccacagctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcggggcaaagaaatcaagattacacctcagtcttccaccacggaggccgaactgaccgggtatggaacagtcaccatggagtgtagcccccgcacaggccttgatttcaacgaaatggtgctgctccaaatggaggacaaggcttggctggttcacagacagtggtttcttgatctgccgctcccttggctgcccggggccgacacccagggatctaattggatccagaaggagacgctggtgacattcaagaaccctcacgctaaaaagcaagacgtcgtggttctcggctcccaggaaggggccatgcataccgccctgacaggcgctaccgagattcagatgagctccggaaatcttctgtttaccggccacctcaaatgccggctgagaatggataaacttcaactgaaagggatgtcttacagcatgtgtacaggaaagttcaagatcgtgaaagaaattgcggagacgcagcatggcaccatcgtcatccgcgtgcagtatgagggggacggatccccctgcaagattcccttcgaaatcacagatctcgagaaacggcacgtcctgggcagactgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgcgcggagctaaacggatggccatccttggcgacacagcctgggatttcgggtctctgggaggcgtttttaccagcattgggaaggctctccatcaggtgttcggcgccatctacggagcggctttttccggcgtctcttggaccatgaaaattctgatcggggtgattatcacatggatcggaatgaacagcagatccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcacgaggaaggcatttgtggaatccgcagcgtgacccggcttgagaatctgatgtggaaacagatcacaccggagctcaaccatattctgtccgaaaatgaggtcaagctgaccatcatgacgggcgacattaaagggatcatgcaggccggaaagagatctcttcgccctcaacccaccgaactcaaatatagctggaagacatggggcaaggcgaaaatgctgtccaccgagagccacaaccagacattcctgattgatgggcctgaaaccgccgagtgccccaatacaaaccgggcttggaactctctcgaggtggaagactacggatttggcgttttctccaccaacatctggctgaaacttagagagaaacaggacgtgttttgtgatagcaagctgatgtctgccgctatcaaagacaatcgcgccgtccatgcggatatgggctattggattgaatccgccctcaacgacacgtggaagatggagaaggctagcttcatcgaggtgaaatcttgccactggcctaagagccacacactgtggtccaatggggttctggaaagcgagatgattatccccaaaaacttcgccggaccggtgtctcagcataactaccggcctggctatcacacccaaaccgctgggccctggcatcttggaaagctcgaaatggattttgacttctgtgagggcacaaccgtcgtggtgacggaagattgcgggaatagaggaccctccctgcggacaaccacagccagcggcaaactgattaccgagtggtgctgtcgctcctgcacactccctccgctgagataccggggcgaggacgggtgttggtacggaatggaaatcagaccccttaaggagaaggaagagaacctggtcaattctctcgttaccgccggccacgggcagattgataactttagcctgggagtgctgggcatggctcttttcctcgaagagatgctgcgcacgcgggtggggaccaaacatgcgatcctgctcgtcgccctgtcctttgtgacacttatcaccggaaatatgtctttcagagacctgggccgcgttatggtgatggtcggcgctacaatgaccgatgacattgggatgggagtgacgtatctcgccctgctggccgcttttaaggttagacctacattcgccgcgggccttctgctccggaaactgaccagcaaggagctcatgatggctacaatcgggattgccctgctttcccagtctaccctgcccgaaaccatcctcgagctgacagatgccctggctcttggaatgatggccctgaaaattgtgcgcaacatggaaaagtaccaactcgcggtcacgatcatggctatcagctgcgtgcctaatgccgttattctgcagaacgcctggaaggtgtcctgtaccatcctcgctgccgtcagcgtgtctcccctgcttctgacatccagccagcagaaagctgactggattcctctcgccctgaccatcaagggcctgaatcccacagcgatttttcttaccacgctgtctagaacatccaaaaagcggagctggccgctcaacgaggccatcatggctgtggggatggtctctatcctggcctccagcctcctgaaaaatgacattcctatgaccggaccccttgttgctggcggcctgctgaccgtgtgctatgtgctcacagggcgctccgccgatctggaacttgagagagccgctgacgtcaagtgggaggatcaagcggaaatcagcggatctagccctattctgtccatcaccatttctgaggacggcagcatgtccatcaaaaacgaagaggaggaacagacactcacgattctgatccggaccgggctcctggtgatctctggagttttccccgtgagcattccgatcacagccgctgcctggtacctttgggaggtcaagaagcagcgcgccggcgtgctgtgggatgttccttctccccctcccgtggggaaagctgaactggaggacggagcctatagaattaagcagcggggcatcctcggctacagccaaattggggcgggagtctataaagaaggcacctttcacacaatgtggcacgtgacccgcggggctgtcctgatgcatagaggaaagcggatcgagcccagctgggccgatgtgaaaaaggaccttatctcctacggcgggggatggaagctggagggcgaatggaaagagggcgaagaggttcaggtgctcgccctggaacctgggaagaatccgagagctgtccagacgaaacccggaattttcaagaccaacacaggcaccatcggggccgtgagcctcgatttttctcctggaacatccggcagccccattgttgaccgcaaagggaaggtggtcggactgtacggcaatggcgtggtgacccggtctggggcgtatgtttccgctatcgcccagacagaaaagagcattgaggataaccctgaaatcgaggacgatatcttccgcaagaagcgccttacgattatggacctgcaccccggagccggcaaaaccaagcggtacctgcctgctatcgtcagagaagccattaaacgcgggctccggacactgatccttgctccgaccagagtggtggccgcggagatggaagaggccctgcgcggactccccattcggtatcaaacccctgctatcagagccgagcatacaggccgggaaattgtcgacctgatgtgtcacgctacgttcaccatgcgcctcctgtcccccgtgagagttcctaactacaatcttatcatcatggatgaggcccattttacagaccccgcctctattgctgcgcgggggtatatcagcacccgcgtggaaatgggcgaggccgctggaattttcatgacagccaccccgcctggctccagagatccctttccccagagcaacgcccctatcatggacgaggaacgggagattcccgaaagatcttggaactccgggcacgagtgggtcacggatttcaagggaaagacagtgtggtttgttcctagcatcaaagctggcaacgacatcgccgcgtgcctgcgcaagaatgggaaaaaggtgattcagctgtctcggaaaaccttcgatagcgaatacgtcaagaccagagctaacgactgggattttgtggttacaaccgacatctccgagatgggagccaatttcaaggccgagcgcgtgattgatccgcggagatgtatgaaacccgtcatcctcacagacggcgaagaaagagtgattctggctgggcctatgcccgtgacccactctagcgccgcgcaacggagaggccgcatcggaagaaaccctaagaatgaaaacgaccagtatatctacatgggcgagccccttgaaaatgatgaggactgcgcccattggaaagaggctaagatgctgctcgataacattaatacgccggaagggatcattccttccatgtttgagcccgaacgggagaaagtcgacgccatcgatggagaataccgcctgagaggcgaggctcggaagacattcgttgacctgatgcgcagaggggatctccctgtgtggcttgcctataaagtggctgccgagggaattaactacgcggaccggaagtggtgttttgatggcatcaagaataaccagattctggaagagaacgtcgaagtggagatctggaccaaagagggggaaagaaagaaactgaagccccgctggctcgacgcccggatctattctgatcctctggctcttaaagagttcaaggagttcgccgctggcagaaagagcctgacactcaatctgattaccgagatgggacgcctgcccacgtttatgacccagaaagcccggaacgccctcgacaatcttgctgttctgcacacagcggaagtgggcgggaaggcctacacccatgctctgtccgagctcccggagacactggaaacccttctgctcctgacactgctcgccgccgtcaccggaggcatcttcctttttctgatgagcgggaaaggaattggcaagatgacgctgggcatgtgctgcatcattacagcttctatcctcctgtggtatgcccaaatccagcctcactggattgcggcctccatcattcttgagttctttctgatcgtgctcctgattcccgaacccgagaaacagagaacccctcaggataaccaactgacctacgttgtgatcgctatcctcacagtcgtggccgctaccatggccaatgaaatggggttccttgagaagacaaagaaagacctgggatttggcagcattacgacccaggagtccgaatctaacatcctggacattgatctccggccggcgagcgcctggacactgtatgctgtcgccaccacattcgtgacccccatgcttcgccactccatcgaaaattctagcgttaacgtgtccctgacggctattgccaatcaggctaccgtgctcatggggctgggaaagggctggcctctgagcaaaatggacatcggggtccccctccttgccattggatgttactctcaggttaaccctatcacactgaccgcggccctgctcctgcttgtggctcattacgccatcattggccccggcctgcaagctaaggccacaagagaagcccagaaacgggcggctgccgggatcatgaagaatcctaccgtggatggaattacggtcatcgacctcgagccgattccctatgatcctaagtttgaaaaacagctgggccaggtgatgctgctcatcctttgcgttacacaagtgctgatgatgcgcaccacatgggctctgtgtgaggccctcaccctggccaccgggcccatctccacactttgggagggaaaccctggcagattctggaatacgaccattgctgtcagcatggccaacatctttcgggggtcttacctggcgggagccggcctcctgttctccattatgaagaatacaaccaacacacgcagaggcaccgggaatgtgggagaaacgctgggcgagaaatggaagtcccggctcaacgctcttgggaaatctgaatttcagatctataagaaaagcggcattcaggaggtcgaccgcacactggccaaggagggcatcaagagaggggaaaccgatcaccatgctgtgtcccggggatctgccaaactgagatggttcgttgagcgcaacatggtgacccccgaaggcaaggtcgtggacctcggctgcgggcggggaggctggagctactattgtgggggactgaaaaatgttagagaggtgaagggccttacaaaagggggaccgggccacgaggagcctatccccatgtccacctacggctggaacctggtccgcctccaaagcggggtggatgtgttctttacaccccctgagaagtgcgacacgctgctgtgtgatattggagaatcctctcccaatcctaccatcgaggcgggccggacactcagagttcttaacctggtcgaaaattggctgaacaataacacccagttctgcattaaggtgctcaatccgtatatgcccagcgtgatcgagaaaatggaaacactgcagcgcaagtacgggggagcccttgtccggaaccctctgtccagaaattctacccatgagatgtactgggttagcaacgctacgggcaatattgtgtcctctgtgaacatgatcagccgcatgctcatcaatcggtttaccatgaaacacaagaaagccacatatgagcccgacgtcgatctggggtccggaaccagaaacattggcatcgaaagcgagattcctaacctggacatcgtgggcaagcgcattgaaaagatcaaacaggagcacgaaacatcttggcattacgaccaagatcacccctataagacctgggcttaccatgggtcctatgagacaaaacagaccggaagcgcctcttccatggttaatggcgtggtccggctccttacgaagccgtgggacgtggttcctatggtgacacagatggctatgaccgataccacacccttcgggcagcaaagagtctttaaagagaaggtggacacgcgcacccaggaacctaaggagggaaccaagaagctgatgaaaattaccgccgaatggctgtggaaggagctcggcaaagagaagacacccagaatgtgtacccgggaagagttcacacgcaaagtgagaagcaacgcggccctgggggctgtctttaccgatgaaaataagtggaagtctgcccgggaggctgttgaagacggaagattctgggagcttgtggatcgggagcgcaacctgcacctcgaaggcaaatgcgagacgtgtgtgtacaatatgatgggcaagagagagaaaaagctgggggagtttggaaaagccaagggctcccgggccatctggtatatgtggctgggggcgcgcttcctcgaatttgaggctctgggattccttaacgaggaccactggtttagcagaggcaattccctgagcggggtcgaaggcgagggactccatcggctgggctacatccttcgcgaagtggggaagaaagagggaggcgccatgtacgccgatgacaccgctgggtgggatacaagaattaccctggaagacctcaagaacgaggagatggttacaaatcacatgaaaggagaacataagaaactggccgaggctatcttcaagctgacctatcagaacaaggtggtccgggtgcagcgccctacgcccagaggcacagttatggacattatctctcggaaagatcaacgcgggagcggccaggtgggaacctacggcctcaatacattcaccaacatggaagcccagctgattagacaaatggagggggagggaatctttaagtccatccagcaccttacggcgaccgaagagattgccgtccagaattggctggctcgggtgggccgcgaaagactctctcggatggccatcagcggggacgattgcgttgtgaaaccgattgacgatagattcgcttccgccctgacagcgcttaacgacatgggaaaggtccgcaaagatatccagcaatgggagccttctcggggctggaatgactggacccaggtgcccttttgcagccatcacttccacgaactggtcatgaaggatgggagagtgctcgttgtgccctgtcgcaaccaggacgagctgattggccgggccagaatctcccagggagctggctggtctctgaaggagacagcctgcctcgggaaaagctatgctcaaatgtggaccctgatgtactttcatcgccgggatcttagactggccgctaacgccatctgttccgcggtccctagccactgggtgccgacatctcgcaccacgtggtccattcatgccaagcacgaatggatgacaaccgaggacatgctcgtggtttggaatcgggtgtggatccaggaaaacccctggatggaggataaaacccctgtcgaaagctgggaggaggtgccctatctgggaaagagagaagaccagtggtgcggctctcttattgggctgacatcccgcgctacctgggccaaaaatatccagacagccattaaccaagttcggagcctcatcggaaatgagggctacacggactatatgccttccatgaagagattccggagagaagaggaagaggctggggtgctgtggtga

SEQ ID NO: 19850 - RNA, 9876 nt, synthetic construct
  misc_feature 1..9876: note = derived and/or modified CDS sequence (opt5) from DENV-2__KC294223__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccaaatccagcctcactggattgcggcctctatcattcttgagttctttctgatcgtgctcctgattcccgaacccgagaaacagcggacccctcaggataaccaactgacatacgttgtgatcgctatcctcaccgtcgtggccgctacaatggccaatgaaatggggttccttgagaagacgaagaaagacctgggatttggctccattaccacacaggagagcgaatccaacatcctggacattgatctcagaccggcgtctgcctggaccctgtatgctgtcgccacaaccttcgtgacgcccatgcttcggcatagcatcgaaaatagctctgttaacgtgagcctgaccgctattgccaatcaggctacagtgctcatggggctgggaaagggctggcctctgtccaaaatggacatcggggtccccctccttgccattggatgttacagccaggttaaccctatcaccctgacagcggccctgctcctgcttgtggctcactacgccatcattggccccggcctgcaagctaaggccacccgcgaagcccagaaaagagcggctgccgggatcatgaagaatcctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctctacgctttgggagggaaaccctggccgcttctggaataccacaattgctgtctccatggccaacatctttagagggagctacctggcgggagccggcctcctgttctctattatgaagaataccacaaacacccggcgcggcacggggaatgtgggagaaacactgggcgagaaatggaagtccagactcaacgctcttgggaaaagcgaatttcagatctataagaaatctggcattcaggaggtcgaccggaccctggccaaggagggcatcaagcgcggggaaaccgatcatcacgctgtgagcagaggatccgccaaactgcggtggttcgttgagagaaacatggtgacacccgaaggcaaggtcgtggacctcggctgcgggcgcggaggctggtcttactattgtgggggactgaaaaatgttcgggaggtgaagggccttaccaaagggggaccgggccatgaggaacctatccccatgagcacatacggctggaacctggtcagactccaatccggggtggatgtgttctttacgccccctgagaagtgcgacaccctgctgtgtgatattggagaaagctcccccaatcctacaatcgaggcgggccgcaccctccgggttcttaacctggtcgaaaattggctgaacaataacacacagttctgcattaaggtgctcaatccgtatatgccctctgtgatcgagaaaatggaaaccctgcagagaaagtacgggggagcccttgtccgcaaccctctgagcagaaattccacgcacgagatgtactgggtttctaacgctaccggcaatattgtgagctccgtgaacatgatctctagaatgctcatcaatcgctttacaatgaaacacaagaaagccacctatgagcccgacgtcgatctggggagcggaacacggaacattggcatcgaatccgagattcctaacctggacatcgtgggcaagagaattgaaaagatcaaacaggagcatgaaaccagctggcactacgaccaagatcatccctataagacatgggcttaccacgggtcttatgagaccaaacagacgggatccgccagctctatggttaatggcgtggtccgcctccttacaaagccgtgggacgtggttcctatggtgacccagatggctatgaccgatacaacgcccttcgggcagcaacgggtctttaaagagaaggtggacaccagaacacaggaacctaaggagggaaccaaaaagctgatgaaaattacagccgaatggctgtggaaggagctcggcaaagagaagacaccccgcatgtgtacaagagaagagttcacccggaaagtgcgctccaacgcggccctgggggctgtctttacggatgaaaataagtggaaaagcgccagagaggctgttgaagacggacggttctgggagcttgtggatagagagcggaacctgcacctcgaaggcaaatgcgagacctgtgtgtacaatatgatgggcaagcgcgagaagaagctgggggagtttggaaaagccaagggctctagagccatctggtatatgtggctgggggcgcggttcctcgaatttgaggctctgggattccttaacgaggaccattggttttcccgcggcaatagcctgtccggggtcgaaggcgagggactccacagactgggctacatccttcgggaagtggggaagaaagagggaggcgccatgtacgccgatgacacagctgggtgggatacccgcattacactggaagacctcaagaacgaggagatggttaccaatcatatgaaaggagaacacaagaaactggccgaggctatcttcaagctgacgtatcagaacaaggtggtcagagtgcagcggcctacaccccgcggcaccgttatggacattatcagcagaaaagatcaacgggggtctggccaggtgggaacatacggcctcaataccttcacgaacatggaagcccagctgattcgccaaatggagggggagggaatctttaagagcatccagcatcttaccgcgacagaagagattgccgtccagaattggctggctagagtgggccgggaacgcctctccagaatggccatctctggggacgattgcgttgtgaaaccgattgacgatcggttcgctagcgccctgaccgcgcttaacgacatgggaaaggtcagaaaagatatccagcaatgggagccttcccgcggctggaatgactggacacaggtgcccttttgctctcaccacttccatgaactggtcatgaaggatgggcgggtgctcgttgtgccctgtagaaaccaggacgagctgattggccgcgcccggatcagccagggagctggctggtccctgaaggagaccgcctgcctcgggaaatcttatgctcaaatgtggacactgatgtactttcacagacgcgatcttcggctggccgctaacgccatctgtagcgcggtcccttcccattgggtgccgaccagcagaacgacatggtctattcacgccaagcacgaatggatgaccaccgaggacatgctcgtggtttggaatcgcgtgtggatccaggaaaacccctggatggaggataaaacacctgtcgaatcctgggaggaggtgccctatctgggaaagcgggaagaccagtggtgcggcagccttattgggctgacctctagagctacatgggccaaaaatatccagacggccattaaccaagttcgctccctcatcggaaatgagggctacaccgactatatgcctagcatgaagcggttcagacgggaagaggaagaggctggggtgctgtggtga

SEQ ID NO: 19851 - RNA, 9876 nt, synthetic construct
  misc_feature 1..9876: note = derived and/or modified CDS sequence (opt5) from DENV-2__FJ906959__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacagaggacggcgttaatatgtgcaccctgatggccatggatctcggggaactgtgtgaggacacaatcacctacaaatgcccgttccttaagcaaaacgaacccgaggatattgactgttggtgcaattctacaagcacctgggtgacgtatggaacctgtacaaccacaggcgagcaccgcagagaaaaacggtccgtggcgctggtccctcatgtggggatgggactcgagacccgcacggaaacatggatgtctagcgagggcgcttggaagcacgcccagagaatcgagacctggatcctgcggcatcccggctttacaattatggccgctatcctggcctacaccattgggaccacacacttccagcgcgctctcatctttattctgcttacggccgttgcgccttccatgaccatgagatgcatcggaatttctaaccgggatttcgtggaaggcgtcagcgggggatcctgggtggacatcgttctggagcacggcagctgtgtgacaaccatggccaagaataaacccacactcgattttgaactgatcaagaccgaggctaaacagcctgccacgcttcgcaagtattgcattgaagctaaactgacaaacaccaccacagactctagatgtccgacccaaggggagccctccctcaatgaggaacaggataagcggttcgtctgcaagcatagcatggtggaccgcggatggggcaacggctgtgggctgtttggaaaaggcgggatcgtgacatgcgccatgttcacgtgcaagaaaaatatgaagggaaaagtcgttcagcctgagaacctggaatacaccattgtgatcacaccccactctggcgaggaacatgcggtggggaatgataccggaaagcacggcaaagagattaagatcacacctcagtccagcatcaccgaggccgaactcacgggctatgggaccgtcacaatggagtgttctcccagaaccggactggactttaacgaaatggtgcttctgcaaatggagaataaggcttggctcgttcaccggcagtggttcctggatcttccgctgccttggctccccggcgccgacacacaggggtccaactggattcagaaagaaaccctggtgacgtttaagaatcctcatgctaaaaagcaagacgtcgtggttctgggaagccaggagggcgccatgcacacagccctcaccggggctacagagatccagatgtcctctggcaacctgcttttcaccggacatctgaaatgccgcctcagaatggataagctgcaacttaagggcatgagctactccatgtgtaccgggaaattcaaggtggtcaaagaaattgcggagacacagcacggaacgatcgtgattcgggtccagtatgaaggcgacgggagcccctgcaagatcccctttgagatcatggatctggagaaaagacatgtgctcggacgcctgattaccgttaaccctatcgtgacagaaaaggactctccggtcaatattgaggccgaaccccctttcggcgattcctacatcattatcggggtggagcccggccagctgaagctcaactggtttaaaaagggaagctctattggccaaatgatcgaaaccacaatgcggggggctaaaagaatggccatcctgggagacaccgcctgggatttcggcagccttgggggagtttttacgtccattggcaaggctctgcaccaggtgttcggggccatctacggcgcggctttttctggagtcagctggattatgaaaatcctcattggcgtgatcatcacatggattgggatgaattcccgcagcacctctctgtccgtgagcctggttcttgtcggagtggtgaccctctatctgggcgtcatggtgcaggccgactctgggtgtgttgtgtcctggaagaacaaggagctgaaatgcggaagcggcatcttcattacagataatgtccacacctggacagagcagtacaagtttcaacctgaatccccctctaaactcgccagcgctatccagaaggcccatgaggaagggatttgtggcatccggtccgtgacgagactggagaaccttatgtggaaacagatcaccccggaactgaatcacattctctctgagaacgaggttaagctgacaatcatgaccggagacattaaaggcatcatgcaggctgggaagcgcagcctgcaacctcagcccacagaacttaagtattcctggaaaacctggggaaaggccaaaatgctcagcacggagtctcataatcagaccttcctgattgatggccctgaaacagcggagtgccccaacaccaatcgggcctggaactccctggaagtggaggactacgggtttggagtcttcacaaccaatatctggctcaagctgagagagaaacaggacgtgttttgtgatagcaagcttatgtctgctgccatcaaggacaaccgcgctgttcacgccgatatgggctattggattgaatccgcgctgaatgacacatggaaaatcgagaaggccagcttcattgaagtgaaatcttgccactggcctaagagccataccctctggtccaacggcgtcctggagagcgagatgatcattcccaaaaacttcgctgggccggtgtctcaacacaattaccggcctggatatcatacgcagacagccggcccctggcacctggggaagcttgaaatggattttgacttctgtgagggaaccaccgtggtcgttacagaagattgcggcaacagagggccctccctccgcaccacgacagctagcggaaagctgatcaccgagtggtgctgtcggtcctgcacactgcctccgctcagataccggggcgaagacggctgttggtacgggatggagattcgccccctgaaagagaaggaagagaatcttgtgaactctctggtgaccgccggacatggccagatcgataattttagcctcggggtcctgggaatggccctgttccttgaagagatgctcagaacacgggtgggcaccaaacacgctatcctgctggttgcggtgtcctttgtcacgctcattaccgggaacatgtctttcagagacctgggacgcgtgatggttatggtgggcgccacaatgaccgatgacatcggcatgggggtcacatatcttgctctgctcgccgcctttaaggtgcggcctaccttcgctgccggactgctgcttagaaaactgacgagcaaggaactcatgatgacaaccattggcatcgttctgctctcccaatctacaattcccgagaccatcctggagcttaccgatgcgctggctctcgggatgatggtgctgaagatggtccgcaaaatggaaaagtaccagctggccgtgacaatcatggccattctttgcgtgcctaatgctgtcatcctgcagaacgcctggaaagttagctgtacgattctcgcggtggtgtccgtcagccccctgtttctcacctcttcccagcaaaaggctgactggatccctctggcccttacaattaaaggactgaatcccaccgccatcttcctcacaaccctgagcagaacgaacaagaaacggtcttggccgctgaatgaggctatcatggccgtgggcatggtttccattcttgctagctctctgctcaagaacgacatccctatgacagggcccctggtggccggaggcctcctgaccgtctgctatgtgcttaccggccgctccgcggatctggaactggagagagccgctgacgttaagtgggaagatcaggccgagattagcgggtccagccctatcctctctattacaatcagcgaggacggatccatgtctattaaaaatgaagaggaagagcagaccctgacaatccttatccggacgggcctgctcgtgattagcgggctgtttcccgtctccatcccgattaccgctgccgcctggtacctctgggaggtgaagaaacagcgcgctggagtcctgtgggatgtgccttctccccctcccgttggcaaggcggaacttgaggacggggcctatagaatcaaacaaaagggaattctgggctacagccagatcggcgctggggtgtataaggaaggaacattccacaccatgtggcatgtcacacggggcgccgtgctgatgcacaaagggaagcgcatcgagccctcctgggccgatgttaaaaaggacctcatttcttacggaggcgggtggaaactggaaggagagtggaaggagggcgaagaggtgcaggtccttgctctggaacctggcaagaacccgagagccgtgcagaccaaacccgggctctttaagacgaatgcgggaaccatcggcgctgtgagcctggatttctcccctgggacaagcggatctcccattatcgacaaaaagggcaaagttgtcgggctctacggaaacggcgtggtgacccggtccggcgcctatgtcagcgccattgctcaaacagagaagtctatcgaagataaccctgagatcgaggacgatattttccgcaagagaaaactgaccatcatggaccttcatcccggggccggaaagacaaaacggtacctgcctgcgattgtgagagaagctatcaagcgcggcctgcggacgctcattctggccccgaccagagttgtggccgctgagatggaagaggcccttcgcgggctgcccatccggtatcagacacctgctattagagccgaacacaccggacgcgagatcgtcgacctcatgtgtcatgcgacctttacaatgcggctgctctcccccgtgagagttcctaattacaacctgatcattatggatgaggcccacttcacggaccccgctagcatcgccgctcgcggctatatttccacccgggtggaaatgggggaggccgccggcatctttatgacagctaccccgcctggatctagagatcccttcccccagagcaatgcgcctattatggacgaagagcgggagatccccgaacgctcctggagctctggccacgagtgggtcacagattttaaagggaagaccgtgtggttcgttccttccatcaaggccggaaacgacattgctgcctgccttagaaaaaatggcaagaaagtgatccaactgagccggaagacgtttgattctgaatacgtcaaaacacgcaccaacgactgggatttcgtggtgaccacagacattagcgagatgggggccaattttaaggctgaaagagtcatcgatccgcggagatgtatgaaacccgttattctgaccgacggagaggagcgcgtgatcctcgccggccctatgcccgtgacacattcctctgcggctcagcggagagggcgcatcggccggaaccctaagaatgaaaacgaccagtatatttacatgggagagcccctggaaaatgatgaggactgcgcccactggaaggaagccaaaatgcttctggataacatcaataccccggagggcattatccctagcatgttcgagcccgaaagagagaaggtcgacgctattgatggggaataccgcctccggggagaggccagaaaaacgtttgtggacctgatgcgcagaggcgatctgcctgtttggctcgcgtatcgggtggccgctgaagggatcaactacgccgaccgcagatggtgtttcgatggaattaagaataaccagatccttgaggagaacgtcgaagtggagatctggacaaaagaaggcgagcggaagaagctgaaaccccgctggctggacgctagaatttattccgatcctctcgccctgaaggagttcaaagaatttgctgccgggcggaagtctcttaccctgaatctcatcacagagatgggcagactgcccaccttcatgacgcaaaaagcgcgcgacgccctggataacctcgctgttcttcataccgccgaagctggaggccgggcctacaatcacgccctgagcgagctgccggaaacactcgagaccctgcttctgctcacactgctggctaccgtgacagggggaatttttctcttccttatgtccggcagagggatcggaaagatgaccctgggcatgtgctgcattatcacggcgagcatcctgctctggtatgcccagattcagcctcactggatcgctgcctctattatcctggagtttttccttattgtcctgctcatccccgaacccgagaagcagcgcacacctcaagacaaccagctgacctacgtggtcatcgccattctgaccgtggttgctgccacaatggcgaatgaaatgggctttctcgagaaaaccaagaaagaccttgggctgggatccatcacaacgcagcagccggaaagcaacattctggatatcgacctccggcccgcctccgcttggaccctgtatgccgtggctacaaccttcgtgacacctatgcttagacattctattgagaatagctccgtcaacgtttctctgaccgccatcgcgaatcaagccacggtgctcatgggcctggggaagggatggcccctgagcaaaatggatattggcgtgcctctccttgctatcgggtgttactcccaggtcaaccccatcaccctgacagccgctctgtttctcctggtggcccactacgctattatcggacctggccttcaggccaaggcgacccgggaggcccagaagcgcgctgccgctggcattatgaaaaatccgacagttgacgggatcaccgtgattgatctggaccccatcccttatgatcccaagttcgaaaaacaactcggacaggtcatgctgctggtgctctgcgtcacgcaggtgcttatgatgagaacaacctgggccctgtgtgaggccctgacactcgcgaccggccctatcagcaccctgtgggaagggaaccccggacggttttggaatacaacgattgctgtttctatggccaacatcttccgcggctcctaccttgctggggccggactgctctttagcattatgaagaataccacaaacaccagacggggcacaggcaatatcggggagaccctgggagaaaaatggaagtctcgcctgaacgccctcggcaaatccgagttccaaatttataagaagagcgggatccaggaggtggacagaacgcttgctaaagaaggaatcaagcggggcgagacagatcatcacgccgtctctcgcgggagcgcgaaactgagatggttcgtggaacggaacatggttaccccggagggaaaggtggtcgacctgggctgcggcagagggggatggtcctactattgtggcgggctcaaaaatgtgcgcgaggtgaagggactgaccaagggcgggcctggacatgaagagcccattcccatgtctacatacggctggaaccttgttcggctgcagagcggcgtcgatgtgtttttcacccctcccgaaaaatgcgacacactcctgtgtgatatcggggagtccagccctaatccgacggtggaagccggaagaaccctgcgcgtcctcaaccttgttgagaattggctgaacaataacacacagttttgcattaaggtgctgaatccctatatgccttccgtgatcgagaaaatggaagctctccaacggaagtacggcggggccctggtcagaaaccccctttctcgcaatagcacccacgagatgtactgggtgtccaacgcttctggaaatattgttagctccgtgaacatgatctctcggatgctgatcaatagattcacaatgcgccacaaaaaggccacctatgaacctgacgtcgacctcggcagcgggacgcggaacattggaatcgagtccgaaattcccaacctggatatcattggcaagagaatcgagaaaattaagcaggagcatgaaaccagctggcactacgaccaggatcatccgtataaaacatgggcgtaccacggctcttatgagaccaagcagacagggtccgccagctctatggtgaatggagttgtgcgcctgctcaccaaaccttgggacgtcgtgcccatggtgacacaaatggctatgaccgatacgacaccttttggccagcagcgggtcttcaaggaaaaggttgacaccagaacccaggagcccaaagaagggacaaagaaacttatgaagatcacggccgagtggctgtggaaagagctgggaaagaaaaagacccctcgcatgtgtacaagagaagagtttacccggaaggtgcgctccaacgctgccctcggcgctatcttcacagatgaaaataaatggaagagcgccagagaggcggtggaggactctcggttttgggaactggtcgataaagagagaaaccttcacctggaagggaagtgcgagacctgtgtgtacaatatgatgggaaaacgggaaaagaagctcggcgagttcggcaaagccaaggggtcccgcgctatttggtatatgtggctgggagccagatttctggagttcgaagctctcggctttctgaacgaggaccattggttcagccgggaaaattcccttagcggggttgagggagaaggcctgcacaaactcgggtacatcctgcgcgatgtgtctaagaaagagggcggagccatgtacgccgacgacacagcgggctgggataccagaattacgcttgaggacctgaagaacgaagagatggtcaccaatcatatggaaggggagcacaagaaactcgctgaagccatcttcaagctgacatatcaaaacaaagtggttcgggtgcagcgccccaccccgagaggaacagtcatggatattatcagccggcgcgaccagagaggctccgggcaagtgggaacctacggcctgaatacgtttacaaacatggaggcccagctcatccggcagatggagggggaaggcgttttcaagtctattcagcatctgaccgtgacagaggaaatcgctgtccaaaattggcttgcccgcgtgggaagagagcggctgagccgcatggctatttccggcgatgactgcgtcgtgaaacctctcgatgacagatttgcctctgcgctgaccgcccttaacgatatggggaaggttcggaaggacatccagcagtgggagcccagcagaggatggaatgattggacgcaggtgcccttctgctcccaccactttcatgaactgattatgaaagacggccgcgtcctcgtggtgccttgtcggaaccaagatgagctgatcgggagagctcgcatctctcagggagccggctggagcctgcgggaaaccgcttgcctcgggaagtcctatgcccagatgtggagcctgatgtacttccacagacgcgaccttcggctggcggccaacgctatttgttctgccgttccgtcccattgggtgcccacaagcagaaccacatggtctatccacgctaaacacgagtggatgaccacagaagacatgctcaccgtctggaatcgcgtgtggattcaggagaacccttggatggaggataagacgcccgttgaatcctgggaggaaatcccttatctgggcaaacgggaggaccaatggtgcggaagccttattggcctgacatccagagccacctgggctaagaatatccagaccgccattaaccaggtgcgctctctcatcgggaatgaagagtacacagattatatgcccagcatgaagcggtttagacgggaggaagaggaagcgggagtcctgtggtga

SEQ ID NO: 19852 - RNA, 9876 nt, synthetic construct
  misc_feature 1..9876: note = derived and/or modified CDS sequence (opt5) from DENV-2__KF360005__SS-prME
  source 1..9876: mol_type = other RNA
accgccggcgtgatcattatgagaatccccacagctatggccttccacctgacgacccggaacggggagcctcatatgattgtcagcaagcaggaaaaaggaaagtccctcctgtttaaaacagaggacggcgttaatatgtgcacccttatggcgatggatctgggggaactctgtgaggacacaatcacctacaactgcccgctgcttcgccaaaatgaacccgaggatattgactgttggtgcaactctacaagcacctgggtgacgtatggaacctgtacagctaccggcgagcacagacgggaaaagcgctccgtggccctggtccctcatgtggggatgggactcgagacaagaaccgaaacgtggatgtctagcgagggcgcctggaaacacgctcagcggatcgagacatggatcctgcgccatcccggcttcaccattatggccgctatcctggcctacacaattgggaccacctattttcagagagttctcatcttcattctgcttacagcggtggccccttccatgacgatgcggtgcatcggaatttctaatcgcgattttgtcgaaggcgtgagcgggggatcctgggttgacatcgtgctggagcacggcagctgtgtcaccacaatggctaagaacaagcccaccctcgatttcgaactgatcaaaacagaggccaagcagcctgctacccttagaaaatactgcattgaagccaagctgacgaatacaaccaccgcgtctcggtgtccgacacaaggggagccctccctcaacgaggaacaggacaaacgctttgtgtgcaagcacagcatggtgggaagaggctggggcgatgggtgtggactgttcggcaaggggggaatcgtcacctgcgccatgtttacatgcaaaaagaatatggagggcaaaattgttcagcctgaaaacctggagtatacgatcgtggtgaccccccattctggggaagagaatgctgtcggaaacgacacaggcaagcacggcaaagagattaaggtgacccctcagtccagcatcacagaagccgagctcaccgggtacggaacggttaccatggaatgttctccccggacaggcctggatttcaatgagatggtgcttctgcaaatggaaaacaaagcttggctcgtccatcgccagtggtttctggaccttccgctgccttggctccccggggccgatatccagggatccaattggattcagaaggagaccctggtgacattcaagaaccctcacgccaaaaagcaagacgttgtggtcctgggcagccaggagggggctctccacaccgcgctgacgggcgccacagaaatccagatgtcctctggaaaccttctgtttaccggccatctcaaatgcagactgcggatggacaagcttcaactgaaagggatgagctattccatgtgtacaggaaagttcaaggtggtcaaagagattgctgaaacccagcacggcaccatcgtggttagaattcagtacgagggggatggaagcccctgcaagatccccttcgagatcatggacctcgaaaaacgccatgtgctgggccggctgattacagtcaatcctatcgtgacggagaaggattctccggttaacattgaagccgagcccccttttggggactcctacatcattatcggcgtggaacccggacagctcaaactgagctggttcaagaagggctctagcattgggcaaatgtttgagaccacaatgagaggagccaaacgcatggctatccttggcgataccgcctgggacttcgggtccctgggaggcgtctttacatctatcgggaaggcgctccaccaggtgttcggcgctatttatggagccgcctttagcggcgtgtcctggaccatgaaaatcctgattggggttgtcatcacgtggattggaatgaatagccggtctacatccctgagcgtgtctcttgtgctcgtcggcgtggttaccctgtacctgggggtgatggtccaggctgattccggatgtgtggttagctggagaaacaaggagctcaaatgcggctccgggatcttcatcaccgacaatgtgcatacatggaccgaacagtataagtttcaacctgagtctcccagcaagctggcctccgctattcagaaagcccacgaagagggcatctgtggaattcgctctgtcacacggcttgaaaacctgatgtggaagcagatcacgccggagctcaatcacattctgagcgagaacgaagtgaaactgtccatcatgaccggcgatatcaaggggattatgcaggcgggaaaaagaagccttcgccctcaacccacagagctcaagtactcttggaaaacctggggcaaggccaagatgctgtccacagaacctcataatcagaccttcctgatcgacgggcccgagacggctgaatgccctaacaccaatcgggcctggaacagcctcgaggttgaggattatggatttggcgtgttcacaaccaatatttggctgaaacttaaggaaagacaggacgtcttttgtgactctaaactgatgtccgctgccatcaaggataaccgcgcggtgcacgccgacatgggctactggattgagagcgctctcaatgatacatggaaaatcgaaaaggcctctttcatcgaggtgaagagctgccattggcccaaatcccacaccctgtggagcaacggggtcctggagtctgaaatgattatcccgaagaacttcgctggacctgtttcccagcacaattatcggcccggctaccatacacaaaccgccgggccctggcaccttggaaaactcgagatggactttgatttctgtgaaggcacgacagtggtggtcaccgaggactgcgggaacagaggacctagcctgcggaccacaaccgcctccggcaagctgattacggaatggtgctgtcgctcttgcacactcccgcccctgagataccggggcgaggatgggtgttggtatggaatggagatcagacctcttaaagaaaaggaggaaaatctggtgaacagcctcgttaccgctggccatgggcagattgacaatttttccctgggagtgctgggcatggcgcttttcctcgaggaaatgctgcgcacacgggtcgggaccaagcacgccgtgctgctcgttgctgtgtcttttatgacactgatcaccggaaacatgagcttcagagatcttggccgcgtcatggtgatggttggcgccgccatgacggacgatattgggatgggagtgacctacctggctctcctggccgcgtttaaagtcagacccacattcgctgccggcctgcttctgcggaagctcacctccaaagagctgatgatgacaaccatcgggatcgtgctcctgtctcagagcacgacacctgagaccattcttgaactgacagacgccctcgctctgggaatgatgatcctgaagattgtgcgcaatatggagaaatatcaacttgccgtcaccatcatggcgattctgtgcgttcccaacgctgtgatcctccagaatgcctggaaggtgtcctgtaccatcctggccgctgtcagcgtgtctcctctcctgcttacatccagccagcagaaggccgattggattcccctggctctcacgatcaaaggcctgaacccgaccgccatttttctgacaaccctttctagaacaaataagaaacggtcctggcctctgaacgaagcgatcatggccgttgggatggtgagcattctcgcttcttccctgctcaagaatgacatccccatgaccggacctctggtcgccggcggccttctgacggtgtgctacgttctgacagggcgcagcgctgacctcgagctggaaagagccgccgatgtgcggtgggaggaccaagctgaggtctccggaagctctcccatccttagcattaccatctccgaagatggctctatgagcattaaaaacgaggaagaggagcagaccctgacaatcctcattcgcaccgggctgctcgtgatctccggactgttcccggtctctattcctatcacagcggccgcttggtatctttgggaagtgaagaaacagagagccggcgttctgagcgccgtgccctcccctccccccgtcgggaaggctgagctggaagacggagcctaccggatcaagcagaaaggcattctcggctattctcaaatcggggcgggagtgtacaaggagggcacgtttcataccatgtggcacgttacacgcggggctgtgctgatgcacaaaggaaagagaattgaacctagctgggccgatgtccggaaagaccttatctcctacggcgggggaagaaagctggagggcgagtggaaggaaggcgaggaagtgcaggtgctcgccctggagccggggaaaaatccccgcgctgttcagaccaagcctggactcttcaaaacaaacaccggcacgattggggccgtcagcctggatttttctcccggagcgtccggcagccctatcgtggacaagaaagggaaggtggtcggactttatggcaacggcgtggttacccggtctgggacatacgtgtccgctatcgcccagaccgaaaagagcattgaggataatcccgagatcgaagacgatattttcagaaaaaagcgcctgacaatcatggacctgcatcctggagccggcaaaaccaagcggtatctcccggctattgtcagagaggccatcaaacgcgggctgcggacacttatcctggctcccacgagagtggttgccgcggaaatggaggaagccctccgcggactgcctattcggtaccaaacccccgctatcagagccgagcacacaggccgggagattgtggatctcatgtgtcatgctaccttcaccatgcgcctgctttcccctgtcagagtgcccaactataatctgatcattatggacgaagcccactttacagacccggcctctatcgctgcgcgggggtacattagcacgcgcgttgagatgggcgaagccgctggaatcttcatgaccgccacacctcccggctccagagatccctttcctcagagcaacgcccccatcatggacgaggagcgggaaattcctgagagatcttggaattccgggcatgaatgggtgaccgatttcaagggaaagacagtctggtttgtgccgagcatcaaagctggcaacgacattgccgcgtgcctgcgcaagaatgggaaaaaggtgatccagctctctcggaaaaccttcgatagcgagtatattaagacgagaacaaacgactgggattttgtcgttaccaccgacatctccgaaatgggagctaatttcaaggccgagcgcgtgatcgatccccggagatgtatgaaacctgtgattctgacagacggcgaggaacgcgtcatccttgccgggcccatgcctgtgacccactctagcgctgcccaacggagaggccgcattggaagaaaccccaagaatgagaacgatcagtacatctacatgggcgaaccgctggagaatgacgaagactgcgcgcactggaaagaggccaagatgctcctggataacattaatacacctgaggggatcatcccctccatgtttgaacctgagcgggaaaaagttgacgctattgatggagagtatcgcctgagaggcgaagcccggaagaccttcgtggacctcatgcgcagaggggatcttcccgtctggctggcttaccgggtggccgctgagggaatcaactatgccgacagacgctggtgttttgatggcattaaaaacaatcagatcctggaggaaaacgttgaggtggaaatttggacgaaggagggggagcggaagaaactcaagcctagatggctggacgcgcgcatctactctgatccccttgccctgaaagaattcaaggagttcgctgccggccggaaaagcctcacactgaatctgattaccgaaatgggaagactcccgacatttatgacccagaaggctcggaacgcccttgacaatctggccgtcctgcatacggctgaggcgggcgggcgcgcctataaccacgctctctccgaactgcctgagacccttgagacactgctcctgctgaccctccttgccacagtgaccggaggcatcttcctgtttctgatgagcgggaagggaatcggcaaaatgacactcggcatgtgctgcattatcaccgcctctattctgctttggtacgctcaaatccagccccattggattgccgcgtccatcatcctggaattctttctcattgtcctgctgatccccgagcctgaaaagcagagaacgccgcaggataatcaactcacatatgtggttattgccatccttaccgtggtggctgccaccatggctaacgagatggggttcctggaaaaaacaaagaaagactttggactgggcagcattgccacccagcagcccgagtccaatatcctcgatatcgacctgcggcctgcgtctgcctggacactttacgctgtcgccacgaccttcattacacccatgctgcgccacagcatcgagaactcctctgttaatgtgagcctcaccgctattgccaaccaggctacagtgctgatggggctgggaaagggctggcctctctccaagatggacatcggggtcccccttctggccattggatgttacagccaagtgaatcctatcaccctgacggcggccctcctgcttctggttgctcactatgccattatcggcccgggcctccaggctaaagccaccagagaagcccagaagcgggcggctgccgggatcatgaaaaaccccacagctgatggaattaccgtgatcgacctggatcctattccctacgaccctaagtttgagaaacagctgggccaagtcatgctccttgtgctgtgcgtcacacaggtgctgatgatgcgcaccacgtgggccctctgtgaagccctgacacttgctaccgggcccatctctacactgtgggagggatccccgggcagattctggaataccaccattgccgttagcatggcgaacatctttcgggggtcttatctcgccggagctggcctgctgttctccatcatgaagaatacaacgaacacccgcagaggcacagggaacaccggagaaacactcggcgagaagtggaaaaatcggcttaacagcctggggaagtctgagtttcagatttacaaaagaagcggaatccaagaagtggatcgcaccctggccaaggagggcattaaacggggggaaacggaccatcacgctgtctccagaggatctgccaagctccgctggttcgtggagcggaatctggttacacctgagggcaaagtggtcgatcttggctgcgggagaggaggctggagctattactgtgggggactgaagaacgtgcgcgaagtgcggggcctcaccaaggggggacccggccatgaggaacccatccctatgtccacctatggctggaatctggttagactgcagagcggggtcgacgtgttctttacaccccctgagaaatgcgataccctcctttgtgacattggagaatcctctccgaaccccacagtggaggcgggccgcacgctgcgggtcctgaatctcgttgagaactggctgaataacaatacccagttctgcatcaaggtgcttaacccttacatgcccagcgtgatcgaaaaaatggagacactgcagagaaagtacgggggagccctcgtccgcaatcctctgtcccggaactctacccacgaaatgtattgggtgagcaatgcttccggcaacattgtttctagcgtgaacatgatctccagaatgctgattaatcgctttacaatgagacataaaaaggccacctacgagcccgatgtcgacctcgggagcggaacgcggaacatcggcattgaatctgagaccccgaatcttgatatcatcggcaagcgcattgagaaaatcaagcaagaacacgagacatcctggcactatgaccaggaccatccttacaaaacctgggcttatcacgggagctacgaaacaaagcagaccggatctgcctccagcgtggttaacggcgtggtcagactgctgacaaaaccctgggatgtgattcctatggtgacccagatggctatgacggacacaacccccttcgggcaacagcgggtctttaaggagaaggttgataccagaacacaggaacctaaagagggaacgaagaaactcatgaagatcaccgccgagtggctgtggaaagaacttggcaagaagaaaacaccccggatgtgtacccgcgaggaattcgcgagaaaggtgcggtctaatgccgctctgggggccatttttacagacgagaacaaatggaagtccgctcgcgaggccgtggaagatagcagattctgggagctcgtcgacaaagaacggaatctgcatctggagggaaagtgcgaaacctgtgtgtataacatgatgggcaaacgcgagaagaagatcggcgagtttgggaaagccaagggatccagagcggtttggtacatgtggctcggcgctcggttcctggaatttgaggcccttgggttcctgaatgaagatcactggtttagccgcgagaactctctcagcggagtggaaggcgaggggctgcacaaacttggctacattctgagagaggtctccaagaaagaaggaggcgccatgtatgctgacgatacagccgggtgggacacccggatcacgctcgaggatctgaagaatgaagagatggtgaccaaccatatggaaggagagcacaagaaactggctgaggccatcttcaagctcacataccagaataaagttgtgcgcgtccaaagaccgacccctcggggcacagtgatggacattatctctcgcagagaccagcggagctccgggcaggttggaacctatggcctgaacacgttcacaaatatgggggcgcaacttattagacagatggaaggcgagggagtgtttaagggcatccagcatctgaccgccacagaagaggtcgctgtgcaggattggctcgcccgcgtcgggcgggagagactgtctcgcatggctattagcggagacgattgcgtggttaaaccccttgacgatcggttcgcctccgcgctgaccgccctcaacgacatgggcaaggtgagaaaggatatccaacagtgggaaccctctcgcgggtggaacgactggacgcaggtccctttttgcagccaccatttccacgagctgatcatgaaagatggacgggtgctggtggttccgtgtagaaatcaggacgaactcattggccgcgctcggatctcccaaggggccggctggagcctgagagagaccgcttgccttggaaagtcttacgcccagatgtggtccctgatgtattttcaccgccggggcctcagactggctgccaacgcgatttgtagcgccgtgccctctcattgggtccctacatcccggaccacatggagcatccacgctagacatgaatggatgaccacagaggatatgcttaccgtgtggaatcgcgtttggattcaggagaacccctggatggaagacaaaacgcctgtggagtcctgggaagagatcccctacctggggaagcggggagatcagtggtgcggctctctcatcgggctgacaagcagagccacctgggcccgcaatattcaaaccgctatcaacagagtccggtccctgattggaagcgaaggctatacagactacatgccttctatgaaacgcttcagacgggaggaggacgaagccggggtgctctggtga

SEQ ID NO: 19853 - RNA, 9876 nt, synthetic construct
  misc_feature 1..9876: note = derived and/or modified CDS sequence (opt5) from DENV-2__KJ010185__SS-prME
  source 1..9876: mol_type = other RNA
accgccggagtgatcattatgctgatccccaccgctatggccttccacctcacgaccagaaatggggaacctcatatgattgttagcaagcaggaaaaaggaaagtccctgctttttaaaaccgaagacggcgttaatatgtgcaccctgatggcgatggatctcggggaactgtgtgaagacacaatcacctacaactgcccccttctgcggcaaaatgaacccgaggatattgactgttggtgcaacgctacatctacctgggtgacgtatggaacctgtacagccaccggcgagcaccgcagagaaaagcggagcgtggccctcgtccctcatgtggggatgggactggagacacgcaccgaaacgtggatgtcctctgagggcgcttggaaacacgcccagagaatcgagacatggatcctgcggcatcccggcttcaccattatggctgccatcctcgcgtacacaattgggaccacctattttcagcgcgttctgatcttcattcttctgacagccgtggctcctagcatgacgatgagatgcatcggaatttccaatcgggattttgtcgaaggcgtgtctgggggaagctgggttgacatcgtgctcgagcacggctcctgtgtcaccacaatggccaagaacaagcccaccctggatttcgaacttatcaaaacagaggctaagcagcctgccaccctgcgcaaatactgcattgaagcgaagctcacgaatacaaccaccgccagcagatgtccgacacaaggggagccctctctgaacgaggaacaggacaaacggtttgtgtgcaagcactccatggtggatcgcggatggggcaatggctgtgggctgttcggaaagggcgggatcgttacctgcgctatgtttacatgcaaaaagaacatggagggaaaaattgtccagcctgaaaatctcgagtatacgatcgtggtgacaccccatagcggcgaagagaacgccgtcgggaatgacacaggaaagcacggcaaagagattaaggtgacccctcagtcttccatcacagaagctgagctgaccggctacgggacggttaccatggaatgtagccccagaacaggacttgatttcaacgagatggtgctgctccaaatggaaaataaagcctggctggtccatcggcagtggtttcttgacctgccgctcccttggctgcccggcgccgatatccaggggtctaactggattcagaaggagaccctggtgacattcaagaaccctcacgctaaaaagcaagacgttgtggtcctcggatcccaggagggcgcgatgcacaccgccctgacgggggctacagaaatccagatgagctccggcaatcccctttttaccggacatctgaaatgccgcctcagaatggacaagctgcaacttaaaggcatgtcttatagcatgtgtacagggaagttcaaggtggtcaaagagattgccgaaacccagcacggaaccatcgtggttcggattcagtacgagggcgatgggtccccctgcaagatccctttcgagatcatggacctggagaagcggcatgtgctcggacgcctgattacagtcaacccgatcgtgacggagaaggatagccccgttaatattgaagccgagcctccctttggcgactcttacatcattatcggggtggaacctggccagctgaaactctcctggttcaagaagggaagctctattggccaaatgtttgagaccacaatgagaggggctaaaagaatggccatcctgggagataccgcgtgggacttcggcagccttgggggagtctttacatccatcggcaaggctctgcaccaggtgttcggggccatttatggcgccgctttttctggagtgagctggaccatgaaaatcctcattggcgttgtcatcacgtggattgggatgaactcccgcagcacatctctgtccgtgagcctggtgcttgtcggagtggttaccctctacctgggcgtgatggtccaggccgattctgggtgtgtggtttcctggaagaataaagagctgaagtgcggaagcggcatcttctttaccgacaacgtgcatacatggaccgaacagtataagttccaacccgagtccccgtctaaactcgctagcgccatccagaaggcgcacgaagaggggatttgtggcatccggtccattacaagactggataatcttatgtggaaacagatcacgcctgaactgaaccacattctctctgagaatgaggtcaagctgagcatcatgaccggagacatcaaaggcattatgcaggccgggaagcgctccctgcggccccaacctacagaacttaaatacagctggaagacctggggaaaggctaaaatgctctctacagagccccataaccagacctttctgatcgatggccctgaaacggcccagtgccccaataccaacagagcttggaactccctggaggtggaagactatgggttcggagtttttacaaccaacatttggctcaagctgaaagagcgccaggacgtgttctgtgatagcaaacttatgtctgccgcgatcaaagacaatcgggccgtccacgctgatatgggctactggattgagtccgccctgaacgacacatggaagatcgaaaaggctagcttcatcgaggtgaaatcttgccattggcccaagagccacaccctctggtccaacggcgtgctggaaagcgagatgattatccctaaaaattttgccgggcccgtctctcaacacaactatagacccggataccatacacagaccgccggcccttggcacctggggaaacttgagatggatttcgacttttgtgaaggaacgacagttgtggtgaccgaggattgcggcaatcgcgggccgtccctccggaccacaaccgctagcggaaaactgattacggaatggtgctgtagatcctgcacactgccccctctccggtaccgcggcgaggacggctgttggtatgggatggaaatcagacccctgaaggagaaggaggaaaaccttgtcaattctctggtgaccgcgggacatggccagattgataacttcagcctcggggttctgggaatggccctgtttcttgaggaaatgctccggacaagagtgggcaccaaacacgctgtcctgctggtggccgtttccttcatgacactcatcaccgggaatatgtcttttcgcgacctgggacgggtgatggtcatggtgggcgccgctatgacggatgacattggcatgggggttacctaccttgccctgctcgcggctttcaaggtgagacctacatttgccgccggactgctgcttcgcaaactgaccagcaaggagctcatgatgacaaccatcggcatcgtcctgctctcccaatctacgacacccgaaaccattctggagcttacagatgctctggccctcgggatgatgatcctgaaaattgtgagaaacatggagaagtatcagctggcggtgaccatcatggctattctttgcgtccctaatgccgttatcctgcagaacgcctggaaggtgagctgtaccatcctcgctgccgtgtccgtcagccccctgctcctgacatcttcccagcaaaaagctgactggattccgcttgccctgacgatcaagggactcaatcctaccgcgattttcctgacaaccctgagccggacaaacaaaaagcgctcttggccccttaatgaagccatcatggctgtgggcatggtttccattctggccagctctctcctgaaaaacgacatccctatgaccgggcccctcgtggctggaggcctgcttacggtctgctacgtgctgacaggcagatccgccgatctggagctcgaacgggccgctgacgttcgctgggaggatcaggcggaaatcagcgggtccagcccgattctgtctatcaccattagcgaggacggatccatgtctatcaagaatgaggaagaggaacagacccttacaattctgatcagaaccggcctcctggtgattagcgggctctttcctgtctccatccccatcacagccgctgcctggtatctgtgggaggtgaaaaagcagcgggccggagtcctttgggatgtgccttctccgccccctgttggcaaggctgagctggaagacggggcctaccgcattaaacaaaagggaatcctgggctatagccagattggcgcgggggtgtacaaagagggaacgttccataccatgtggcacgtcacaagaggcgctgtgctcatgcacaaggggaaacggatcgaaccgtcctgggccgatgttcgcaaggacctgatttcttacggaggcgggtggaaacttgagggagaatggaaagagggcgaggaagtgcaggtcctggccctcgagcccggcaagaaccctagagctgtgcagaccaaacccgggctgtttaagacaaacaccggaacgatcggcgccgtgagcctcgatttctcccctgggaccagcggatctcccatcgttgacaaaaagggcaaggtcgtggggctgtatggaaatggcgtggtcacacggtccggcacctacgtgagcgcgattgctcaaacagaaaaatctatcgaggataaccctgaaattgaggacgatatcttcagaaagaaacgccttaccattatggacctgcatccgggggccggaaagacaaaacggtatctgcccgccatcgttagagaggctatcaagcgcggcctccggacgctgattcttgcccctaccagagtggtcgctgccgaaatggaggaagcgctgcgcgggctccccatccggtaccagacccctgccattagagctgagcacaccggacgcgaaatcgtggacctgatgtgtcatgccacctttacaatgcggctcctgtcccccgttagagtgccgaattataaccttattatcatggatgaggctcacttcacggaccctgccagcattgccgctcggggctacatctccacccgcgtcgagatgggggaagcggccggcatctttatgacagctacaccgcccggatctagagatcctttcccccagagcaatgcccctattatggacgaggaacgggagatcccggagcgctcctggaacagcggccatgaatgggtgacagattttaaggggaaaaccgtttggttcgtgccctctattaaggccggaaatgacatcgctgcctgcctgcgcaaaaacggcaagaaagtcattcaactgtcccggaagacgtttgatagcgagtatatcaagacaagaaccaatgactgggatttcgtggtgaccacagacatctctgaaatgggggcgaactttaaagctgagcgcgtcattgatcctcggagatgtatgaagcccgttatcctcaccgacggagaagaaagagtgattctggccggccctatgcccgtgacacacagctccgccgctcagcggagagggcgcatcggccggaatccgaaaaacgagaatgaccagtacatttacatgggagaacctcttgagaacgatgaagactgcgcccactggaaggaggcgaaaatgctgctcgataatatcaacacccccgaaggcatcattccttctatgttcgagcccgagagagaaaaggtcgacgccatcgatggggagtatcgcctgagaggagaagctcggaaaacgtttgtggacctgatgcgcagaggcgatctccctgtttggcttgcctaccgggtggctgccgaggggattaactatgctgaccgcagatggtgtttcgatggaatcaagaataaccagattctggaagagaatgtcgaggtggaaatctggacaaaggagggcgaacggaaaaagctgaaacccagatggctcgacgcccgcatttacagcgatccgctggcgcttaaggagttcaaagagtttgccgctgggcggaagtccctgaccctcaacctgatcacagaaatgggcagactgcctaccttcatgacgcaaaaggcccgcaatgctctcgacaaccttgccgttctgcataccgccgaggctggaggccgggcgtataatcacgccctgtctgaactccccgagacactggaaacccttctgctcctgacactgctcgctaccgtgacagggggaatctttcttttcctgatgagcggcaaagggattggaaagatgaccctgggcatgtgctgcatcattacggcctccatcctcctgtggtacgcccagattcagccccattggatcgctgccagcatcattcttgagtttttcctgatcgtcctcctgattcctgagccggaaaaacagagaacaccccaagataaccagctgacctatgtggtcatcgcgattctcaccgtggttgccgctacaatggccaatgagatgggctttcttgaaaagaccaaaaaggacttcgggctgggatctatcgctacacagcagcctgagtccaacatcctggacattgatctccggcccgccagcgcgtggacgctgtacgccgtggctaccacatttatcacccctatgcttcgccactccattgaaaattctagcgtgaacgtctccctgacagccatcgctaatcaagccaccgttctcatgggcctggggaagggatggcccctgtctaaaatggacattggcgtgcctctccttgctatcgggtgttacagccaggtgaacccgattacgctgaccgccgcgctgctcctgcttgtcgcccactatgctatcatcggacccggcctgcaggccaaggcttccagagaggcccagaaacgggccgcggctggcattatgaagaatcctacagtggatgggatcaccgttattgacctcgatcccatcccttacgaccccaaattcgagaagcaactgggacaggtgatgctgctcattctttgcgtcacacaggtgctgatgatgcgcaccacgtgggccctgtgtgaagctctcacactggccaccggcccgatcagcacactttgggaggggaaccctggaagattttggaataccaccatcgccgtctctatggctaacattttccggggctcctatctggccggggcgggactcctgtttagcatcatgaagaacacaacgaatacccgcagaggcacaggcaacaccggggaaacactgggagagaaatggaagaatcgggtgtctctccttggcaaatccgagttccaaatttacaagcgcagcgggatccaggaggttgatagaaccctggccaaagagggaattaagcggggcgaaacggaccatcacgctgtgtctagagggagcgccaaactgcgctggttcgtcgagcggaacctcgtgacacccgaaggaaaggttgtggatctgggctgcggcagagggggatggtcctattactgtggcgggcttaagaatgtccgcgaggtgaaaggactgaccaagggcgggcccggacatgaggaacctatccccatgtctacctatggctggaacctcgtgcggctgctgacaggcgctgacgtctttttcacccctccggagaaatgcgatacactcctttgtgacatcggggaaagctcccccaatcctacggtcgaggccggaagaaccctgcgcgtgctgaacctcgtggaaaattggctgaacaataacacacagttttgcattaaggtccttaatccctacatgcctagcgttatcgagaaaatggagaccctgcagcggaagtacggcggggcgctcgtgagaaaccccctgtcccgcaattctacacacgaaatgtattgggtgagcaacgcctccggaaacattgtctctagcgtgaatatgatctcccggatgctgattaacagattcaccatgcgccataagaaagctacgtacgatccggacgttgacctcggctctgggacccggaatatcggaatcgagagcgaaacacctaaccttgatattatcggcaagagaattgagaaaatcaagcaagaacacgagacctcccgccactatgaccaggatcatccctacaaaacatgggcctatcacggcagctacgagaccaagcagacagggtctgcttccagcaccgtgaatggagtcgtgagactgctgacgaagccttgggacgttattcccatggtgacacagatggccatgaccgataccacaccttttggccaacagcgggtcttcaaagaaaaggtggacacgcgcacccaggagcccaaagaagggacaaagaaactcatgaagatcaccgctgagtggctgtggaaggaacttggcaagaagaaaacaccgagaatgtgtacccgggaggagtttgccagaaaggtgcggtctaacgcggccctgggcgctattttcacagatgaaaataaatggaagtccgcccgcgaggctgtcgaagacagcagattttgggagctcgttgataaagagcggaacctgcatctggaagggaagtgcgagacctgtgtgtataatatgatgggaaagcgcgagaagaagatcggcgagttcggcaaagccaaggggtctagagccatctggtacatgtggctcggagcgcggtttctggagttcgaggctcttggctttctgaacgaggaccactggttctcccgcgaaaatagcctctccggggtggagggagaaggcctgcacaaacttgggtacattctgagagaggtcagcaagaaggaaggcggagccatgtatgccgatgacacggctggctgggacacccggatcacactcgaggatctgaaaaacgaggaaatggtgaccaatcatatggagggggaacacaagaaactggccgaggctattttcaagctcacataccagaacaaagttgtgcgcgtccaaagacctacaccccggggaacggtgatggacatcatttctcgcagagatcagcggggcagcgttcaggtggggacatatggactgggcacctttacaaatatgggggcccaacttatccgccagatggaaggcgagggagtcttcaagggcatccagcatctgaccgcgacggaggaagtggccgttcaggactggctcgctagagtggggcgggagagactgtcccgcatggccatttctggagatgactgcgtcgtgaagccccttgatgaccggtttgctagcgccctgaccgcgctcaacgatatgggcaaagtcagaaaggacatccaacagtgggaaccttcccgcgggtggaacgattggacacaggtgccgttctgctctcaccattttcacgagctgattatgaaagacggacgggttctggtggtcccctgtagaaatcaggatgagctcatcggccgcgcccggattagccaaggggctggctggtccctgagagaaaccgcctgccttggaaagtcttacgctcagatgtggagcctgatgtatttccaccgccgggacctcagactggccgctaacgccatctgttccgcggtgcctagccattgggtgcccacatctcgcaccacatggtccatccacgccggccatgagtggatgaccacggaagacatgcttacagtttggaatcgggtgtggattcaggagaacccttggatggaagataaaacccccgtcgagagctgggaggaaatcccttacctggggaagagagaggaccagtggtgcggatctctcattggcctgacctcccgggctacatgggccagaaatatccaaaccgccattaaccaggtgcgcagcctgatcgggtccgaagagtatacagattacatgccctctatgaagcggtttggaagagaagaggaggaagctggcgttctctggtga

SEQ ID NO: 19854 - RNA, 9876 nt, synthetic construct
  misc_feature 1..9876: note = derived and/or modified CDS sequence (opt5) from DENV-2__KJ010186__SS-prME
  source 1..9876: mol_type = other RNA
accgccggcgtgatcattatgctgatccccaccgctatggccttccacctgacgaccagaaatggggagcctcatatgattgtcagcaagcaggaaaaaggaaagtccctgctttttaaaaccgaggacggcgttaatatgtgcaccctgatggcgatggatctcggggaactgtgtgaggacacaatcacctacaattgcccgcttctgcggcaaaatgaacccgaggatattgactgttggtgcaacgctacatctacctgggtgacgtatggaacctgtacagccaccggcgagcaccgccgggaaaagcggagcgtggccctcgtccctcatgtggggatgggactggagacacgcaccgaaacgtggatgtcctctgagggcgcttggaaacacgcccagagaatcgagacatggatcctgcggcatcccggcttcaccattatggctgccatcctcgcgtacacaattgggaccacctattttcagcgcgttctgatcttcattcttctgacagccgtggctcctagcatgacgatgagatgcatcggaatttccaatcgggattttgtcgaaggcgtgtctgggggaagctgggttgacatcgtgctcgagcacggctcctgtgtcaccacaatggccaagaacaagcccaccctggatttcgaacttatcaaaacagaggctaagcagcctgccaccctgcgcaaatactgcattgaagcgagactcacgaatacaaccaccgccagccggtgtccgacacaaggggagccctctctgaacgaggaacaggacaagcgctttgtgtgcaaacactccatggtggatagaggatggggcaatggctgtgggctgttcggaaagggcgggatcgtgacatgcgctatgtttacatgcaagaaaaacatggagggaaagattgttcagcctgaaaatctcgagtatacgatcgtggtgacaccccatagcggcgaagagaacgccgtcgggaatgacacaggaaaacacggcaaggagattaaagtgacccctcagtcttccatcacagaagctgagctgaccggctacgggacggttaccatggaatgtagcccccggacaggacttgatttcaacgagatggtgctgctccaaatggaaaataaggcctggctggtccatcgccagtggtttcttgacctgccgctcccttggctgcccggcgccgatatccaggggtctaactggattcagaaagagaccctggtgacattcaagaagcctcacgctaaaaagcaagacgttgtggtcctcggatcccaggagggcgcgatgcacaccgccctgacgggggctacagaaatccagatgagctccggcaaccttctgtttaccggacatctcaaatgcagactgcggatggacaaacttcaactgaaaggcatgtcttatagcatgtgtacagggaagttcaaggtggtcaaagagattgccgaaacccagcacggaaccatcgtggttagagtgcagtacgagggcgatgggtccccctgcaagattcccttcgagatcatggacctcgaaaaacgccatgtcctgggacggctgatcacagtgaatcctattgttacggagaaggatagcccggtgaacatcgaagccgagcccccttttggcgactcttacattatcattggggtcgaacccggccagctcaaactgtcctggttcaagaagggaagctctatcggccaaatgtttgagaccacaatgagaggggctaaacgcatggccattcttggagataccgcgtgggacttcggcagcctcggaggggtgtttacatccatcggcaaggctctccaccaggtgttcggggccatctatggcgccgctttttctggagttagctggaccatgaaaattctgatcggcgtcgtgattacgtggatcgggatgaactcccggagcacatctctgtccgtgagccttgtcctcgtgggagttgtgaccctgtacctgggcgtcatggtgcaggccgattctgggtgtgttgtgtcctggaagaacaccgctctcaaatgcggaagcggcattttcatcacagacaatgtccatacctggacagagcagtataagtttcaacctgaatccccctctaagctggccagcgcgatccagaaagcccacgaggaagggatttgtggcatcagatccgtgacgcgccttgagaacctgatgtggaagcagattaccccggaactcaatcacatcctgtctgagaacgaggttaaactgagcattatgacaggagatatcaagggcatccttcaggctgggaaacggtccctcagacctcaacccaccgaactgaagtacagctggaaaacatggggaaaggccaagatgctgtctaccgagtcccataatcagacgttcctcattgacggccctgaaaccgctgagtgccccaacacaaatcgcgcctggaacagcctggaagtggaggattatgggtttggagtcttcaccacaaatatctggcttaaactgaaggagcggcaggacgtgttttgtgactctaaactcatgtccgcggccattaaggataacagagctgtgcacgccgacatgggctactggatcgaaagcgctctgaatgatacctggaaaattgagaaggcctctttcatcgaagtcaagagctgccattggcctaaatcccacacactgtggagcaacggcgttcttgagtctgagatgatcattcccaagaacttcgccgggccggtgtcccagcacaattatcgccctggataccatacccaaacggctggcccctggcacctcgggaaactggaaatggactttgatttctgtgagggaacaaccgtggtcgtgaccgaagactgcggcaaccgggggcccagcctgagaacaaccacggcgtccggaaagctcatcacagagtggtgctgtcggtcttgcaccctgcctccgcttcgctacagaggcgaagatggctgttggtatgggatggagattcggcccctgaaagagaaggaagagaatctcgttaacagcctggtgacagccggacatggccagatcgacaatttttccctgggggtccttggaatggctctcttcctggaagagatgctgagaacccgcgtgggcacaaagcacgccgttctcctggtggccgtctcttttatgacccttattacggggaacatgagcttccgggatctgggaagagtgatggttatggtgggcgctgccatgaccgacgatatcggcatgggggtcacatacctcgcgctgctggctgcctttaaagtgcgccctaccttcgccgctggacttctgctcagaaagctgacatccaaagaactcatgatgaccacgattggcatcgtgctgctttctcagagcacaacccccgagacaatcctggagctcaccgacgccctggcgctggggatgatgattcttaagatcgtccggaatatggaaaaatatcaactggctgttaccattatggccatcctctgcgtgcctaacgccgtgattctgcagaatgcttggaaggtctcctgtacaatcctcgccgctgtgagcgtttctcccctgcttctgacgtccagccagcagaaggccgattggatccctctcgcgctgaccattaaaggactgaaccccacagccatctttcttaccacactgtctcgcaccaataagaaaagatcctggccgctcaacgaggctattatggccgtgggcatggtcagcatcctggcttcttccctcctgaagaatgacattcctatgacggggccccttgtggccggaggcctgctgacagtttgctacgtgctcaccggccggagcgccgacctggaacttgagcgcgctgcggatgtcagatgggaagaccaagccgagatctccgggagctctcctatcctgagcattaccatctccgaggatggatctatgagcattaaaaacgaagaggaagaacagacactcaccatcctgattcggacaggcctcctggtgatctccgggcttttccccgtctctattccgatcacggctgccgcctggtatctgtgggaggtgaagaaacagcgcgctggagttctgtgggacgtgagaagctaccctcccgtcggcaaggccgaactcgaggatggggcgtatcggatcaagcagaaagggattctgggctactcccaaatcggcgctggggtgtacaaggaaggaacctttcatacaatgtggcacgttacccgcggcgccgtgcttatgcacaaagggaagagaattgagccttcttgggccgacgtccggaaagatctgatcagctatggaggcgggtggaagctcgaaggagagtggaaggagggcgaagaggtccaggtgctggctctcgaacccggcaaaaatcccagagccgttcagacaaagcctgggctgttcaaaaccaacacgggaaccattggcgcggtctcccttgactttagcccggggacatctggatcccccatcgtggataagaaaggcaaggtggtcgggctgtacggaaacggcgtggttacccgcagcggcacatatgtgtctgctatcgcccagaccgagaagtccattgaagacaatcctgagatcgaggatgacattttccggaaaaagagactgacaatcatggatctccatcccggggccggaaaaacgaagcgctacctgcctgctattgtccgggaagccatcaaaagaggccttcgcaccctgatcctcgctcccacacgggtggttgccgcggagatggaagaggccctgagagggctccctattcgctatcaaaccccggctatccgggccgaacacaccggaagagagattgtggacctgatgtgtcatgctacattcacgatgcggcttctgagccccgtccgcgtgcctaactacaatctgatcattatggacgaggcccactttaccgatcccgcctccatcgctgcgagaggctatatttctacacgggttgaaatgggggaggccgctggcatcttcatgaccgccacacctcccggaagccgcgacccgtttcctcagtccaacgcccccatcatggatgaagagagagagattcccgaacggagctggaactctggccatgagtgggtgaccgacttcaaggggaagacggtctggtttgtgccttccatcaaagctggaaacgatattgccgcgtgcctcagaaagaatggcaaaaaggtgatccagctgagccgcaaaacattcgactctgaatacattaagacccggaccaacgattgggactttgtcgttacaaccgatatcagcgagatgggggctaatttcaaggccgaaagagtgatcgacccccgccggtgtatgaaacctgtgattcttacagatggagaggagagagtcatcctggccggcccgatgcccgtgacccactcctctgctgcccaacgccgggggagaattggccgcaaccctaagaatgaaaacgaccagtacatctatatgggagagcccctcgaaaatgacgaggattgcgcgcactggaaagaagccaagatgctgctggacaacattaatacgcctgagggcatcatccccagcatgtttgagccggaaagagagaaagttgatgctattgacggggaataccggctccgcggagaggccagaaagacattcgtggatcttatgcggcgcggcgacctgcctgtctggctggcttatagagtggccgctgaagggatcaactacgccgatcggagatggtgttttgacggaattaaaaacaatcagatcctcgaggagaacgttgaagtggagatttggaccaaggaaggcgagcgcaagaaactgaagccccggtggcttgatgcgagaatctattccgaccctctggccctcaaagagttcaaggagttcgctgccgggcgcaaatctctgacactgaatctcattaccgagatgggccggcttcccacgtttatgacccagaaggctagaaacgccctggataatctggccgtcctccatacagctgaagcgggaggccgggcctacaaccacgctctgagcgagcttcctgaaaccctggagacactcctgctgctcacccttctggccacagtgaccgggggaatcttcctgtttctcatgtccggcaaggggatcggaaaaatgacgctgggcatgtgctgcattatcacagccagcattcttctgtggtatgctcaaatccagccccattggattgccgcgtctatcatcctcgagttctttctgattgtcctgctcatcccggaacctgagaagcagcgcacaccccaggacaatcaacttacctacgtggttattgccatcctgacagtggtggctgccaccatggctaacgaaatgggcttcctggagaaaacaaagaaagattttgggctcggatccattgccacgcagcagcccgaaagcaatatcctggacatcgaccttagacctgcgtccgcctggaccctgtacgctgtcgccacaaccttcattacaccgatgctccggcactctatcgagaacagctccgttaatgtgtctctgaccgctattgccaaccaggctacggtgctgatgggcctcgggaagggatggccccttagcaagatggatatcggcgtccctctgctggccattgggtgttattcccaagtgaatcccatcaccctcacagcggccctgcttctgctcgttgctcactacgccattatcggacctggcctgcaggctaaagccacccgcgaggcccagaagagagcggctgccggcatcatgaaaaaccccacagtggacgggattaccgtcatcgatctggaccctattccgtatgatcccaagtttgaaaaacagctcggacaagtgatgcttctggtcctgtgcgtgacgcaggttctcatgatgcggacaacctgggctctgtgtgaggcccttacactggccaccggccctatcagcaccctctgggaagggaatcccggacgcttctggaacacaacgattgctgtgtctatggccaatatctttagaggctcctacctggcgggggccggactgctgttcagcatcatgaagaacaccacaaacacccggcgcggcacaggcaataccggggagacgcttggagaaaagtggaaaaacagactcaattctctgggcaagtccgagtttcagatttataaacggagcgggatccaagaggtcgacagaacactcgctaaggaaggaattaaacgcggcgagaccgatcatcacgccgtgtctcgggggagcgctaagctgagatggttcgttgaacgcaaccttgtgacccctgagggaaaagtcgtggacctgggctgcggcagagggggatggtcctactattgtggcgggctcaagaatgtgagagaggttaagggactgacaaaaggcgggcccggacatgaggaacccatccctatgtctacctacggctggaacctggtccgcctccagagcggcgtggatgtgttctttacaccgcccgaaaagtgcgacacgcttctgtgtgatattggggagtccagccctaatcccaccgtcgaagccggacggacactgagagttctcaacctggtggagaattggcttaacaataacacccagttctgcatcaaagtgctgaatccttacatgccgtccgtcatcgagaagatggaaacactccagcgcaaatatggcggggcgctggtgcggaaccccctgtctagaaatagcacccacgagatgtactgggtttccaacgcctctggaaacattgtgagctccgtcaatatgatctctcgcatgctcattaaccggtttacgatgagacataagaaggctacctatgaacctgacgtggatcttggcagcgggacacgcaatatcggaattgagtccgaaacccccaacctggacatcatcggcaaaagaattgagaagatcaaacaagagcacgaaacaagctggcactacgaccaggatcatccttataagacctgggcctaccacggctcttatgagacaaaacagaccgggtccgctagctctatggttaatggagtggtccggctgctcacgaagccctgggacgtgattccgatggtgacacagatggccatgaccgataccacacctttcggccaacagcgcgtctttaaggaaaaagttgacacgagaacccaggagcccaaggaagggaccaagaagctgatgaaaatcaccgctgagtggctttggaaggagctgggaaagaaaaagacacctcggatgtgtaccagagaagagttcgcccggaaagtgcgctccaacgcggccctcggcgctatttttacagatgaaaataagtggaaaagcgccagagaggctgtggaggactctcggttctgggaactggtcgataaggagcgcaacctgcatctcgaagggaaatgcgagacctgtgtgtacaatatgatgggaaagagagaaaagaaaatcggcgagtttggcaaggccaaagggtcccgggccatttggtacatgtggctgggagcgcgcttccttgagtttgaagctctgggcttcctcaacgaggaccactggtttagcagagaaaattccctgagcggggttgagggagaaggccttcacaagctggggtatatcctccgggaggtgtctaaaaaggagggcggagccatgtacgccgatgacacggctggctgggatacccgcatcacactggaagacctgaagaacgaggaaatggtcaccaatcatatggagggggaacacaaaaagctcgccgaggctattttcaaactgacatatcagaacaaggtggttagagtgcaacggcccacccctcgcggaacggtcatggacatcattagcagacgggatcagcgcggctccggacaggtgggaacatacggccttaataccttcacaaacatgggggcccaactgatcagacagatggagggcgaaggagtttttaaaggcattcagcatctcaccgcgacggaggaagtggccgtccaggactggctggctcgggtggggagagagcgcctttctcggatggccatcagcggagatgactgcgtcgtgaagcccctggatgacagattcgctaacgccctcaccgcgctgaatgatatgggcaaggttcgcaaagacatccaacagtgggagccgtcccgggggtggaacgattggacacaggtgcctttttgctctcaccatttccacgaactgattatgaaggacggaagagtcctcgtggtgccctgtcgcaatcaggatgagctgatcggccgggccagaattagccaaggggctggctggtcccttcgcgaaaccgcctgcctgggaaaatcttatgctcagatgtggagcctcatgtactttcaccggagagacctgcgccttgccgctaacgccatctgttccgcggttcccagccattgggtgcctacatctcggaccacatggtccattcacgccagacatgagtggatgaccacggaagatatgctgacagtctggaatcgggtgtggatccaggagaacccgtggatggaggacaagacccccgttgaaagctgggaggaaatcccttatctcggcaaaagagaggaccagtggtgcgggtctctgattggactgacctcccgcgctacatgggcccggaatatccaaaccgccattaaccaggtgagaagcctcatcggctccgaagagtacacagattacatgccctctatgaagcgcttcagacgggaggaagaggaagctggggtcctgtggtga

SEQ ID NO: 19855 - RNA, 9876 nt, synthetic construct
  misc_feature 1..9876: note = derived and/or modified CDS sequence (opt5) from DENV-2__KF955364__SS-prME
  source 1..9876: mol_type = other RNA
accgctggagtgatcattatgctgatccccacagctatggccttccacctcacgaccagaaatggggaacctcatatgattgtcggacggcaggaaaagggcaagagcctgctttttaagacagaagacggggttaatatgtgcaccctgatggcgatcgatctcggagaactgtgtgaagacacaattacctacaaatgcccgcttctgcgccaaaacgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatggcgtgaaacttacaattatgaccggggacatcaaaggaattatgcaggctggcaagcggtccctcagacctcagcccacggagctgaaatattcttggaagacctgggggaaggccaaaatgctgagcacagaatcccataaccaaaccttcctcatcgatggacctgagacagcggaatgccccaataccaaccgcgcctggaatagcctggaggttgaggactacggctttggcgtgttctctacaaacatctggcttaagctgcgggaaaaacaggacgtcctctgtgattccaagctgatgagcgctgccattaaagacaatagagctgtgcacgccgatatggggtattggatcgagtctgcgctgaacgacacctggaagatggaaaaggcctcctttattgagatcaaaagctgccactggcctaagtctcatacgctttggagcaatggagttctcgagtccgaaatgattatccccaaaaacttcgctggcccggtgagccagcacaactaccgccctgggtatcatacacagaccgccggaccctggcacctgggcaagctggagatggatttcgacttttgtgaagggaccacagtcgtggtgaccgaggattgcggaaatcggggcccctctctcagaacgacaaccgcttccggcaaactgattacagaatggtgctgtcggagctgcacccttcctccgctgcgctacagaggggaggacggatgttggtacggcatggagatccggcccctcaaggaaaaggaggaaaacctggtcaattccctggttacagccgggcatggacaaatcgataacttctctcttggcgtgctcgggatggccctgtttctggaggaaatgctcagaacccgcgtgggaacgaaatatgctattctgcttgtcgcggtgagcttcgttaccctgatcacaggcaatatgtcctttcgggacctcggcagagtgatggtcatggtgggggccaccatgacagatgacattggaatgggcgttacctacctggctctgcttgccgccttcaaggtgcgccctacgtttgctgccgggctgctcctgagaaaactcacatctaaggagctgatgatggcgaccatcggaattgcccttctgagccagtccacaatccccgagaccatcctcgaactgaccgatgccctggcccttggcatgatggtcctgaaaattgtgcggaacatggagaagtatcagctcgctgttacaatcatggccatttcttgcgtgcctaatgcggtcatcctgcaaaacgcttggaaggtgagctgtacgattctcgccgccgtgtccgtcagccccctgcttctgacctcttcccagcagaaagctgactggatccctctcgccctgacaatcaaggggctgaatcccaccgctattttccttacaaccctgagccgcacgtctaaaaagagatcctggccgctcaacgaagccgttatggcggtgggaatggtgagcatcctggcctcttccctcctgaaaaatgacattcctatgacaggcccccttgtcgctggcgggctgctgaccgtgtgctacgttctcaccggacggagcgccgatctggagcttgaacgcgctgccgacgtgaagtgggaggatcaggccgagatctccggcagctctcctattctgagcatcacaatttccgaagacgggtctatgagcatcaaaaacgaggaagaggagcacaccctcacaatcctgattagaacgggactcctggtcatctccggcgtgtttcccgtttctattccgatcaccgctgcggcctggtatctttgggaagtgaagaagcaacgggctggggtcctgtgggatgtgccttctccccctcccgtcggaaaagccgagctggaagacggcgcctaccgcattaagcagagaggcatcttcgggtattcccagatcggagctggcgtgtacaaagaggggacatttcacaccatgtggcatgttacacggggagccgtgctcatgcaccgcggcaagagaattgaaccctcctgggcggatgtcaaaaaggacctgatcagctacgggggaggctggaaacttgagggcgagtggaaagaaggggaggaagtgcaggttctggctctcgagcctggaaagaatccgcgggccgtgcaaaccaaacccggcctgttcaagacgaacaccgggacaattggagccgtctccctcgattttagccctggcacctctgggtcccccatcgtggacagaaaaggaaaggtggttggcctgtatggcaatggggtcgtgacacgcagcggagcttacgtgtctgccattgcgcagaccgaaaagtccatcgaggataaccctgagatcgaagacgatattttccggaaaaagagacttacaatcatggacctgcatcccggcgctgggaaaacgaagcgctatctgcctgccattgtccgggaggccatcaaaagaggactccgcaccctgattcttgctccgacacgggtggttgccgctgaaatggaggaagccctgagaggcctccccatccgctaccagacccctgcgattcgggccgagcacaccgggagagagatcgtggacctgatgtgtcatgctacattcacgatgcggctcctgagccccgtccgcgtgcctaactataatcttatcattatggatgaagcccactttaccgaccccgcttccatcgccgccagaggctacatttctacacgggttgagatgggagaagctgcgggcatcttcatgaccgccacaccgcctgggagccgcgatccctttccccagtccaacgctcctattatggacgaggagagagaaatccccgagcggagctggaactctggacacgaatgggtgaccgatttcaagggcaagacggtctggtttgtgccttccatcaaagccgggaacgacattgccgcttgcctgagaaagaatggcaagaaggttatccaactgagccgcaaaacattcgattctgagtatgtgaagacccgggccaacgactgggattttgtcgtgaccacagacattagcgaaatgggcgcgaatttcagagctgagcgcgtgatcgatccgcggagatgtatgaagcccgtcattctcaccgacggggaggaacgcgttatcctggccggccctatgcccgtgacacattcctctgccgctcagcggagaggacgcatcggcagaaaccctaaaaatgagaacgaccagtacatttacatgggggaaccccttgagaatgatgaagactgcgcccactggaaggaggcgaaaatgctgctcgataacatcaataccccggagggaattatccctagcatgtttgaacccgagcgggaaaaggtggacgccattgatggcgagtatcgcctgagaggggaagctcggaaaacgttcgtcgacctgatgcgcagaggagatctccctgtgtggcttgcctaccgggttgctgccgagggcatcaactatgctgacagacgctggtgttttgatgggattaagaataaccaaatcctggaggaaaacgtggaggtcgaaatctggacaaaagagggcgagcggaagaagctgaaacccagatggctcgacgcccgcatttactccgatcctctggcgcttaaggagttcaaagagttcgccgctggacggaagtctctgaccctcaatctgatcacagaaatgggcagactgcccacctttatgacgcagaaagcccgggacgctctcgataaccttgccgtgctgcataccgccgaggttgggggacgcgcttataatcacgcgctgagcgaactcccggagacactggagacccttctgctcctgacactgctcgccaccgtgacaggcgggattttcctttttctgatgtccggaaagggcatcggcaagatgaccctggggatgtgctgcattatcacggctagcatcctcctgtggtacgcccagattcagcctcactggatcgccgcttctattatccttgagttctttctgattgtcctcctgatccccgagcccgaaaaacaaagaacacctcaggacaaccagctgacctatgtggtcatcgccattctcaccgtggttgcggccacaatggctaatgagatgggattccttgaaaagaccaaaaaggacctgggcctggggtccatcacaacgcaggagagcgagtccaacattctcgatatcgacctgcggccggcctctgcttggaccctttacgccgtggcgacaacctttgtgacacccatgctgcgccatagcattgaaaattcctctgtcaacgttagcctcaccgccatcgctaatcaagccacggtgctgatgggactgggcagagggtggcctctctccaaaatggatattggagtgccccttctggctatcggctgttacagccaggtcaaccctatcaccctgacagccgctctcctgcttctggtggcccactatgcgattatcggccccgggctccaggccaaggctacccgggaggcccagaagcgcacagctgccggaattatgaaaaatcctaccgttgacggcatcacggtgattgatctggaaccgatcccctacgaccctaagttcgagaaacaactggggcaggtcatgctccttgtgctgtgcgtcacacaggtgctgatgatgagaaccacatgggccctctgtgaagcgctgacccttgctaccggacccatctctacactgtgggagggcaaccctgggcggttttggaatacgaccattgccgtttccatggctaacatcttccgcggaagctatctcgccggcgccggcctgctgttttctattatgaagaatacaaccaacacaagacgggggaccggaaatatcggcgagacgctcggggaaaaatggaagtccagacttaacgctctgggaaagagcgagttccagatttacaaaaagtctggcatccaagaagtggatcgcacactggccaaagaggggatcaagcggggagagaccgaccatcacgcggtcagcagaggctccgccaaactccgctggtttgtggaacggaacatggttacccccgagggcaaggtggtcgatctggggtgcggaagaggcgggtggtcttattactgtggaggccttaaaaatgtgcgcgaagtgaaggggctgacaaagggaggcccgggccatgaggaacctattcccatgagcacctatgggtggaacctcgttcggctgcagtccggagtcgacgtgttcttcacaccccctgagaaatgcgatacgctgctctgtgacatcggcgagagctcccccaatcctaccattgaagctgggagaacacttcgcgtgctgaacctggtcgagaattggctcaacaataacacccagttttgcgttaaggtgctgaatccgtacatgccctctgtgatcgagaagatggagacacttcaacggaagtacggaggcgccctggtcagaaaccctctcagccgcaattccacccacgaaatgtattgggtgtctaacgctacggggaatattgttagctccgtgaacatgatctctcggatgctgatcaatagattcaccatgaaacacaagaaggccacatacgagcccgatgtcgacctgggaagcggcacccgcaacattggcatcgagaacgaaattcctaatctcgacatcattgggaaaagaatcgagaagattaaacaggaacatgagacatcctggcactatgatcaggaccatccctacaagacctgggcgtatcacggaagctacgaaacaaaacagaccggctctgcctccagcatggtgaacggggttgtgaaacttctgacgaagccgtgggatgtcgtgcctatggtgacacaaatggctatgaccgacaccacaccctttggacagcagcgggtcttcaaagagaaggttgatacgcgcacccaggagcctaaagaaggcacaaagaaactgatgagaatcaccgccgagtggctctggaaggaactggggaagaaaaagacaccccggatgtgtaccagagaggagtttacacggaaagtgcgctctaatgctgcccttggagctatcttcaccgacgaaaacaagtggaaatccgccagagaggcggtggaagatagccggttttgggagctggtcgaccgcgaaagaaatctccacctggagggcaagtgcgagacgtgtgtgtataacatgatgggcaaacgggaaaagaagctgggggagttcggaaaagccaagggctctcgcgctatttggtacatgtggctcggggccagatttctggagttcgaggctcttggatttctgaatgaagatcattggttctcccggggcaacagcctctccggggttgagggcgagggactgcacaaacttggctacatcctgcgcgacgtgagcaagaaagaagggggagccatgtatgccgatgacaccgcgggctgggacacaagaattaccctcgaggatctgaagaatgaagagatggtcacaaaccatatgaagggggaacacaaaaagctggctgaggccatctttaaactcacctaccaaaataaggtggttcgggtgcagcgccctacgcccagaggaacagtcatggacattatctctcggaaagatcagcgcggcagcggacaggtgggcacctatggactgaacacattcaccaatatggaggcccaacttatcagacagatggaaggcgaggggattttcaagtccatccagcggctgacggttaccgaagagattgctgtgcaaaactggctcgccagagtcggacgcgagcggctgtctagaatggctatcagcggcgacgattgcgtggtcaagccgcttgacgatcgctttgcctccgcgctgacagccctcaatgacatggggaaagtgcggaaggatattcagcagtgggaaccttctagaggatggaacgactggacccaggttcccttctgcagccatcactttcacgagctggtgatgaaagatggccgcgtcctggtggtgccctgtcggaaccaagacgaactcatcgggagagctcgcatctcccagggcgccggatggtctctgaaggagacagcttgccttggcaaaagctacgcccagatgtggaccctgatgtatttccatcggagagatctccgcctggcggccaatgctatttgttccgccgttcctagccactgggtgccgacatctcggaccacgtggtccatccatgctaagcacgaatggatgacaaccgaggacatgcttgccgtctggaacagagtgtggattcaggagaatccctggatggaagacaagacccctgttgagagctgggaagaggtgccctacctggggaaacgggaagatcaatggtgcggatctctcatcggcctgacatccagagctacctgggccaagaacattcagacagcgatcaatcaggtccgcagcctgattgggaacgaggagtatacggactacatgccttccatgaaacggtttagaaaggaagaggaagaggccggagtgctctggtga

SEQ ID NO: 19856 - RNA, 9876 nt, synthetic construct
  misc_feature 1..9876: note = derived and/or modified CDS sequence (opt5) from DENV-2__KF955372__SS-prME
  source 1..9876: mol_type = other RNA
accgccggagtgatcattatgctgatccccaccgctatggccttccacctcacgacccggaatggggagcctcatatgattgtgggacggcaggaaaagggcaagagcctgctttttaagacggaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagtatgcggtgggaaatgacaccggcaagcatggcaaagaaatcaagattacacctcagtcttccatcaccgaggccgaacttacggggtacggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcacgctaaaaagcaggacgtcgtggttctgggctcccaagaaggggccatgcatacagcccttaccggcgctacagagatccagatgagctccggaaatctgctctttaccggccacctgaaatgcagacttcggatggataagctgcagctcaaagggatgtcttatagcatgtgtaccggaaagttcaagattgtgaaagaaatcgcggagacacaacatggcacgatcgtcattagagtgcagtacgagggggacggatccccctgcaagatccccttcgaaattatggatctggagaaacgccacgtcctgggccggctcatcaccgtgaaccctattgttacagaaaaggacagcccggtgaacgtcgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcatcaagtgttcggcgccatttatggagcggctttttccggcgtctcttggacaatgaaaatcctgattggggtgatcatcacctggattggaatgaacagccggtccaccagcctttctgtgtccctcgttctggtcggcgtggtgacactgtacctcggggtcatggtgcaggccgacagcggatgtgttgtgtcttggaagaataaagaactgaagtgcggctccgggatcttcattaccgataacgtccacacatggacggagcagtataagtttcagcctgaaagcccctccaaacttgcctctgctatccaaaaggcccacgaggaaggcatttgtggaatcagaagcgtgacccgcctggagaatctcatgtggaaacagatcacaccggagctgaaccatattctgtccgaaaatgaggttaaacttaccatcatgacaggcgacattaaagggatcatgcaggctggaaagcggtctctcagacctcagcccaccgaactgaaatacagctggaagacgtggggcaaggccaaaatgctgtccaccgagagccacaaccaaacattcctcattgatgggcctgaaaccgcggagtgccccaatacaaaccgcgcctggaactctctggaggtggaagactatggatttggcgtcttctccaccaacatctggcttaagctgcgggagaaacaggacgtgttttgtgatagcaagctcatgtctgctgccatcaaagacaatagagctgttcatgccgatatgggctactggattgaatccgcgctgaacgacacatggaagatggagaaggccagcttcatcgaggtgaaatcttgccactggcctaagagccacaccctgtggtccaatggggtccttgaaagcgagatgattatccccaaaaacttcgctggaccggtgtctcagcataactatcgccctggctaccacacgcagacagccgggccctggcatctcggaaagctggaaatggattttgacttctgtgagggcaccaccgtggtcgttacagaagattgcgggaatcggggaccctccctgagaaccacgacagctagcggcaaactcattaccgagtggtgctgtcggtcctgcacactgcctccgcttcgctacagaggcgaggacgggtgttggtatggaatggaaatccggcccctgaaggagaaggaagagaacctcgtcaattctctggtgaccgccggccacgggcaaattgataactttagcctgggagtccttggcatggccctcttcctggaagagatgctgagaacacgcgtggggaccaaacatgctatcctcctggttgcggtgtcctttgtcacgcttatcaccggaaatatgtctttccgggacctgggcagagtgatggttatggtgggcgccacaatgaccgatgacattgggatgggagtcacatacctcgctctgctggccgcctttaaggtgcgccctaccttcgctgccggccttctgctcagaaaactgacgagcaaggagctcatgatggcgacaatcgggattgctctgctttcccagtctaccatccccgaaacaattctggagctcaccgatgccctggccctgggaatgatggttcttaaaatcgtgcggaacatggaaaagtatcagctggctgtcaccatcatggccattagctgcgtgcctaatgcggtgatcctccaaaacgcttggaaggtctcctgtacaattctggccgccgttagcgtgtctcccctcctgcttacgtccagccagcagaaagctgactggatccctctggccctcaccattaagggcctgaatcccacagctatctttctgaccacactttctcgcacctccaaaaagagaagctggccgctgaacgaggccgtgatggcggtcgggatggtgtctatcctcgcctccagcctgctcaaaaatgacattcctatgacgggacccctggttgctggcggccttctgacagtgtgctacgtcctgaccgggcggtccgccgatctcgaactggagcgcgctgccgacgtgaagtgggaggatcaggccgaaatcagcggatctagccctattctttccatcaccatttctgaggacggcagcatgtccatcaaaaacgaagaggaggaacaaacactgaccattctcatcagaacagggctgctcgttatctctggagtgttccccgtcagcattccgatcacggctgcggcctggtatctgtgggaggtgaagaagcagcgggctggcgtcctttgggatgtgccttctccccctcccgttgggaaagccgaactggaggacggagcctaccgcattaagcagagaggcatctttggctatagccagattggggctggagtgtacaaagaaggcaccttccacacaatgtggcacgtcaccagaggggccgtgctgatgcatcgcggaaagagaatcgagcccagctgggcggatgttaaaaaggacctcatctcctacggcgggggatggaagctggagggcgaatggaaagagggcgaagaggtgcaagtccttgctctggaacctgggaagaatccgcgggccgtgcagacaaaacccggactctttaagaccaacacgggcaccattggggccgtgagcctggatttctctcctggaacatccggcagccccatcgttgacagaaaagggaaggtcgtgggactctatggcaatggcgtggtcacccgctctggggcttacgtgtccgccattgcgcagacagaaaagagcatcgaggataaccctgaaattgaggacgatatcttccggaaaaagagactgaccatcatggaccttcaccccggagctggcaaaacaaagcgctatctgcctgccattgttcgggaagccatcaaaagagggctgcgcacgctcattctggctccgacccgggtggtcgccgctgagatggaagaggcccttagaggactgcccatccgctaccagacccctgcgattcgggccgagcataccggcagagaaatcgtggacctcatgtgtcacgctacctttacaatgcggctgctctcccccgttcgcgtgcctaactataatctgattatcatggatgaggcccatttcacggaccccgcttctaccgccgccagagggtacatcagcacacgggtcgaaatgggcgaggctgcgggaatttttatgaccgccacaccgcctggctcccgcgatcccttcccccaaagcaacgctcctatcatggacgaggaaagagagattcccgaacggtcttggaactccgggcacgagtgggtgaccgattttaagggaaagacggtttggttcgtgcctagcatcaaagccggcaacgacattgccgcttgccttagaaagaatgggaaaaaggtcatccagctgtctcgcaaaacatttgatagcgaatatgtgaagacccgggccaacgactgggatttcgtggtcaccacagacatctccgagatgggagcgaattttagagctgagcgcgttattgatccgcggagatgtatgaagcccgtgatcctgaccgacggcgaggaacgcgtgattctcgccgggcctatgcccgtcacacactctagcgccgctcagcggagaggccgcatcggaagaaaccctaaaaatgaaaacgaccaatacatttacatgggcgagcccctggaaaatgatgaggactgcgcccattggaaggaggcgaaaatgcttctggataacatcaataccccggaagggatcattccttccatgttcgagcccgaacgggagaaggtggacgccatcgatggagaatatcgcctcagaggcgaggctcggaaaacgtttgttgacctgatgcgcagaggggatctgcctgtgtggctcgcctaccgggtcgctgccgagggaattaactatgctgacagacgctggtgtttcgatggcatcaagaataaccagattcttgaagagaacgtggaagttgagatctggacaaaagagggggaacggaagaagctgaaacccagatggctggacgcccgcatttactctgatcctctcgcgctgaaggagttcaaagaatttgccgctggccggaagtcccttaccctgaatctcatcacagagatgggaagactgcccaccttcatgacgcagaaagcccgggacgctctggataacctcgccgtgcttcacaccgccgaagtcggcgggcgcgcttataatcatgcgctgtccgagctgccggagacactcgaaaccctgcttctgctcacactgctggccaccgtgacaggaggcatctttctcttccttatgagcgggaagggaattggcaagatgaccctgggcatgtgctgcatcattacggcttctatcctgctctggtacgcccagattcaacctcactggatcgccgcttccatcattctggagtttttccttatcgtcctgctcattcccgaacccgagaaacagagaacacctcaggacaaccagctgacctatgtggttatcgccattctgaccgtggtggcggccacaatggctaatgaaatggggtttctcgagaagaccaaaaaggaccttggactgggcagcatcacaacgcaagagtccgaatctaacatcctggatattgacctccggccggccagcgcttggaccctgtacgccgtcgcgacaaccttcgttacacccatgcttcgccactccatcgaaaattctagcgtgaacgtgtccctgaccgccattgctaatcaggccacggtcctcatggggctgggaagaggctggcctctgagcaaaatggatatcggggtgcccctccttgctattggatgttactctcaggttaaccctatcaccctgacagccgctctgctcctgcttgtggcccattatgcgattatcggccccggcctgcaggccaaggctacccgggaagcccaaaagcgcgctgccgccgggatcatgaaaaatcctacagtcgacggaattaccgtgatcgatctcgagccgattccctacgaccctaagtttgaaaaacagctgggccaggtcatgctgctcgtgctttgcgttacacaggtgctgatgatgagaacaacctgggcgctgtgtgaggctctcacactggccaccgggcccatctccaccctttgggagggaaaccctggccggttctggaatacaacgattgctgtcagcatggccaacatctttcgcgggtcttatctggccggagctggcctcctgttctccatcatgaagaataccacaaacaccagacggggcacagggaatattggagaaaccctgggcgagaaatggaaaagcagactcaacgcccttgggaagtctgaatttcaaatctacaaaaagagcggcattcaggaggtggatcgcacgctggcgaaagagggcatcaagagaggggaaacagaccaccatgccgtttccagaggatctgctaaactgcgctggttcgtggagcggaacatggtcacccccgaaggcaaggtggtggatctcggctgcgggagaggaggctggagctattactgtgggggactgaaaaatgttcgcgaggtcaagggccttaccaaagggggaccgggccacgaggagcctattcccatgtccacatatggctggaacctggtgcggctccagagcggggtggacgtcttctttacaccccctgagaaatgcgatacactgctgtgtgacatcggagaatcctctcccaatcctacgatcgaggccggcagaaccctccgcgttcttaacctggtggaaaattggctgaacaataacacacaattctgcattaaggtgctcaatccgtacatgcccagcgtcatcgagaaaatggaaaccctgcagcggaagtacgggggagctcttgtgagaaaccctctgtcccgcaattctacacatgagatgtattgggttagcaacgccaccggcaatattgtgtcctctgtcaacatgatcagccggatgctcattaatagatttacgatgaaacacaagaaggcgacctacgagcccgatgtggacctggggtccggaacacgcaacatcggcatcgaaaacgagattcctaatctggacatcattggcaaaagaatcgaaaagattaaacaggagcacgaaaccagctggcattatgatcaggaccacccctacaagacatgggcctatcatgggtcttacgagaccaaacaaacaggatccgctagctctatggttaacggcgtggtccggctccttaccaagccgtgggatgtggtgcctatggtcacgcagatggccatgacagacaccacccccttcgggcagcagcgcgtttttaaggagaaagtggatacaagaacgcaagaacctaaggagggaaccaaaaagctgatgcggatcacagctgaatggctgtggaaagagctcggcaagaagaaaacccccagaatgtgtacacgggaggagttcacccgcaaggtgagatccaatgccgctctgggggccatttttacagacgagaacaaatggaaaagcgcgcgggaagccgtcgaggattctcgcttctgggaacttgtggacagagagcggaatctgcacctcgagggaaaatgcgaaacctgtgtttataacatgatgggcaagcgcgagaaaaagctgggcgaatttgggaaggctaaaggatccagagccatctggtacatgtggctgggcgctcggttcctcgagtttgaagccctggggttccttaatgaggatcactggtttagccgcggaaactccctgagcggcgtggagggggaaggcctccataagctgggatacatccttagagacgtctctaaaaaggagggcggggccatgtatgcggatgacacggctggatgggacacccggattacactggaagatctcaaaaatgaggaaatggtgaccaaccacatgaagggcgagcataagaaactggccgaggccatcttcaagctgacataccagaataaagttgtgcgcgtccagagacctacaccccgggggacggtgatggacattatcagccgcaaggatcagagaggatccggccaagttgggacatatggcctcaacaccttcacaaatatggaagctcagctgattcggcagatggagggagaaggcatctttaaatctatccaaagacttaccgtgacggaggagattgccgtccagaactggctggctcgcgtggggcgggaaagactcagccgcatggccatctccggagacgattgcgtcgtgaagccgctggacgatcggttcgcgtctgcccttaccgctctgaatgacatgggcaaggttagaaaagatattcagcagtgggagcctagccgcgggtggaacgactggacacaagtgcccttttgctcccaccatttccacgaactcgtcatgaaggatggacgggtgctggtggttccctgtagaaaccaggacgagctgatcggccgcgcccggatttctcagggggctggctggagcctcaaagaaaccgcctgcctgggaaagtcctacgcgcagatgtggacacttatgtattttcacagacgcgatctgcggctcgccgctaatgccatctgtagcgctgtgccttctcattgggtcccgacctccagaacaacctggagcatccacgccaaacatgagtggatgacgacagaggacatgctggctgtgtggaaccgggtttggattcaagaaaatccctggatggaggacaagacccctgtggaatcttgggaggaagtcccctaccttggcaagagagaggatcagtggtgcgggtccctgatcggactcaccagccgcgccacatgggcgaaaaacattcagaccgccatcaatcaggtgcggtccctgattggcaacgaggaatatacagactacatgccttctatgaagagattccgcaaagaggaagaggaagctggggtcctgtggtga

SEQ ID NO: 19857 - RNA, 9876 nt, synthetic construct
  misc_feature 1..9876: note = derived and/or modified CDS sequence (opt5) from DENV-2__KF955373__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccctgagcatcccgattacggctgcggcctggtacctttgggaggtgaagaagcaacgggctggcgtcctgtgggatgtgccttctccccctcccgtcgggaaagccgaactggaggacggagcctatcgcatcaagcagagaggcatttttggctacagccagatcggggctggagtgtataaagaaggcaccttccatacaatgtggcacgttaccagaggggccgtgctcatgcatcgcggaaagagaatcgagcccagctgggcggatgtcaaaaaggacctgatttcctacggcgggggatggaaacttgagggcgaatggaaagagggcgaagaggtgcaggttctggctctcgaacctgggaagaatccgcgggccgtgcaaacaaaacccggactgtttaagaccaacacgggcaccatcggggccgtcagcctcgatttctctcctggaacatccggcagccccattgtggacagaaaagggaaggtggttggactgtacggcaatggcgtcgtgacccgctctggggcttatgtgtccgccatcgcgcagacagaaaagagcattgaggataaccctgaaatcgaggacgatatcttccggaaaaagagacttaccattatggacctgcaccccggagctggcaaaacaaagcgctacctgcctgccatcgtccgggaagccattaaaagagggctccgcacgctgatccttgctccgacccgggtggttgccgctgagatggaagaggccctgagaggactccccattcgctatcagacccctgcgatccgggccgagcataccggcagagaaattgtggacctgatgtgtcacgctacctttacaatgcggctcctgtcccccgtccgcgtgcctaactacaatcttatcatcatggatgaggcccacttcacggaccccgcttctattgccgccagagggtatatcagcacccgggttgaaatgggcgaggctgcgggaatttttatgacagccaccccgcctggctcccgcgatcccttcccccagagcaacgctcctatcatggacgaggaaagagagattcccgaacggtcttggaactccgggcatgagtgggtgacagattttaagggaaagaccgtctggttcgtgcctagcatcaaagccggcaacgacatcgccgcttgcctgagaaagaatgggaaaaaggttattcaactgtctcgcaaaacgtttgatagcgaatacgtgaagacacgggccaacgactgggatttcgtcgtgaccaccgacatctccgagatgggagcgaattttagagctgagcgcgtgattgatccgcggagatgtatgaagcccgtcatcctcacagacggcgaggaacgcgttattctggccgggcctatgcccgtgacccactctagcgccgctcagcggagaggccgcatcggaagaaaccctaaaaatgaaaacgaccagtatatctacatgggcgagccccttgaaaatgatgaggactgcgcccattggaaggaggcgaaaatgctgctcgataacattaatacaccggaagggatcattccttccatgttcgagcccgaacgggagaaggtggacgccatcgatggagaataccgcctgagaggcgaggctcggaaaacctttgtcgacctgatgcgcagaggggatctccctgtgtggcttgcctatcgggttgctgccgagggaattaactacgctgacagacgctggtgtttcgatggcatcaagaataaccaaattctggaagagaacgtggaagtcgagatctggacgaaagagggggaacggaagaagctgaaacccagatggctcgacgcccgcatctattctgatcctctggcgcttaaggagttcaaagaatttgccgctggccggaagtccctgacactcaatctgattaccgagatgggaagactgcccacattcatgacccagaaagcccgggacgctctcgataaccttgccgtgctgcacacggccgaagttggcgggcgcgcttacaatcacgcgctgtccgagctcccggagaccctggaaacacttctgctcctgaccctgctcgccacagtgaccggaggcatctttcttttcctgatgagcgggaagggaattggcaagatgacactgggcatgtgctgcatcattaccgcttctatcctcctgtggtatgcccagatccagcctcattggattgccgcttccatcattcttgagtttttcctgatcgtcctcctgattcccgaacccgagaaacaaagaacgcctcaggacaaccagctgacatacgtggtcatcgccatcctcaccgtggttgcggccaccatggctaatgaaatggggtttcttgagaagaccaagaaggacctgggactgggcagcattaccacacaggagtccgaatctaacatcctcgatattgacctgcggccggccagcgcttggacgctttatgccgtggcgaccacattcgtgacccccatgctgcgccactccatcgaaaattctagcgtcaacgtttccctcacagccattgctaatcaagccaccgtgctgatggggctgggaagaggctggcctctcagcaaaatggatatcggggtgccccttctggctattggatgttactctcaggtcaaccctatcacgctgaccgccgctctcctgcttctggtggcccattacgcgatcattggccccggcctccaggccaaggctacacgggaagcccagaagcgcgctgccgccgggatcatgaaaaatcctaccgttgacggaattacagtgatcgatctggagccgattccctatgaccctaagtttgaaaaacaactgggccaggtcatgctccttgtgctgtgcgtcacccaggtgctgatgatgagaacgacatgggcgctctgtgaggctctgacccttgccacagggcccatctccaccctgtgggagggaaaccctggccggttctggaataccacaatcgctgttagcatggccaacatttttcgcgggtcttacctcgccggagctggcctgctgttctccatcatgaagaatacgaccaacacaagacggggcaccgggaatattggagaaacactcggcgagaaatggaaaagcagacttaacgccctggggaagtctgaatttcagatctataaaaagagcggcattcaagaggtggatcgcaccctggcgaaagagggcatcaagagaggggaaacggaccaccatgccgtctccagaggatctgctaaactccgctggttcgtggagcggaacatggttacacccgaaggcaaggtggtcgatctgggctgcgggagaggaggctggagctactattgtgggggacttaaaaatgtgcgcgaggtgaagggcctgaccaaagggggaccgggccacgaggagcctatccccatgtccacctacggctggaacctcgttcggctgcagagcggggtcgacgtgttctttacaccccctgagaaatgcgataccctgctctgtgacattggagaatcctctcccaatcctacaatcgaggccggcagaacgcttcgcgtgctgaacctggtcgaaaattggctcaacaataacacccagttctgcattaaggttctgaatccgtatatgcccagcgtgatcgagaaaatggaaacacttcaacggaagtacgggggagctctggtgagaaaccctctctcccgcaattctacccacgagatgtactgggtcagcaacgccacaggcaatattgtgtcctctgttaacatgatcagccggatgctgatcaatagatttaccatgaaacataagaaggcgacgtatgagcccgatgtggacctggggtccggaacccgcaacattggcatcgaaaacgagattcctaatctcgacatcattggcaaaagaatcgaaaagattaaacaggagcacgaaacaagctggcattacgatcaggaccacccctataagacctgggcctaccacgggtcttatgagacaaaacagaccggatccgctagctctatggtcaacggcgtggttaaacttctgacaaagccgtgggatgtggtccctatggtgacccaaatggccatgacggacacaacccccttcgggcagcagcgggtgtttaaagagaaggtcgatacccgcacacaggaacctaaagagggaacgaagaaactgatgagaatcaccgctgaatggctctggaaggagctgggcaagaaaaagacaccccggatgtgtaccagagaggagttcacacggaaagttcgctccaatgccgctcttggggccatctttaccgacgagaacaagtggaaaagcgcgagagaagccgtggaggattctcggttctgggaactggtggaccgcgagagaaatctccatctggagggaaagtgcgaaacatgtgtctacaacatgatgggcaaacgggagaagaagctgggcgaatttgggaaagctaagggatcccgcgccatttggtatatgtggctcggcgctagattcctggagtttgaagcccttgggttcctgaatgaggatcactggtttagccggggaaactccctcagcggcgtggagggggaaggcctgcataaacttggatacatcctgcgcgacgtttctaagaaagagggcggggccatgtacgcggatgacaccgctggatgggacacgagaattaccctcgaagatctgaagaatgaggaaatggtgacaaaccacatgaagggcgagcataaaaagctggccgaggccatcttcaaactcacctatcaaaataaggtcgtgcgggttcagcgccctacacccagagggaccgtgatggacattatcagccggaaagatcagcgcggatccggccaggtcgggacgtacggcctgaacacattcaccaatatggaagctcaacttatcagacagatggagggagaaggcatttttaagtctatccagcggctgacagtgaccgaggagattgccgttcaaaactggctcgctagagtggggcgcgaacggctgagcagaatggccatctccggagacgattgcgtcgtgaagccgcttgacgatcgcttcgcgtctgccctgacggctctcaatgacatgggcaaagtccggaaggatattcagcagtgggagcctagcagagggtggaacgactggacccaggtgcccttttgctcccaccacttccatgaactggttatgaaagatggacgcgtgctggtcgtgccctgtcggaaccaagacgagctcatcggcagagcccgcatctctcagggggctggctggagcctgaaggaaacagcctgccttggaaaatcctatgcgcagatgtggaccctgatgtactttcaccggagagatctccgcctggccgctaatgccatttgtagcgctgtgccttctcattgggttccgacatcccggaccacatggagcatccacgccaagcacgagtggatgaccacggaggacatgcttgctgtgtggaacagagtctggattcaggaaaatccctggatggaggacaagacacctgtggaatcttgggaggaagttccctatctgggcaaacgggaggatcaatggtgcgggtccctcatcggactgaccagcagagccacctgggcgaagaacattcagacagccatcaatcaggtgcgctccctgattggcaacgaggaatacaccgactatatgccttctatgaaacggttcagaaaggaggaagaggaagctggggtcctctggtga

SEQ ID NO: 19858 - RNA, 9876 nt, synthetic construct
  misc_feature 1..9876: note = derived and/or modified CDS sequence (opt5) from DENV-2__GQ868600__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacaaaagacggcaccaatatgtgcacactgatggccatggatctcggggagctgtgtgaagacaccatcacatacaagtgcccgttccttaaacaaaacgagcccgaagatattgactgttggtgcaattctaccagcacgtgggttacctatggaacatgtaccacaaccggcgagcaccgcagagagaagcggtccgtggcgctggtgcctcatgtcgggatgggactcgaaacgcgcacagagacctggatgtctagcgaaggcgcttggaagcacgcccagagaatcgagacatggatcctgcggcatcccggctttaccattatggccgctatcctggcctacaccattgggacaacgcacttccagcgcgtgctcatctttattctgcttaccgctatcgccccttccatgacaatgagatgcattggaatctctaaccgggatttcgttgagggcgtgagcgggggatcctgggtcgacatcgtgctggaacacggcagctgtgttaccacaatggcgaaaaataagcccaccctcgattttgagctgattaaaacggaagccaagcagcctgctacacttcgcaaatattgcatcgaggccaagctgaccaacaccacaaccgactctagatgtccgacacaaggggaacccacgctcaatgaggagcaggataagcggttcgtgtgcaaacattccatggtcgaccgcggatggggcaacggctgtgggctgtttggaaagggcgggattgtgacctgcgctatgttcacatgcaaaaagaatatggaaggaaaaatcgtgcagcctgagaacctggaatacaccgtcgttattacaccccacagcggcgaggaacatgccgtggggaatgataccggaaagcacggcaaagaggtgaagatcacgcctcagtcttccatcaccgaggcggaactcacaggctatgggaccgtcacaatggagtgtagccccagaaccggactggactttaacgaaatggtgcttctgcaaatggaggataaggcctggctcgttcaccggcagtggttcctggaccttccgctgccttggctccccggcgctgacacgcaggggtctaattggattcagaaagaaacactggtgacctttaagaaccctcatgccaaaaagcaagatgtcgtggttctgggatcccaggagggcgctatgcacacagccctcaccggggccaccgagatccagatgagctccggcaatctgcttttcacaggacatctgaaatgccgcctcagaatggacaagctgcaacttaagggcatgtcttacagcatgtgtacggggaaattcaagattgtgaaagaaatcgctgagacccagcacggaacaattgtcatccgggtgcagtatgaaggcgatgggtccccctgcaagatcccctttgagattatggacctggagaaaagacatgtcctcggacgcctgatcaccgtgaaccctattgttacagaaaaggatagcccggtgaacatcgaggcggaaccccctttcggcgactcttacattatcattggggtcgagcccggccagctgaagctcgattggtttaaaaagggatccagcatcggccaaatgttcgaaaccacgatgcggggggccaaaagaatggctatcctgggagacacagcctgggattttggctctcttgggggagtgttcaccagcattggcaaggccctgcaccaggtttttggggctatctacggcgccgcgttctccggagtgtcttggaccatgaaaattctcatcggcgtcattatcacatggatcgggatgaatagccgctccaccagcctgtctgtgtccctggtgcttgttggaattgtcacactctatctgggcgtgatggtgcaggctgacagcgggtgtgtcgtgtcttggaagaacaaggagctgaaatgcggatccggcatctttgttacggataatgtgcacacctggacagagcagtacaagttccaacctgaaagcccctccaaactcgcctctgccattcagaaggctcatgaggaagggatctgtggcattcggagcgtcaccagactggagaaccttatgtggaaacagatcacatccgaactgaatcacatcctctctgagaacgaggtgaagctgaccattatgacgggagacatcaaaggcattatgcaggttgggaagcgcagcctgcggccgcaacctaccgaacttagatattcctggaagacatggggaaaagccaagatgctcagcaccgagctgcataatcagacatttctgatcgacggccccgaaaccgctgagtgccctaacacaaatcgcgcctggaactctctcgaagtggaggattacgggttcggagtctttaccacgaatatttggctgcggcttagagagaaacaggacgcgttctgtgattccaagctgatgagcgccgctatcaaagacaaccgcgccgtgcacgctgatatgggctattggatcgaatctgccctcaatgacacatggaagattgagaaggcgtccttcatcgaagttaaaagctgccactggcccaagtctcataccctgtggagcaacggcgtgctggagtccgagatggtcattcctaaaaattttgccgggcccgtgagccagcacaacaaccggccgggataccatacccaaacagctggcccttggcaccttgggaagctcgaaatggatttcgacttttgtgagggaaccacggtggtcgttacagaagattgcggcaatagagggccctctctgcggaccacaaccgcctccggaaaactgatcacagagtggtgctgtcgcagctgcaccctcccccctctgagatatcggggcgaagacggctgttggtacgggatggagattagaccgcttaaggagaaggaagagaacctggtgtcctctctcgtgacggctggacatggccagatcgataatttcagcctggggattctgggaatggccctttttctcgaagagatgctgcgcacccgggtcggcacaaaacacgccatcctgctcgtggctgtttccttcgtgaccctgatcacagggaacatgtcttttagagaccttggacgcgtcatggtgatggttggcgcgaccatgacggatgacattggcatgggggtgacatacctggccctcctggctgccttcaaggtcagacccacctttgccgctggactgcttctgcggaaactcacaagcaaggaactgatgatgaccaccatcggcattgtgctcctgtcccagtctagcatccctgagacaattcttgagctgacggacgccctcgcgctggggatgatggttctgaaaatggtgcgcaatatggaaaagtatcaacttgctgtcaccatcatggccatcctgtgcgtgcccaacgccgtgattctccagaatgcttggaaggtctcctgtacaatcctggccgttgtgagcgtgtctcctctcctgcttacctccagccagcagaaagcggattggattcccctggctctcacaatcaagggactgaaccctaccgccattttcctgacgacactttctagaacctccaaaaagcggagctggcccctgaatgaggccatcatggctgtcggcatggtgtctatcctcgcctccagcctgctcaaaaacgacattccgatgaccgggcctctggttgctggaggccttctgacagtgtgctacgtcctgaccggccgctccgccgatctcgaactggagagagcgacagacgtgaagtgggatgaccaagccgaaatcagcgggtctagccccattctttccatcacgatttctgaggatggaagcatgtccatcaaaaatgaggaagaggaacagaccctgacaattctcatccggaccggcctgctcgttatctctgggctgtttcctgtgagcattcccatcacagctgccgcttggtatctttgggaggtcaagaagcagcgcgccggagtgctgtgggacgtcccgtcccctccccctgtgggcaaagccgagctggaagatggggcttacagaattaagcagaaaggaatcctcggctattctcaaattggcgcgggggtttacaaggagggaaccttccacacgatgtggcatgtgacccggggcgccgtcctgatgcacaaagggaagcgcatcgaacccagctgggctgacgtgaagaaagatcttatctcctatggaggcgggtggaagctggagggagaatggaaagagggcgaggaagttcaggtgctcgccctggagcccggcaagaaccctagagccgtccagacaaaaccggggctctttcggaccaatacaggaaccattggcgctgtgagcctggacttctctcccgggacatccggaagccctatcgtggataagaagggcaaagttgtcgggctttacggaaacggcgtggtgacgagatctggcgcctacgtctccgcgattgctcagaccgaaaagagcatcgaggacaatcccgaaattgaggacgatatcttccgcaaacggagactgacaatcatggacctgcatcctggggccggaaagaccaaacgctatctccccgccattgtgcgggaggctatcaagagaggcctgcgcacccttattctggcccctacacgggttgtggcggctgaaatggaggaagccctcagagggctgccgatccgctaccaaacgcccgccattcgggctgagcacaccggaagagaaatcgtcgatctcatgtgtcatgccacatttaccatgcggctgctttcccctattcgcgtgcccaactataacctgatcatcatggacgaggctcacttcacagatcctgcctctattgcggccagaggctacatcagcacccgggttgagatgggggaagctgccggcatttttatgacggctacacccccgggatcccgcgaccctttcccccagagcaatgcccccatcatggatgaggaaagagagattcctgagcggtcttggaactccggccacgaatgggtgaccgactttaaggggaaaaccgtctggttcgtgcccagcatcaagacaggaaatgatatcgccgcttgcctgagaaaaaacggcaagcgcgttattcagctctctcggaaaacctttgacagcgagtatgtgaagacaagaaccaatgattgggacttcgtcgtgacgacagacatctccgaaatgggggcgaactttaaggccgagcgcgtgattgatcctcggagatgtatgaaaccggtcatcctgaccgacggagaagagcgcgttattcttgctggccccatgcctgtgacacattctagcgccgcccaacggagagggcgcatcggcagaaatccccggaacgagaatgatcagtacatctatatgggagaacctctggagaacgacgaagattgcgctcactggaaggaggccaaaatgctcctggacaatattaacacccccgaaggcatcattccgtccatgttcgagcctgagcgcgaaaaggtggatgcgatcgacggggagtacagactgcggggagaagctcgcaaaacgtttgtcgatctcatgagacggggcgaccttcccgtgtggctggcctacaaggttgccgctgaggggattaattatgccgatagacgctggtgtttcgacggaacccggaacaatcagatcctggaagagaacgtggaggtcgaaatttggacaaaagagggcgaaagaaagaagctcaaacctcgctggctggatgcgcggatctactctgacccccttgccctgaaggagttcaaagagtttgctgccgggagaaagagcctcaccctgaacctgatcacagaaatgggccggctccctaccttcatgacacagaaagctcgcgacgcccttgataatctggctgtgctgcataccgccgaggcgggaggcaaggcctataaccacgctctctccgaactgcccgagacgcttgaaacactgctcctgctgaccctccttgccaccgttacagggggaatttttctgttcctgatgagcggcagagggatcggaaagatgaccctcggcatgtgctgcattatcacagcttctattctgctttggtacgcccaaatccagccgcactggatcgccgcttccattatcctggagtttttcctcattgtgctgctgatccctgagcccgaaaaacagcggacgccccaggacaatcaactcacctatgtcattatcgcgatccttacagtggtcgccgctaccatggccaacgagatgggctttctggaaaagacaaaaaaggatctggggctcggaaatattgccacccagcagcctgagagcaacatcctggacattgatcttcgcccggcttccgcctggacgctgtacgcggtggccaccacattcatcacccccatgctcagacattctattgaaaatagctccgttaacgtgtctctgacagctatcgccaatcaggctaccgtgctgatgggcctcgggaaaggatggcctcttagcaagatggacattggcgtccccctgctggccatcgggtgttattcccaagttaaccctatcacgctcacagcggccctgcttctgctcgtggctcactacgccattatcggacccggcctgcaggctaaggccacccgggaggctcagaaacgcgccgcggccggcattatgaagaatcctacagtggatgggatcaccgtcattgacctggatccgatcccctacgaccctaaatttgagaagcagctcggacaagtgatgcttctggttctgtgcgtgacccaggtcctcatgatgagaacaacgtgggctctgtgtgaagcccttaccctggctacaggccccgtgagcaccctctgggaggggaaccctggacggttctggaatacaaccatcgccgtctctatggccaacatttttcgcggctcctatctggcgggggctggactgctcttcagcatcatgaaaaatacgacatctaccagacggggcaccggcaacattggggaaacacttggagagaagtggaagtccagactgaatgccctgggcaaaagcgaatttcagatctacaagaaatctgggattcaagaggtggatcgcaccctcgctaaggagggaatcaaacggggcgaaacagaccatcacgccgttagcagagggtccgccaagctgcgctggttcgtggagcggaaccttgtcacgcccgaaggaaaagtggttgatctgggctgcggcagagggggatggtcttattactgtggcgggctcaagaacgtgcgcgaggtcaagggactgaccaaaggcgggccgggacatgaggaacctatccccatgagcacatatggctggaatctggtgcggctccagtccggcgtggacgttttctttgtcccccctgagaagtgcgacacccttctgtgtgatattggggaaagctcccccaaccctacagtggaggctggaagaaccctgcgcgtgctcaatctggtcgaaaactggcttaataacaatacgcagttctgcgttaaagtgctgaacccgtacatgccctctgtgatcgagcggatggagaccctccagagaaagtatggcggggccctggtccgcaatcctctgagccggaactccacacacgaaatgtactgggtgtctaatgcgagcggaaacattgtttcctctgtgaatatgatcagcagaatgctcattaaccgctttaccatgagacacaaaaaggccacatacgagcccgacgtcgatcttggctccgggacccggaatatcggaatcgaaagcgagacacctaacctggacattatcggcaagcgcattgaaaaaatcaagcaagagcatgagacctcttggcactatgatcaggaccatccctacaaaacgtgggcttatcacggctcctacgaaacaaagcagaccgggagcgcctcttccatggtgaacggagttgtgagactgctcaccaaaccgtgggatgtcgtgcctatggtgacacagatggctatgacggacaccacacccttcggccaacagcgggtctttaaggagaaggttgataccagaacacaggaacctaaagaggggaccaagaaactgatgaagattacagccgaatggctttggaaagagctgggaaagaagaaaaccccccggatgtgtacgcgcgaggaattcaccaagaaagtgagaagcaatgcggccctcggcgctatctttacagacgagaacaagtggaaatctgcccgggaagctgtggaggattcccgcttctgggagctggtcgacaaggaaagaaatctgcacctcgaggggaaatgcgaaacctgtgtgtataacatgatgggaaagcgggagaagaaactgggcgaatttggcaaggccaaagggagccgcgctatttggtacatgtggcttggagccagattcctggagtttgaggcgctcggcttcctgaatgaagaccattggttttcccgggagaacagcctttctggggttgaaggagagggcctgcacaagctcgggtatatcctgcgcgaagtgagcaaaaaggagggcggagccatgtacgctgatgacacagccggctgggataccagaatcacgattgaggacctgaagaatgaagagatgatcacaaaccatatggctggggaacacaaaaagctcgccgaggccattttcaaactgacctaccagaataaggtcgtgcgggttcaacgccctacacccagaggaaccgtgatggatatcatttcccggcgcgaccagagaggctctgggcaggtcggaacgtatggccttaacaccttcacaaatatggaagcgcaactgatccggcagatggagggggagggcatctttaaaagcattcagcatctcaccgcttccgaagagatcgccgtgcaggattggctggttagagtgggacgcgaacggctttctagaatggccattagcggcgacgattgcgtcgtgaagccgctggacgatcgcttcgctcgggccctcacagctctgaacgacatggggaaggtcagaaaagatatccaacagtgggagccttcccgcggatggaatgactggacccaggtgcccttttgctctcaccacttccatgagctgattatgaaggacggccggacactcgttgtgccctgtagaaaccaggatgaactgatcgggcgcgcccggatcagccaaggagcgggctggtcccttagagagaccgcctgcctggggaaaagctacgctcagatgtggtctctcatgtattttcaccgccgggacctgagacttgccgctaatgccatttgttccgcggtccctagccattgggtgccgacgtctcggacaacctggtccatccacgccagccacgaatggatgaccacagaggatatgctgaccgtgtggaacaaggtttggattctcgaaaacccctggatggaggacaaaacacctgtggagtcctgggaagagatcccctacctgggcaagagagaagatcagtggtgcggatctctgattggcctcacgagccgcgctacctgggccaagaatatccagacagctattaaccaagtccggtccctgatcgggaatgaggaatataccgactacatgcctagcatgaaaagattccgcagagaggaggaagaggccggagtgctttggtga

SEQ ID NO: 19859 - RNA, 9876 nt, synthetic construct
  misc_feature 1..9876: note = derived and/or modified CDS sequence (opt5) from DENV-2__KF955359__SS-prME
  source 1..9876: mol_type = other RNA
acagccggcgtgatcattatgctgatccccacagctatggccttccacctcacgaccagaaatggggagcctcatatgattgttggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaaccatggccgctatcctcgcctacaccattggaacaacgcactttcagagagctctgatcttcattcttctgaccgccgtggcgcctagcatgacaatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacggaggctaagcagcctgccattctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgcctccctcgtgctggtgggcattgttacactgtatctcggggtcatggtgcaggccgacaccggatgtgtggtcagctggaagaataaagaactgaagtgcggctctgggatcttcattacagataacgtgcacacgtggaccgagcagtacaagtttcagcctgaatcccccagcaaacttgcttccgccatccaaaaggctcatgaggaaggcatctgtggaattagatctgttacacgcctggagaatctcatgtggaaacagatcaccccggagctgaaccacattctgagcgaaaatgaggtgaaacttacaatcatgaccggcgacattaaagggatcatgcaggccggaaagcggtccctcagacctcagcccacggaactgaaatattcttggaagacctggggcaaggcgaaaatgctgagcacagagtcccataaccaaaccttcctcatcgatgggcctgaaacagccgagtgccccaataccaaccgcgcttggaatagcctggaggtcgaagactacggatttggcgtgttctctacaaacatttggcttaagctgcgggagaaacaggacgtcttttgtgattccaagctcatgagcgccgctatcaaagacaatagagccgtgcacgcggatatgggctattggattgaatctgccctgaacgacacctggaagatggagaaggcttccttcatcgagattaaaagctgccactggcctaagtctcatacgctgtggagcaatggggtccttgaatccgagatgatcattcccaaaaacttcgccggaccggtgagccagcacaactaccgccctggctatcatacacagaccgctgggccctggcacctcggaaagctggaaatggattttgacttctgtgagggcaccacagttgtggtcaccgaagattgcgggaatcggggaccctctctgagaacgacaaccgcctccggcaaactcatcacagagtggtgctgtcggagctgcaccctgcctccgcttcgctacagaggcgaggacgggtgttggtacggaatggaaatccggcccctgaaggagaaggaagagaacctcgtgaatagcctggtgacagccggccatgggcaaattgataacttttctctgggagtccttggcatggctctcttcctggaagagatgctgagaacccgcgttgggacgaaacacgcgatcctcctggtggccgtgagctttgtcacccttattacaggaaatatgtccttccgggacctgggcagagtgatggttatggtgggcgctaccatgacagatgacatcgggatgggagtcacctatctcgccctgctggccgcttttaaggtgcgccctacgttcgccgcgggccttctgctcagaaaactgacatctaaggagctcatgatggctaccattgggatcgccctgcttagccagtccacaatccccgaaaccattctggagctcaccgatgccctggctctgggaatgatggttcttaaaatcgtgcggaacatggaaaagtaccagctggccgtcacaattatggcgatctcttgcgtgcctaatgctgttattctccaaaacgcctggaaggtgagctgtacgatcctggccgctgtctccgtgagccccctcctgcttacctcttcccagcagaaagccgactggatccctctggctctcacaattaagggcctgaatcccaccgccatctttctgacaacccttagccgcacgtctaaaaagagatcctggccgctgaacgaggcggtgatggccgtcgggatggttagcattctcgcttcttccctgctcaaaaatgacatccctatgacaggacccctggtggccggcggccttctgaccgtgtgctatgtcctgaccgggcggagcgctgatctcgaactggagaaggccgccgacgtgaaatgggaggatcaggctgaaatttccggaagctctcctatccttagcattacaatctccgaggacggctctatgagcatcaagaacgaagaggaggaacacaccctgacaattctcatccgcacggggctgctcgttatttccggagtgttccccgtctctatcccgattaccgcggccgcttggtacctgtgggaggtgaagaaacaaagagccggcgttctttgggatgtgccttctccccctcccgtcgggaaggccgaactggaggacggagcttatcggatcaaacagcgcggcatctttggctactcccagattggggccggagtgtataaggaaggcacattccataccatgtggcacgtcacaagaggggcggtgctgatgcatcggggaaaacgcatcgagccctcctgggctgatgttaagaaggacctcattagctacggcgggggatggaaactggagggcgaatggaaggagggcgaagaggtgcaggtccttgccctggaacctgggaaaaatccgagagccgtgcaaaccaagcccggactctttaaaacgaacaccggcacaatcggggctgtttccctggatttcagccctggaacctctggctcccccattgtggaccggaaggggaaggtcgtgggactctacggcaatggcgtggttacaagaagcggggcctatgtctctgcgatcgctcagaccgagaaatccatcgaggataaccctgaaattgaggacgatatcttccgcaagaaacggctgacaattatggaccttcaccccggagccggcaagacgaaaagatacctgcctgccatcgtgcgcgaagctattaagcgggggctgagaaccctcatcctggccccgacacgcgtggtcgctgccgagatggaagaggcgcttcggggactgcccattagatatcagacccctgccatccgcgctgagcataccggccgggaaatcgtggacctcatgtgtcacgccacatttacgatgagactgctcagccccgttcgggtgcctaactacaatctgattatcatggatgaggctcacttcaccgaccccgcctccattgccgctcgcgggtatatctctacaagagtcgaaatgggcgaggcggccggaatttttatgaccgctacaccgcctggcagccgggatcccttcccccagtccaacgcccctatcatggacgaggaacgcgagatccccgaaagaagctggaactctgggcatgagtgggtgaccgattttaagggaaaaacggtttggttcgtgccttccattaaggccggcaacgacatcgctgcctgccttcggaaaaatgggaagaaagtcattcaactgagcagaaagacatttgattctgaatacgtgaagacccgcgcgaacgactgggatttcgttgtgaccacagacatcagcgagatgggagctaattttcgggccgagagagtcattgatccgcgccggtgtatgaaacccgtgatcctgaccgacggcgaagagagagtgatcctcgccgggcctatgcccgtcacacactcctctgctgcccagcgccggggcagaattggacgcaaccctaagaatgaaaacgaccagtatatctacatgggcgagcccctggaaaatgatgaggactgcgcgcattggaaagaggccaagatgcttctggataacattaataccccggaagggatcattcctagcatgttcgagcccgaaagagagaaagttgacgctatcgatggagaataccggctccgcggcgaggccagaaagacgtttgtggacctgatgcggcgcggggatctgcctgtgtggctcgcttatagagtcgccgctgagggaattaactacgccgaccggagatggtgtttcgatggcatcaaaaataaccaaatccttgaagagaacgtggaagttgagatttggacaaaggagggggaacgcaagaaactgaagccccggtggctggacgcgagaatctattccgatcctctcgccctgaaagagttcaaggaatttgctgccggccgcaaatctcttaccctgaatctcattacagagatgggacggctgcccaccttcatgacgcagaaggctagagacgccctggataacctcgccgtgcttcacaccgctgaagtcggcgggcgggcgtacaatcacgccctgagcgagctgccggagacactcgaaaccctgcttctgctcacactgctggctaccgtgacaggaggcatctttctcttccttatgtccgggaagggaattggcaaaatgaccctgggcatgtgctgcatcatcacggccagcattctgctctggtatgcccagatccagcctcattggattgctgcctctatcattctggagtttttccttatcgttctgctcatccccgaacccgagaagcaacgcacacctcaggacaaccagctgacctacgtggtcattgcgatcctgaccgtggtcgccgctacaatggccaatgaaatggggtttctcgagaaaaccaagaaagaccttggactgggctccattacaacgcaggagagcgaatccaacatcctggatattgacctcagaccggcttctgcctggaccctgtatgcggtggccacaaccttcgttacacccatgcttcggcacagcatcgaaaattcctctgtgaacgtgagcctgaccgctattgccaatcaagctacggtcctcatggggctgggacgcggctggcctctgtccaagatggatatcggggttcccctccttgccatcggatgttacagccaggtgaaccctattaccctgacagctgccctgctcctgcttgtggcgcattacgccatcattggccccggcctgcaggctaaggccaccagagaagctcagaaacggacagccgccgggatcatgaagaatcctaccgtcgacggaattacggtgatcgatctcgagccgatcccctatgaccctaaatttgaaaagcaactgggccaggttatgctgctcgtgctttgcgtcacacaggtgctgatgatgcgcaccacatgggcgctgtgtgaggctctcaccctggccaccgggcccatttctacactttgggagggaaaccctggcagattctggaatacgaccatcgctgtctccatggccaacatttttcgggggagctacctggccggagctggcctcctgttctctatcatgaaaaatacaaccaacacacgcagaggcaccgggaatattggagaaacgctgggcgagaagtggaagtcccggctcaacgcccttgggaaaagcgaatttcagatctataagaaatctggaatccaagaggtggatagaacactggcgaaggagggcattaaacgcggggaaaccgaccaccatgccgttagccggggatccgctaagctgagatggttcgtggagcgcaacatggtcacccccgaaggcaaagtggttgatctcggctgcgggcggggaggctggtcttactattgtgggggactgaagaatgtgagagaggtcaagggccttacaaaagggggaccgggccacgaagaacctatccccatgagcacctacggctggaacctggtgcgcctccagtccggggtggacgttttctttacaccccctgagaagtgcgatacgctgctgtgtgacattggagaaagctcccccaatcctaccatcgaggccggccggacactcagagtccttaacctggtggaaaattggctgaacaataacacccagttctgcgtgaaagtcctcaatccgtatatgccctctgttattgagaagatggaaacactgcaacgcaaatacgggggagctcttgtgcggaaccctctgagcagaaattccacccacgagatgtactgggtgtctaacgccacgggcaatatcgtcagctccgtgaacatgatctctcgcatgctcattaatcggtttaccatgaagcataagaaagcgacatatgagcccgatgttgacctggggagcggaaccagaaacatcggcattgaaaacgagatccctaatctggacattatcggcaagcgcattgagaagatcaagcaggagcacgaaacatcctggcattacgatcaggaccacccctataaaacctgggcctaccacgggagctatgagacaaagcagaccggatctgcttccagcatggtgaacggcgtcgtgaagctccttacgaaaccgtgggatgttgtgcctatggtcacacaaatggccatgaccgacaccacacccttcgggcagcagagagtgtttaaggagaaagtggatacgcggacccaggaacctaaggagggaaccaaaaagctgatgcgcatcaccgctgaatggctgtggaaggagctcggcaaaaagaaaacacccagaatgtgtacccgggaggagttcacaagaaaggtccggtctaatgccgctctgggggccatttttaccgacgagaacaaatggaagtccgcgcgcgaagccgttgaggatagcagattctgggaacttgtggaccgggagcgcaatctgcatctcgagggaaaatgcgaaacgtgtgtgtacaacatgatgggcaagagagagaagaaactgggcgaatttgggaaggctaaaggatctcgggccatctggtatatgtggctgggcgctcgcttcctcgagtttgaagccctggggttccttaatgaggatcactggttttccagaggaaacagcctgtccggcgtcgagggggaaggcctccataagctgggatacattcttcgggacgtgagcaaaaaggagggcggggccatgtacgcggatgacaccgctggatgggacacacgcatcaccctggaagatctcaagaatgaggaaatggttacaaaccacatgaaaggcgagcataagaaactggccgaggccattttcaagctgacctatcaaaataaagtggtcagagtgcagcggcctacgccccgcgggacagttatggacatcatctctagaaaggatcagcggggaagcggccaggtggggacctacggcctcaacacattcaccaatatggaagctcaactgattcgccagatggagggagaaggcatctttaagtccattcagagacttacggtcaccgaggagatcgccgtgcaaaactggctggctcgggttgggagagaacgcctctctcggatggccattagcggagacgattgcgtggtcaaaccgctggacgatagattcgcgtccgcccttacagctctgaatgacatgggcaaggtgcgcaaagatatccagcagtgggagccttctcgggggtggaacgactggacccaggtccccttttgcagccaccacttccatgaactcgtgatgaaggatggaagaatgctggttgtgccctgtcgcaaccaagacgagctgatcggccgggccagaatttcccagggggctggctggtctctcaaagaaacagcctgcctgggaaagagctatgcgcagatgtggacccttatgtactttcaccgccgggatctgagactcgccgctaatgccatctgttccgctgtccctagccattgggtgccgacatctcgcaccacgtggtccattcacgccaagcacgagtggatgacaaccgaggacatgctggctgtgtggaaccgggtttggatccaggaaaatccctggatggaggacaaaacccctgtggaaagctgggaggaagtcccctatcttggcaagagagaggatcaatggtgcgggtctctgattggactcacatcccgggccacctgggcgaaaaacatccagacagccattaatcaggtgagaagcctgatcggcaacgaggaatacacggactatatgccttccatgaagcgcttccggaaagaggaagaggaagctggggttctgtggtga

SEQ ID NO: 19860 - RNA, 9876 nt, synthetic construct
  misc_feature 1..9876: note = derived and/or modified CDS sequence (opt5) from DENV-2__KF955360__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtgctacaaccggggagcaccggcgggaaaagcgcagcgtggccctcgtccctcatgtgggaatgggcctggagacaagaaccgaaacgtggatgtcctctgagggcgcctggaagcacgttcagcggatcgagacatggattctgcgccatcccgggttcaccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaagacagaggccaagcagcctgctaccctgagaaaatattgcatcgaagccaagctcacgaacacaaccaccgagagccggtgtccgacacaaggagagccctctctgaatgaggaacaggacaaacgctttatttgcaagcattccatggtggatagaggctggggcaacgggtgtggactgttcggcaaagggggaatcgtgacctgcgcgatgtttacatgcaaaaagaatatggaaggcaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggacaaagcctggcttgttcaccgccaatggtttctggatctcccgctgccttggctgcccggggctgacacccagggatctaattggattcagaaggagacactcgtgaccttcaagaaccctcatgccaaaaagcaggacgtcgtggttctgggctcccaagaaggggccatgcacacggctcttacaggcgcgaccgagatccagatgagctccggaaatctgctctttacaggccatctgaaatgcagacttcggatggataagctgcagctcaaagggatgtcttacagcatgtgtaccggaaagttcaagattgtgaaagaaatcgccgagacccaacacggcacaatcgtcattagagtgcagtatgagggggacggatccccctgcaagatccccttcgaaattatggatctggagaaacgccatgtcctgggccggctcatcacggtgaaccctattgttaccgaaaaggacagcccggtgaacatcgaggctgaacccccttttggggattcttacattatcatcggcgtcgagcccggacagctgaaacttaattggttcaagaagggctccagcattgggcagatgtttgagacaaccatgagaggagccaaacgcatggccatcctgggcgacacagcttgggatttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggtgatggtccaggccgacagcggatgtgtggtttcttggaagaataaagaactgaagtgcggctccgggattttcatcacagataacgtgcacacctggacagagcagtacaagtttcagcctgaaagcccctccaaacttgcttctgccattcaaaaggctcatgaggaaggcatctgtggaatcagaagcgtcacgcgcctggagaatctcatgtggaaacagattaccccggagctgaaccacatcctgtccgaaaatgaggtgaaacttacaattatgaccggcgacatcaaagggattatgcaggccggaaagcggtctctcagacctcagcccacagaactgaaatatagctggaagacctggggcaaggcgaaaatgctgtccacggagagccataaccaaaccttcctcatcgatgggcctgaaacagccgagtgccccaataccaaccgcgcttggaactctctggaggttgaagactacggatttggcgtgttctccacaaacatctggcttaagctgcgggagaaacaggacgtcttttgtgatagcaagctcatgtctgccgctattaaagacaatagagccgtgcacgcggatatgggctattggatcgaatccgccctgaacgacacctggaagatggagaaggctagcttcattgagatcaaatcttgccactggcctaagagccatacactgtggtccaatggggttcttgaaagcgagatgattatccccaaaaacttcgccggaccggtgtctcagcacaactaccgccctggctatcatacccagacggctgggccctggcacctcggaaagctggaaatggattttgacttctgtgagggcacaaccgtcgtggtgaccgaagattgcgggaatcggggaccctccctgagaacaaccacggccagcggcaaactcattacagagtggtgctgtcggtcctgcaccctgcctccgcttcgctacagaggcgaggacgggtgttggtacggaatggaaatccggcccctgaaggagaaggaagagaacctcgtcaattctctggttacagccggccatgggcaaatcgataactttagcctgggagtgcttggcatggctctcttcctggaagagatgctgagaacccgcgtggggacaaaacacgcgattctcctggtcgccgtgtcctttgttacccttatcacgggaaatatgtctttccgggacctgggcagagtgatggtcatggtgggcgctaccatgacagatgacattgggatgggagttacctatctcgccctgctggccgcttttaaggtgcgccctacattcgccgcgggccttctgctcagaaaactgaccagcaaggagctcatgatggctacgatcgggattgccctgctttcccagtctacaatccccgaaaccatcctggagctcacagatgccctggctctgggaatgatggtccttaaaattgtgcggaacatggaaaagtaccagctggccgttaccatcatggcgattagctgcgtgcctaatgctgtcatcctccaaaacgcctggaaggtgtcctgtaccattctggccgctgtgagcgtctctcccctcctgcttacatccagccagcagaaagccgactggatccctctggctctcacgatcaagggcctgaatcccaccgccatttttctgacaaccctttctcgcacatccaaaaagagaagctggccgctgaacgaggcggttatggccgtggggatggtgtctatcctcgcttccagcctgctcaaaaatgacattcctatgaccggacccctggtcgccggcggccttctgacggtgtgctatgttctgacagggcggtccgctgatctcgaactggagcgcgccgccgacgtgaagtgggaggatcaggctgaaatcagcggatctagccctattctttccatcaccatttctgaggacggcagcatgtccatcaaaaacgaagaggaggaacacaccctgacaatcctcattagaaccgggctgctcgtcatctctggagtgttccccgttagcattccgatcacagcggccgcttggtacctgtgggaggtgaagaagcaacgggccggcgtcctttgggatgtgccttctccccctcccgtcgggaaagccgaactggaggacggagcttatcgcattaagcagagaggcatctttggctacagccagatcggggccggagtgtataaagaaggcacgttccataccatgtggcacgttacaagaggggcggtgctgatgcatcgcggaaagagaattgagcccagctgggctgatgtcaaaaaggacctcatctcctacggcgggggatggaagctggagggcgaatggaaagagggcgaagaggtgcaggttcttgccctggaacctgggaagaatccgcgggccgtgcaaaccaaacccggactctttaagacaaacaccggcacgattggggctgtcagcctggatttctctcctggaacctccggcagccccatcgtggacagaaaagggaaggtggttggactctacggcaatggcgtcgtgacacgctctggggcctatgtgtccgcgattgctcagaccgaaaagagcatcgaggataaccctgaaatcgaggacgatattttccggaaaaagagactgacaatcatggaccttcaccccggagccggcaaaaccaagcgctacctgcctgccattgtccgggaagctatcaaaagagggctgcgcacactcattctggccccgacgcgggtggttgctgccgagatggaagaggcgcttagaggactgcccatccgctatcagacccctgccattcgggctgagcatacaggcagagaaatcgtggacctcatgtgtcacgccacctttaccatgcggctgctctcccccgtccgcgtgcctaactacaatctgatcattatggatgaggctcacttcacagaccccgcctctatcgccgctagagggtatattagcacgcgggttgaaatgggcgaggcggccggaatctttatgaccgctacaccgcctggctcccgcgatcccttcccccagagcaacgcccctattatggacgaggaaagagagatccccgaacggtcttggaactccgggcatgagtgggtgaccgattttaagggaaagacagtctggttcgtgcctagcatcaaagccggcaacgacattgctgcctgccttagaaagaatgggaaaaaggttatccaactgtctcgcaaaacctttgatagcgaatacgtgaagacgcgggcgaacgactgggatttcgtcgtgacaaccgacatttccgagatgggagctaattttagagccgagcgcgtgatcgatccgcggagatgtatgaagcccgtcattctgaccgacggcgaggaacgcgttatcctcgccgggcctatgcccgtgacacactctagcgctgcccagcggagaggccgcatcggaagaaaccctaaaaatgaaaacgaccagtatatttacatgggcgagcccctggaaaatgatgaggactgcgcgcattggaaggaggccaaaatgcttctggataacatcaataccccggaagggattatcccttccatgttcgagcccgaacgggagaaggtggacgctattgatggagaataccgcctcagaggcgaggcccggaaaacatttgtcgacctgatgcgcagaggggatctgcctgtgtggctcgcttatcgggttgccgctgagggaatcaactacgccgacagacgctggtgtttcgatggcattaagaataaccaaatccttgaagagaacgtggaagtcgagatctggaccaaagagggggaacggaagaagctgaaacccagatggctggacgcgcgcatttattctgatcctctcgccctgaaggagttcaaagaatttgctgccggccggaagtcccttacgctgaatctcatcacagagatgggaagactgcccaccttcatgacacagaaagctcgggacgccctggataacctcgccgtgcttcacaccgctgaagttggcgggcgcgcgtacaatcacgccctgtccgagctgccggagacgctcgaaaccctgcttctgctcacactgctggctaccgtgacaggaggcatttttctcttccttatgagcgggaagggaatcggcaagatgaccctgggcatgtgctgcattatcacagcctctatcctgctctggtatgcccagattcagcctcattggatcgctgcctccattatcctggagtttttccttattgtcctgctcatccccgaacccgagaaacaaagaacccctcaggacaaccagctgacgtacgtggtcatcgcgattctgacagtggttgccgctaccatggccaatgaaatggggtttctcgagaagaccaaaaaggaccttggactgggcagcatcacaacccaggagtccgaatctaacattctggatatcgacctccggccggctagcgcctggacactgtatgcggtggccacgaccttcgtgacacccatgcttcgccactccattgaaaattctagcgtcaacgtttccctgaccgctatcgccaatcaagctacagtgctcatggggctgggaagaggctggcctctgagcaaaatggatattggggtgcccctccttgccatcggatgttactctcaggtcaaccctatcaccctgacggctgccctgctcctgcttgtggcgcattacgccattatcggccccggcctgcaggctaaggccacccgggaagctcagaagcgcacagccgccgggattatgaaaaatcctaccgttgacggaatcacagtgattgatctcgagccgatcccctatgaccctaagtttgaaaaacaactgggccaggtcatgctgctcgtgctttgcgtcacccaggtgctgatgatgagaacgacatgggcgctgtgtgaggctctcaccctggccacagggcccatctccaccctttgggagggaaaccctggccggttctggaataccacaattgctgttagcatggccaacatctttcgcgggtcttacctggccggagctggcctcctgttctccattatgaagaatacgaccaacacaagacggggcaccgggaatatcggagaaacactgggcgagaaatggaaaagcagactcaacgcccttgggaagtctgaatttcagatttataaaaagagcggaatccaagaggtggatcgcaccctggcgaaagagggcatcaagagaggggaaacggaccaccatgccgtctccagaggatctgctaaactgcgctggttcgtggagcggaacatggttacacccgaaggcaaggtggtcgatctcggctgcgggagaggaggctggagctactattgtgggggactgaaaaatgtgcgcgaggtgaagggccttaccaaagggggaccgggccacgaggagcctattcccatgtccacctacggctggaacctggttcggctccagagcggggtcgacgtgttctttacaccccctgagaaatgcgataccctgctgtgtgacatcggagaatcctctcccaatcctacaattgaggccggcagaacgctccgcgtgcttaacctggtcgaaaattggctgaacaataacacccagttctgcatcaaggttctcaatccgtatatgcccagcgtgattgagaaaatggaaacactgcaacggaagtacgggggagctcttgtgagaaaccctctgtcccgcaattctacccacgagatgtactgggtcagcaacgccacaggcaatatcgtgtcctctgttaacatgatcagccggatgctcattaatagatttaccatgaaacataagaaggcgacgtatgagcccgatgtggacctggggtccggaacccgcaacatcggcattgaaaacgagatccctaatctggacattatcggcaaaagaattgaaaagatcaaacaggagcacgaaacaagctggcattacgatcaggaccacccctataagacctgggcctaccacgggtcttatgagacaaaacagaccggatccgctagctctatggtcaacggcgtggttaagctccttacaaagccgtgggatgtggtccctatggtgacccaaatggccatgacggacacaacccccttcgggcagcagcgggtgtttaaagagaaggtcgatacccgcacacaggaacctaaagagggaacgaagaaactgatgagaatcaccgctgaatggctgtggaaggagctcggcaagaaaaagacaccccggatgtgtaccagagaggagttcacacggaaagttcgctccaatgccgctctgggggccatttttaccgacgagaacaagtggaaaagcgcgagagaagccgtggaggattctcggttctgggaacttgtggaccgcgagagaaatctgcatctcgagggaaagtgcgaaacatgtgtctacaacatgatgggcaaacgggagaagaagctgggcgaatttgggaaagctaagggatcccgcgccatctggtatatgtggctgggcgctagattcctcgagtttgaagccctggggttccttaatgaggatcactggtttagccggggaaactccctgagcggcgtggagggggaaggcctccataaactgggatacattcttcgcgacgtttctaagaaagagggcggggccatgtacgcggatgacaccgctggatgggacacgagaatcaccctggaagatctcaagaatgaggaaatggtgacaaaccacatgaagggcgagcataaaaagctggccgaggccattttcaaactgacctatcaaaataaggtcgtgcgggttcagcgccctacacccagagggaccgtgatggacatcatcagccggaaagatcagcgcggatccggccaggtcgggacgtacggcctcaacacattcaccaatatggaagctcaactgattagacagatggagggagaaggcatctttaagtctattcagcggcttacagtgaccgaggagatcgccgttcaaaactggctggctagagtggggcgcgaacggctcagcagaatggccatttccggagacgattgcgtcgtgaagccgctggacgatcgcttcgcgtctgcccttacggctctgaatgacatgggcaaagtccggaaggatatccagcagtgggagcctagcagagggtggaacgactggacccaggtgcccttttgctcccaccacttccatgaactcgttatgaaagatggacgcgtgctggtcgtgccctgtcggaaccaagacgagctgatcggcagagcccgcatttctcagggggctggctggagcctcaaggaaacagcctgcctgggaaaatcctatgcgcagatgtggacccttatgtactttcaccggagagatctgcgcctcgccgctaatgccatctgtagcgctgtgccttctcattgggttccgacatcccggaccacatggagcattcacgccaagcacgagtggatgaccacggaggacatgctggctgtgtggaacagagtctggatccaggaaaatccctggatggaggacaagacacctgtggaatcttgggaggaagttccctatcttggcaaacgggaggatcaatggtgcgggtccctgattggactcaccagcagagccacctgggcgaagaacatccagacagccattaatcaggtgcgctccctgatcggcaacgaggaatacaccgactatatgccttctatgaaacggttcagaaaggaggaagaggaagctggggtcctgtggtga

SEQ ID NO: 19861 - RNA, 9876 nt, synthetic construct
  misc_feature 1..9876: note = derived and/or modified CDS sequence (opt5) from DENV-2__KF955363__SS-prME
  source 1..9876: mol_type = other RNA
accgccggagtgatcattatgctgatccccaccgctatggccttccacctcacgacccggaatggggaacctcatatgattgtcggacggcaggaaaagggcaagagcctgctttttaagaccgaggacggggttaatatgtgcaccctgatggcgatcgatctcggagaactgtgtgaggacaccattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaagggggaattgtgacatgcgccatgtttacgtgcaaaaagaatatggaaggcaaagtcgttcagcctgagaacctggaatacaccatcgtgattacaccccacagcggggaggagcatgcggtgggaaatgacaccggcaagcacggcaaagaaatcaagatcacacctcagtcttccattaccgaggccgaacttacggggtatggaaccgtcacaatggagtgtagcccccggaccggcctggatttcaacgaaatggtgctcctgcaaatggaggacaaggcttggcttgttcaccgccagtggtttctggatctcccgctgccttggctgcccggggccgacacacagggatctaattggatccagaaggagaccctcgtgacgttcaagaaccctcatgctaaaaagcaagacgtcgtggttctgggctcccaggaaggggccatgcacacagcccttaccggcgctacagagattcagatgagctccggaaatctgctctttaccggccatctgaaatgcagacttcggatggataagctgcaactcaaagggatgtcttacagcatgtgtaccggaaagttcaagatcgtgaaagaaattgcggagacacagcacggcacgatcgtcatcagagtgcagtatgagggggacggatccccctgcaagattcccttcgaaatcatggatctggagaaacgccatgtcctgggccggctcattaccgtgaaccctatcgttacagaaaaggacagcccggtgaacattgaggccgaacccccttttggggattcttacatcattatcggcgtcgagcccggacagctgaaacttaattggttcaagaagggctccagcatcgggcaaatgtttgagaccacaatgagaggagctaaacgcatggccattctgggcgacaccgcctgggatttcgggtctctcggaggcgtgtttacgagcatcgggaaggctctgcaccaggttttcggcgccatttacggagcggctttttccggcgtgtcttggacaatgaaaatcctgattggggtcatcatcacctggattggaatgaacagccggtccaccagcctttctgtgtccctcgtgctggttggcgtcgtgacactgtatctcggggccatggtgcaggccgacagcggatgtgtcgtgtcttggaagaataaagaactgaagtgcggctccgggatcttcattaccgataacgttcacacatggacggagcagtacaagtttcaacctgaaagcccctccaaacttgcttctgccatccagaaggctcatgaggaaggcatttgtggaatcagaagcgtgacccgcctggagaatctcatgtggaaacaggtcacaccggagctgaaccacatcctgtccgaaaatgaggtgaaacttaccattatgacaggcgacatcaaagggattatgcaggccggaaagcggtctctcagacctcaacccaccgaactgaaatatagctggaagacgtggggcaaggcgaaaatgctgtccaccgagagccataaccagacattcctcatcgatgggcctgaaaccgccgagtgccccaatacaaaccgcgcttggaactctctggaggttgaagactacggatttggcgtgttcaccacaaacatttggcttaagctgcgggagaaacaggacgtcttttgtgattccaagctcatgagcgccgctatcaaagacaatagagccgtgcacgcggatatgggctattggatcgaatctgccctgaacgacacctggaagatggagaaggcttccttcattgaggttaaaagctgccactggcctaagtctcatacgctgtggagcaatggggtgcttgaatccgagatgatcattcccaaaaacttcgccggaccggtcagccagcacaactaccgccctggctatcatacacaaaccgctgggccctggcacctcggaaagctggaaatggattttgacttctgtgagggcaccacagtggtggtcaccgaagattgcgggaatcggggaccctctctgagaacgacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgttaattccctggtgacagccggccatgggcagatcgataacttttctctgggagtgcttggcatggctctcttcctggaagagatgctgagaacccgcgtcgggacgaaacacgcgattctcctggtggccgttagctttgtgacccttatcacaggaaatatgtccttccgggacctgggcagagtcatggtgatggttggcgctaccatgacagatgacatcgggatgggagtgacctatctcgccctgctggccgcttttaaggtccgccctacgttcgccgcgggccttctgctcagaaaactgacatctaaggagctcatgatggctaccattgggatcgccctgcttagccagtccacaattcccgaaaccatcctggagctcaccgatgccctggctctgggaatgatggtgcttaaaattgttcggaacatggaaaagtaccaactggccgtgacaatcatggcgatctcttgcgtccctaatgctgtgattctccagaacgcctggaaggtgagctgtacgatcctggccgctgtctccgttagccccctcctgcttacctcttcccagcagaaagccgactggattcctctggctctcacaatcaagggcctgaatcccaccgccatttttctgacaacccttagccgcacgtctaaaaagagatcctggccgctgaacgaggcgatcatggccgtggggatggtgagcatcctcgcttcttccctgctcaaaaatgacattcctatgacaggacccctggtcgccggcggccttctgaccgtgtgctatgttctgaccgggcggagcgctgatctcgaactggagcgcgccgccgacgtgaagtgggaggatcaagctgaaatctccggaagctctcctattcttagcatcacaatttccgaggacggctctatgagcatcaaaaacgaagaggaggaacagaccctgacaattctcatcagaacggggctgctcgtcatctccggagtgttccccgtttctattccgatcaccgcggccgcttggtacctgtgggaggtgaagaagcagcgggccggcgtcctttgggatgtgccttctccccctcccgtcgggaaagccgaactggaggacggagcttatcgcattaagcagagaggcatcctgggctactcccaaattggggccggagtgtataaagaaggcacatttcacaccatgtggcatgttacaagaggggcggtgctcatgcaccgcggaaagagaatcgagccctcctgggctgatgtcaaaaaggacctgatcagctacggcgggggatggaaacttgagggcgaatggaaagagggcgaagaggtgcaggttctggccctcgaacctgggaagaatccgcgggccgtgcagaccaaacccggactgttcaagacgaacaccggcacaattggggctgtctccctcgattttagccctggaacctctggctcccccatcgtggacagaaaagggaaggtggttggactgtacggcaatggcgtcgtgacacgcagcggggcctatgtgtctgcgattgctcagaccgagaagtccatcgaggataaccctgaaattgaggacgatatcttccggaaaaagagacttacaatcatggacctgcatcccggagccggcaaaacgaagcgctacctgcctgccattgtccgggaagctatcaaaagagggctccgcaccctgattcttgccccgacacgggtggttgctgccgagatggaagaggcgctgagaggactccccatccgctatcaaacccctgccattcgggctgagcacaccggcagagaaatcgtggacctgatgtgtcatgccacattcacgatgcggctcctgagccccgtccgcgtgcctaactacaatcttattatcatggatgaggctcactttaccgaccccgcctccatcgccgctagagggtatatttctacacgggttgaaatgggcgaggcggccggaatcttcatgaccgctacaccgcctggcagccgcgatccctttccccagtccaacgcccctattatggacgaggaaagagagatccccgaacggagctggaactctgggcacgagtgggtgaccgatttcaagggaaagacggtctggtttgtgccttccattaaagccggcaacgacatcgctgcctgcctgagaaagaatgggaaaaaggttatccagctgagccgcaaaacattcgattctgaatacgtgaagacccgggcgaacgactgggattttgtcgtgaccacagacattagcgagatgggagctaatttcaaggccgagagagtgatcgatccgcgccggtgtatgaaacccgtcattctcaccgacggcgaagagagagttatcctggccgggcctatgcccgtgacacattcctctgctgcccaacgccggggcagaattggacgcaaccctaagaatgaaaacgaccagtatatctacatgggcgagccccttgaaaatgatgaggactgcgcgcactggaaagaggccaagatgctgctcgataacatcaataccccggaagggattatccctagcatgtttgagcccgaaagagagaaagtggacgctattgatggagaataccggctgcgcggcgaggccagaaagacgttcgtcgacctgatgcggcgcggggatctccctgtgtggcttgcttatagagttgccgctgagggaatcaactacgccgaccggagatggtgttttgatggcattaaaaataaccagatcctggaagagaacgtggaagtcgagatttggacaaaggagggggaacgcaagaaactgaagccccggtggctcgacgcgagaatctattccgatcctctggcccttaaagagttcaaggagttcgctgccggccgcaaatctctgaccctcaatctgatcacagagatgggacggctgcccacctttatgacgcagaaggctagagacgccctcgataaccttgccgtgctgcataccgctgaagcgggcgggaaggcctacaatcacgctctgagcgagctcccggagacactggaaacccttctgctcctgacactgctcgccaccgttacaggaggcattttcctttttctgatgtccgggaaaggaatcggcaagatgaccctgggcatgtgctgcattatcacggccagcattctcctgtggtatgctcaaatccagcctcactggatcgccgcgtctattatccttgagttctttctgattgtgctcctgatccccgaacccgagaaacagcggacacctcaggacaaccaactgacctacgtcgtgattgccatcctcaccgtcgtggctgccacaatggctaatgaaatggggttccttgagaagaccaaaaaggacctgggactgggctccatcacaacgcaggagagcgaatccaacattctcgatatcgacctgcgcccggcctctgcgtggaccctttatgccgttgctacaacctttgtgacacccatgctgagacatagcattgaaaatagctctgtgaacgtcagcctcaccgccatcgctaatcaggccacggttctgatggggctgggaaagggctggcctctctccaaaatggatattggggtgccccttctggctatcggatgttacagccaggtgaaccctattaccctgacagccgcgctcctgcttctggtcgcccactacgctatcatcggccccggcctccaagccaaggctacccgggaagcccagaaacgcgccgcggctgggattatgaagaatcctacagtggacggaatcaccgttattgatctggagccgatcccctatgaccctaaattcgaaaagcagctgggccaggtgatgctccttattctgtgcgtcacgcaagtgctgatgatgagaacaacctgggccctctgtgaggctctgacacttgccaccgggcccatctctaccctgtgggagggaaaccctggccggttttggaatacaacgatcgccgtctccatggctaacattttccgcgggagctacctcgccggagcgggcctgctgttttctatcatgaagaataccacaaacaccagacggggcacagggaatattggagaaaccctcggcgagaaatggaagtcccgccttaacgccctggggaaaagcgagttccagatctataagaaatctggcattcaggaggtggatagaacgctggctaaggagggcatcaaaagaggggaaacagaccatcacgccgttagcagaggatccgctaagctccgctggtttgtggagcggaacatggtcacccccgaaggcaaggtggttgatctgggctgcgggagaggaggctggtcttactattgtgggggacttaaaaatgtgcgcgaggtcaagggcctgaccaaagggggaccgggccatgaagaacctatccccatgagcacatacggctggaacctcgtgcggctgcaatccggggtggacgttttcttcacaccccctgagaagtgcgatacactgctctgtgacattggagaaagctcccccaatcctacgatcgaggccggcagaacccttcgcgtcctgaacctggtggaaaattggctcaacaataacacacagttttgcattaaagtgctgaatccgtatatgccctctgtcatcgagaagatggaaacccttcagcggaagtacgggggagcgctggttagaaaccctctcagccgcaattccacacacgagatgtactgggtgtctaacgccaccggcaatattgtgagctccgtcaacatgatctctcggatgctgatcaatagattcacgatgaaacacaagaaagctacctatgagcccgatgtggacctggggagcggaacacgcaacattggcatcgaatccgagattcctaacctcgacatcattggcaagcggatcgagaagattaagcaggagcatgaaaccagctggcactacgatcaagaccatccctataagacatgggcctaccacgggtcttatgagaccaaacagacaggatccgctagctctatggttaatggcgtggtcagacttctgaccaagccgtgggatgtggttcctatggtgacgcagatggccatgacagacaccaccccctttgggcagcaacgcgtcttcaaagagaaggtggatacaagaacgcaggaacctaaagagggaaccaagaagctgatgaaaatcacagctgaatggctctggaaggagctgggcaaaaagaaaacaccccggatgtgtacacgcgaggaatttaccagaaaggtgcggtccaacgccgcgcttggggccatcttcacagacgagaataaatggaaaagcgctagagaagccgtcgaggattctcggttttgggaactggttgaccgcgagagaaacctccacctggagggaaagtgcgaaacctgtgtgtacaatatgatgggcaaacgggagaagaaactgggcgagttcgggaaggctaaaggatcccgcgccatttggtatatgtggctcggcgccagatttctggagttcgaagcgcttgggtttctgaacgaggatcattggttcagccggggaaattccctcagcggcgtggagggggaaggcctgcaccgccttggatacatcctgagagacgtctctaagaaggagggcggggctatgtacgccgatgacacggccggatgggacacccggattacactcgaagatctgaaaaacgaggaaatggtgaccaatcatatgaagggcgagcacaaaaagctggctgaggccatctttaaactcacatatcagaacaaggttgtgcgcgtccagagacctacaccccgggggacggtgatggacattatcagccgcagagatcaacggggatccggccaggttgggacatacggcctgaataccttcacaaacatggaagctcagcttatccgccaaatggagggagaaggcattttcaagtctatccagcatctgaccgtgacggaggagattgccgtccagaattggctcgcgagagtggggcgggaaagactgagccgcatggttatctccggagacgattgcgtggtcaaaccgcttgacgatcggtttgcctctgctctgaccgccctcaacgacatgggcaaggtgagaaaagatattcagcaatgggagcctagccgcgggtggaatgactggacacaggtccccttctgctcccaccactttcatgaactggtgatgaaggatggacgggttctggtggtcccctgtagaaaccaggacgagctcatcggccgcgctcggatctctcagggggccggctggagcctgaaagaaaccgcgtgccttggaaagtcctatgcccaaatgtggacactgatgtacttccacagacgcgatctccggctggctgccaacgctatttgtagcgccgtgccttctcattgggtgccgacctccagaacaacctggagcatccacgctaagcacgagtggatgacgacagaggacatgcttgccgtttggaatcgcgtgtggattcaggaaaacccctggatggaggacaaaacccctgtcgaatcttgggaggaagtgccctatctgggcaagcgggaggatcagtggtgcgggtccctcatcggactgaccagcagagcgacatgggccaaaaatattcagaccgctatcaaccaagttcggtccctgattggcaatgaggaatacacagactatatgccttctatgaagagatttcgccgggaggaagaggaagccggggtgctctggtga

SEQ ID NO: 19862 - RNA, 9876 nt, synthetic construct
  misc_feature 1..9876: note = derived and/or modified CDS sequence (opt5) from DENV-2__EU726767__SS-prME
  source 1..9876: mol_type = other RNA
agcgctggcatgatcattatgctgatccccaccgtgatggctttccacctgacaacgagaaatggggagcctcatatgattgtctcccggcaggaaaagggaaaatctctgctttttaagaccgaggacggcgttaatatgtgcacactgatggccatggatctcggggaactgtgtgaggacaccatcacatacaaatgcccgcttctgcgccaaaacgaacccgaggatattgactgttggtgcaatagcacctccacatgggtgacctatggaacgtgtgcgaccacaggcgagcacagacgggaaaagcgctctgtggctctcgtccctcatgtggggatgggactggagaccagaacagaaacctggatgagctccgagggcgcctggaaacacgcccagcggatcgagacgtggatcctgcgccatcccggcttcacaattatggctgccatcctcgcttacaccattgggacaacccactttcagagagccctgatcttcattcttctgaccgcggttgccccttctatgacaatgcggtgcatcggaattagcaaccgcgattttgtggaaggcgtctccgggggaagctgggtggacatcgttctcgagcacggctcttgtgtgacgaccatggctaagaataagcccacactggatttcgaacttatcaaaaccgaggccaagcagcctgctacactgagaaaatattgcattgaagccaagctcaccaacacgacaaccgagtcccggtgtccgacccaaggggagcccagcctgaaagaagaacaagacaagcgctttgtctgcaagcattctatggtggatagaggatggggcaatggctgtgggctgttcggaaaaggcgggatcgtgacatgcgcgatgtttacctgcaagaaaaacatggaaggaaagattgtccagcctgagaatctcgaatacacaatcgttgtgacgccccactccggcgaggagcatgccgtggggaacgacaccggaaaacacggcaaggaaattaaagtcacacctcagagctctatcaccgaggctgaactgacaggctatgggaccgtgacgatggagtgtagcccccggaccggacttgatttcaatgaaatggttctgctccaaatggagaacaaggcctggctggtgcaccgccagtggtttcttgacctgccgctcccttggctgcccggcgctgatacacaggggagcaattggatccagaaggagaccctggtcacattcaaaaaccctcatgccaagaaacaagacgtggttgtgctcggatcccaggaaggcgccatgcacaccgctctgacgggggcgacagagattcagatgtctagcggcaatcttctgtttaccggacatctcaagtgcagactgcggatggacaaacttcaactgaagggcatgtcctacagcatgtgtacagggaagttcaaagtcgtgaaggaaatcgccgagacccagcacggaaccattgtcatcagagtgcagtatgagggcgatgggtctccctgcaaaattcccttcgaaatcatggacctcgagaagcgctacgttctgggacggctgatcacagtgaaccctattgtcacggaaaaagattccccggtgaacatcgaggctgaacccccttttggcgacagctacattatcattggggttgagcccggccagctcaagctgaattggttcaagaaaggatctagcatcggccaaatgtttgagaccacaatgagaggggccaagcgcatggccattcttggagataccgcttgggacttcggctccctcgggggagtgtttacatctatcggcaaagccctccatcaggtcttcggggcgatctatggcgctgcctttagcggagtgtcctggaccatgaagattctgatcggcgtgattatcacgtggattgggatgaacagccggtctacatccctgagcgtttctcttgtcctcgtgggaatcgtgaccctgtacctgggcgtcatggtgcaggccgattccgggtgtgttgtgagctggaaaaataaggaactcaagtgcggatccggcatcttcattaccgacaacgtccacacatggaccgagcagtataaatttcaacctgaatctcccagcaagctggcttccgccatccagaaagctcaggaggaagggatttgtggcatcagatctgtgacacgccttgagaatctgatgtggaagcagattacgccggagctcaaccacatcctggccgaaaatgaggttaaactgaccatcatgacaggagatgtgaagggcattatgcaagcggggaaacggagccttagacctcagcccaccgaactcaagtactcctggaagacatggggaaaagccaagatgctgagcaccgagtctcataaccagacgttcctgatcgacggccctgaaaccgctgagtgccccaatacaaaccgcgcctggaactccctcgaggtcgaagattatgggtttggagtgttcaccacaaacatttggctgaaacttaaggagaaacaggacgctttttgtgacagcaagctgatgtctgccgcgatcaaggataatcgggccgttcacgctgacatgggctactggattgaatccgccctcaacgatacctggaaaatcgagaaggctagcttcatcgaggtgaaaaattgccattggcctaagtctcacacactgtggagcaacggcgtcctggaatccgagatgattatccccaaaaaccttgccgggccggtgagccaacacaattatagacctggataccatacccagattgccggcccctggcacctcgggaagctggaaatggacttcgatttttgtgagggaacgacagtggtcgttaccgaagactgcggcaaccgcgggccctctctgcggaccacaaccgcttccggaaagctcatcacggagtggtgctgtagaagctgcacactgcctccgcttcggtaccgcggcgaggatggctgttggtatgggatggaaattagacccctgaaagagaaggaagagaatctcgtgaactccctggtgaccgcgggacatggccaggtcgacaatttctctctgggggtgcttggaatggccctctttctggaagagatgctgcggacaagagttggcaccaaacacgctatcctcctggtggccgtcagcttcatgacacttattaccgggaacatgtcctttaaggatctgggacgcgtggttgtgatggtcggcgccgctatgacggacgatatcggcatgggggtgacctacctcgccctgctggcggctttcaaagttcggcctacatttgccgccggacttctgctcagaaagctgacctctaaggagctcatgatgacaaccatcggcattgctctgcttagccaatccacgatccccgaaacaattctggagctcaccgacgccctggcgctggggatgatggtgcttaaaatggtccgcaatatggaaaagtatcagctggctgtgacaatcatggccattctctgcgtgcctaacgccgtcatcctgcagaatgcttggaaagtttcttgtaccatcctcgccgtggtgagcgtcagccccctgcttctgaccagctctcagcaaaagacagattggattcctctcgctctgacgatcaaaggactgaaccccaccgccattttccttacaaccctgtccagaacaagcaagaaacggtcttggccgctcaatgaggcgatcatggccgtgggcatggtttccattctggctagctctctcctgaagaacgacatccctatgaccgggccccttgtggccggaggcctgctgacggtctgctacgtgctcacaggccgctccgctgacctggaacttgagagagccaccgatgttaagtgggaggaccaggccgaaatcagcgggtccagccctattctgtctatcaccattagcgaggatggatccatgtctatcaaaaatgaagaggaggaacagacactcaccattctgatccggacaggcctcctggtgattagcgggctttttcccgtctccatcccgatcacggctgcggcctggtatctgtgggaggtgaagaaacagcgcgctggagtcctgtgggacgtgccttctccccctcccatgggcaaggccgaactcgaggatggggcctacagaattaaacaaaagggaatcctgggctatagccagattggcgctggggtttacaaggaaggaaccttccatacaatgtggcacgtgacccggggcgccgtccttatgcacaaagggaagcgcatcgagccctcctgggcggacgtgaaaaaggatctgatttcttacggaggcgggtggaaactcgagggagaatggaaggagggcgaagaggttcaggtgctggctctcgaacctggcaagaacccgagagccgtccagacaaaacccgggctgtttaagaccaatgccggaacgatcggcgctgtgagccttgacttctcccctgggaccagcggatctcccatcattgataaaaagggcaaagtggttgggctgtatggaaacggcgtcgtgacacggtccggcgcctacgtgagcgcgatcgctcaaaccgagaagtctattgaggacaaccctgaaatcgaggatgacatttttcgcaagagacggctgacaatcatggatctccatcccggggccggaaaaaccaagagatatctgcctgccatcgtccgcgaagctattaaacggggccttagaacactgatcctcgccccgacgcgcgtggttgctgccgagatggaagaggcgctgcgggggctccccattagataccagacccctgccatccgcgctgagcacacaggacgggaaattgtggacctgatgtgtcatgccaccttcaccatgagacttctgtcccccgtccgcgtgcctaattataacctgatcattatggacgaggctcacttcacagatcccgccagcatcgccgctcggggctacatctccacgagagttgaaatgggggaggcggccggcatttttatgaccgctacaccgcctggatctcgggaccccttcccccagagcaatgcccctatcattgatgaggaacgcgagatccccgaaagatcctggaacagcggccatgagtgggtgaccgactttaaggggaaaacagtctggttcgtgccttctattaaggccggaaatgatatcgctgcctgcctccggaagaacggcaaaaaggttatccaactgtcccgcaaaacctttgacagcgaatatgtgaagacgagaacaaatgattgggacttcgtcgtgaccaccgatatttctgagatgggggcgaactttaaagctgagcgggtgatcgacccgagacgctgtatgaagcccgtcattcttacagatggagaggaacgggttatcctggccggccctatgcccgtgacccacagctccgccgctcagagacgcgggcggattggcagaaatcctaaaaacgaaaatgaccagtacatctacatgggagagcccctcgaaaacgacgaggattgcgcccactggaaggaggcgaagatgctgctggacaatatcaacacaccggaaggcattatcccttctatgttcgagcccgaacgcgagaaagtggatgccattgacggggaatatcggctcagaggagaggctcgcaagacctttgtcgatcttatgagacggggcgacctgcctgtgtggctggcctacaaagttgctgccgaggggatcaattatgctgatcgcagatggtgtttcgacggaattaagaacaaccagatcctcgaagagaatgtggaagtcgagatttggacgaaagagggcgaacggaagaagctgaaaccccgctggcttgatgccagaatctacagcgaccctctggcgctcaaggagtttaaagagttcgccgctgggcggaagtccctgacactgaacctcatcaccgagatgggcagacttcccacattcatgacccagaagacgcgcgatgccctggacaatctggctgtgctccataccgccgaagccggaggccgggcttataaccacgcgctgtctgagcttccggagacactggaaaccctcctgctgctcacacttctggccaccgttacagggggaatttttctgttcctcatgagcggcagagggatcggaaagatgaccctgggcatgtgctgcattatcacggcttccattcttctgtggtacgcccagatccagcctcattggatcgccgctagcattatcctcgagtttttcctgattgtgctgctcatccccgaacccgagaagcagcgcacacctcaagataatcagcttacctatgtcgtgattgccatcctgaccgtcgtggcggccacaatggctaacgaaatgggctttctggagaaaaccaagaaagacctcgggctgggatctatcgttacacagcagccggagtccaatattcttgacatcgatctgcggcccgccagcgcttggacgctctacgccgtggcgaccacattcgtgacccctatgctgagacactccattgaaaactctagcgtcaatgtttccctgacagccatcgctaaccaagccaccgtgctcatgggccttgggaagggatggcccctgtctaaaatggacattggcgtgcctctgctcgctatcgggtgttacagccaggtcaatcccattacgctgaccgccgcccttctgctcctggtggcccactatgcgatcatcggacctggcctgcaggccaaggctacacgggaggcccagaagcgcgctgccgccggcattatgaaaaacccgaccgttgatgggatcacagtgattgacctcgatcccatcccttacgaccccaagtttgaaaaacaacttggacaggtcatgctgctggtgctctgcgtcacccaggtgctgatgatgagaacgacatgggcgctttgtgaggctctgaccctcgccacaggccctatttccaccctgtgggaagggaatcccggacggttctggaacaccacaatcgctgttagcatggccaatatctttcgcggctcttatctggccggggctggactccttttctccattatgaagaacacgaccaatacaagacggggcaccggcaacatcggggagacactgggagagaaatggaagtcccgcctgaacgccctcggcaaatctgaatttcaaatttacaagaagtccgggatccaggaggtggatagaaccctggcgaaagaaggaattaagcggggcgagacggaccatcacgccgtcagccgcgggtctgctaaacttagatggttcgtggagcggaatatggttacaccggaaggaaaggtggtcgatctgggctgcggcagagggggatggagctattactgtggcgggctcaaaaacgtgcgcgaggtgaagggactgaccaagggcgggcctggacatgaagaacccatccccatgtccacctatggctggaatctggttcggctccagtctggcgtcgacgtgtttttcatccctcccgaaaaatgcgatacacttctgtgtgacattggggagagctcccctaacccgaccgtggaggccggaagaacactgcgcgtcctcaatctggttgaaaactggcttaataacaatacgcagttctgcatcaaggtgctgaacccctacatgcctagcgtgattgagaaaatggaagctctccaacggaagtacggcggggccctggtcagaaatcccctgtcccgcaactctacccacgagatgtattgggtgagcaatgcgtccggaaacatcgtttctagcgtgaatatgatttcccggatgctcatcaacagatttacaatgcgccataaaaaggccacctacgaacctgatgtcgaccttggctctgggacacggaacatcggaattgagagcgagatccccaatctggacattatcggcaagagaattgagaaaatcaagcaggagcacgaaacctcctggcactatgatcaggaccatccgtacaaaacgtgggcttatcacggcagctacgagaccaagcagacagggtctgcctccagcatggtgaacggagttgtgcgcctgctcaccaaaccttgggatgtcctgcccacagtgacccaaatggctatgacagacaccacgcctttcggccagcagcgggtgtttaaggaaaaggtcgatacaagaacccaggagcccaaagaggggaccaagaaacttatgaagattacagccgaatggctgtggaaagagctcggaaagaaaaagacgcctcgcatgtgtaccagagaagagttcacacggaaggttcgctctaatgctgccctgggcgcggtgtttaccgacgagaacaaatggaagtccgccagagaagctgtggaggatagccggttctgggaactggtcgacaaagagagatctctccatctggaagggaagtgcgagacatgtgtgtataatatgatgggaaaacgggagaagaaacttggcgaatttggcaaagccaaggggtcccgcgctatctggtacatgtggctgggagccagattcctcgagtttgaagccctgggcttccttaacgaggatcactggtttagccgggaaaattccctgagcggggttgagggagagggcctccacaaactggggtacatcctgcgcgacgtgtctaagaaagaaggcggagcgatgtatgctgatgacaccgccggctgggacacaagaattaccctcgaggatctgaagaacgaagagatggtcacgaatcatatggaaggggagcacaagaaacttgccgaggctatcttcaagctgacctaccaaaacaaagtggttcgggtgcagcgccccacaccgagaggaaccgtcatggacattatcagccggcgcgatcagagaggctccgggcaagtgggaacatatggcctcaatacctttacgaacatggaagcccagctgattcggcagatggagggggaaggcgttttcaagaatatccagcatcttacagtgaccgaggagatcgctgtccaaaactggctggcccgcgtgggaagagaacggctctctcgcatggcgattagcggcgacgattgcgtcgtgaaacctctggacgatagattcgcctccgctctgacagccctcaatgacatggggaagatccggaaggatattcagcagtgggagccctctagaggatggaacgactggacccaggttcccttttgcagccaccatttccacgaactgatcatgaaagatggccgcgtgcttgtcgtgccttgtcggaaccaagacgagctgattgggagagctcgcatctcccagggagccggctggtctctccgggaaacggcgtgcctggggaagtcctacgcccagatgtggtcccttatgtattttcacagacgcgatctgcggctcgctgccaatgctatctgtagcgccgtgccgtctcattgggttcccacctccagaacaacctggagcattcacgctaaacatgagtggatgacaaccgaggacatgctgacagtgtggaaccgcgtctggatccaggaaaatccttggatggaggacaagacccccgtggaatcttgggaggaaattccttacctgggcaaacgggaggatcaatggtgcggatccctcatcggcctgacgagcagagccacatgggcgaagaacattcaggccgctatcaatcaggttcgctcccttattgggaacgaggaatataccgactacatgccctctatgaagcggttcagacgggaggaagaggaagccggagtgctgtggtga

SEQ ID NO: 19863 - RNA, 9876 nt, synthetic construct
  misc_feature 1..9876: note = derived and/or modified CDS sequence (opt5) from DENV-2__EU687246__SS-prME
  source 1..9876: mol_type = other RNA
tccgccggaatgatcattatgctgatccccaccgtgatggctttccacctgacgacgcggaatggggagcctcatatgattgtctccatccaggaaaagggaaaatctctgctttttaagaccgaggacggcgttaatatgtgcacactgatggccatggatctcggggaactgtgtgaggacaccattacatacaaatgcccgcttctgcggcaaaatgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgtcctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaggaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcaaaatccccttcgaaatcatggacctcgagaagagatacgttctgggacgcctgattacggtgaaccctatcgtcaccgaaaaagattccccggtgaacattgaggccgaacccccttttggcgacagctacatcattatcggggttgagcccggccagctcaagctgaattggttcaagaaaggatctagcattggccaaatgtttgagacaaccatgagaggggctaagagaatggccatccttggagatacagcctgggacttcggctccctcgggggagtgtttacctctatcggcaaagctctccatcaggtcttcggggccatttatggcgcggcttttagcggagtgtcctggacgatgaagatcctgattggcgtgatcattacatggatcgggatgaacagccgctctacctccctgagcgtttctcttgtcctcgtgggaatcgtgaccctgtacctgggcgtcatggtgcaggccgattccgggtgtgttgtgagctggaaaaataaggaactcaagtgcggatccggcattttcatcacagacaacgtccacacctggacagagcagtataaatttcaacctgaatctcccagcaagctggcctccgctattcagaaagcccaggaggaagggatctgtggcattcggtctgtgacgagacttgagaatctgatgtggaagcagatcaccccggagctcaaccacatcctggctgaaaatgaggttaaactgacaattatgaccggagatatcaagggcattatgcaagccgggaaacgcagccttcggcctcagcccacagaactcaagtactcctggaagacctggggaaaagcgaagatgctgagcacggagtctcataaccagaccttcctgatcgacggccctgaaacagccgagtgccccaataccaacagagcttggaactccctcgaggtggaagattatgggtttggagtcttcacaaccaacatttggctgaaacttaaggagaaacaggacgccttttgtgacagcaagctgatgtctgctgccatcaaggataatcgcgcggtgcacgccgacatgggctactggatcgaatccgctctcaacgatacatggaaaattgagaaggccagcttcatcgaggttaaaaattgccattggcctaagtctcacaccctgtggagcaacggcgtgctggaatccgagatgattatccccaaaaaccttgctgggccggtcagccaacacaattatcggcctggataccatacgcagattgccggcccctggcacctcgggaagctggaaatggacttcgatttttgtgacggaacaaccgtggtggtcaccgaggattgcggcaacagagggccctctctgcgcacaaccacggcctccggaaagctcatcacagaatggtgctgtcggagctgcaccctgcctccgcttagataccggggcgaggacggctgttggtatgggatggagattcgccccctgaaagaaaaggaggaaaatctcgttaactccctggtgacagctggacatggccaggtggataatttctctctgggggtccttggaatggcgctctttctggaggaaatgctgagaacccgggtgggcacaaaacacgccatcctcctggttgctcttagcttcgtgaccctgatcacggggaacatgtcctttaaggacctcggaagagtcgtggttatggtgggcgccaccatgacagatgacattggcatgggggtcacctacctggccctgcttgctgccttcaaagtgcgccctacatttgcggctggactgctcctgcggaagctcacctctaaggagctgatgatgacgacaatcggcattgttcttctgagccaatccaatatccccgagaccattctcgaactgacagatgccctggcccttgggatgatggtgctgaaaatcgtcagagacatggagaagtatcagctcgctgtgaccatcatggccattctgtgcgtgcctaacgcggtcatcctccagaatgcttggaaagtttcttgtaccattctggccgtggtgagcgtcagcccccttctgctcacaagctctcagcaaaagacggactggatccctctggccctgaccattaaaggacttaaccccacagctatcttcctgaccacactctcccgcaccaataagaaaagaagctggccgctgaacgaagccatcatggctgtgggcatggtttctattctcgcctccagcctgcttaagaatgatatccctatgacggggcccctggtggcgggaggcctgctcacagtctgctacgtgctgaccggccggtctgccgaccttgagctggaacgcgctaccgatgttaagtgggaggaccaggccgagatttccgggagctcccctatcctcagcattacaatctctgaagatggaagcatgtccattaaaaacgaggaagaggagcagaccctgacaatcctcatcagaacgggcctgcttgtgatttctgggctgtttcccgtcagcatcccgattaccgctgccgcctggtatctgtgggaagtgaagaaacagcgggctggagtcctctgggacgtgccttctccccctcccatgggcaaggcggagctggaagatggggcctaccgcatcaaacaaaagggcattcttggctatagccagatcggcgctggggtttacaaggagggaacattccataccatgtggcacgtgacaagaggcgccgtcctgatgcacaaagggaagcggatcgaacccagctgggccgacgtgaaaaaggatctcatttcctacggaggcgggtggaaactggagggagagtggaaggaaggcgaggaagttcaggtgctcgctctggagcctggcaagaatccgcgcgccgtccagaccaaacccgggctttttaagacgaacaccggaacaatcggcgcggtgtctctggacttcagccctgggacctccggaagccccattatcgataaaaagggcaaagtggttgggctgtatggaaacggcgtcgtgacaagatctggcgcttacgtgtccgccattgcccaaaccgaaaagagcatcgaggacaatcctgatatcgaggacgacatttttcggaagcgcagactcacaatcatggatctgcatcccggggctggaaaaacgaagcggtatcttcctgccattgtcagagaagcgatcaaacgcggcctgcggaccctcattctggctccgacaagagtggttgccgccgagatggaagaggctctccgcgggctgcccatccggtaccagacccctgccattagagctgaacacaccggacgcgagatcgtggaccttatgtgtcatgccacattcacgatgcggctgctgtctcccgtcagagtgcctaactataatctcatcattatggatgaggcgcacttcaccgaccccgcctccatcgctgcccgcggctacattagcacacgggttgaaatgggggaggctgccggcatctttatgaccgccacaccgcctggatccagagatcccttcccccagtctaacgctcctattatcgacgaggaacgggagatccccgaacgcagctggaactccggccatgagtgggtgaccgattttaaggggaaaacggtctggttcgtgcctagcattaaggcgggaaacgacatcgccgcttgcctgagaaagaatggcaaaaaggttattcaactttctcggaaaacatttgattccgaatatatcaagacccgcaccaacgactgggatttcgtggtcacaaccgacattagcgagatgggggccaattttaaagccgaaagagtgatcgacccgcggagatgtatgaagcccgtgatcctgacagatggagaggagcgcgtcattctcgctggccctatgcccgttacccactctagcgccgcgcagcggagagggcgcatcggccggaaccctaaaaatgaaaacgaccagtacatttacatgggagagcccctggaaaatgatgaggactgcgctcactggaaggaagccaagatgctgctcgataacatcaatacgccggagggcattatcccttccatgttcgagcccgaaagagagaaagtggacgccattgatggggaatatcgccttcggggagaggctagaaagacatttgtggacctgatgcgcagaggcgatctgcctgtctggctcgcctacaaagtggcggccgaagggatcaactatgctgaccggcgctggtgtttcgatggaatcaagaacaatcagattctggaggagaacgttgaagtggagatctggaccaaagaaggcgagagaaagaaacttaaaccccggtggctggacgcccgcatttactctgatcctctcgctctgaaggagtttaaagagttcgccgctgggagaaagagcctgacactcaatcttatcaccgagatgggccggctgcccacgttcatgacccagaagaccagagacgccctggacaacctcgcggtcctgcataccgccgaagctggaggccgcgcctataatcacgctctttccgagctgccggaaacactcgagaccctgctgctccttacactgctggccaccgtgacagggggaatttttctcttcctgatgtctggccgggggatcggaaagatgacacttggcatgtgctgcatcattaccgccagcatcctgctctggtacgctcagattcagcctcattggatcgcggcctccattatcctggagtttttcctgatcgttctccttattcccgaacccgagaagcagagaacccctcaagataaccagctgacatatgtggtcatcgctattctgaccgtggtcgccgccacaatggctaatgaaatgggctttctcgagaaaacgaagaaagacctggggcttggaagcatcgccacccagcagccggaatctaacattctggatatcgacctccgccccgcgtccgcctggacactgtacgctgtggccaccacattcattacccctatgctgcggcacagcatcgaaaattcctctgttaacgtgagcctcacggctatcgccaatcaagcgaccgtgcttatgggcctggggaagggatggcccctgtccaaaatggatattggcgtccctctcctggccatcgggtgttactctcaggttaaccccattacacttaccgctgccctgctcctgctgatcgctcactatgccattatcggacctggcctccaggctaaggccacaagagaggcgcagaagcgggccgctgccggcatcatgaaaaatccgaccgtggacgggattacggtgatcgatcttgaccccattccttacgatcccaagtttgaaaaacaactgggacaggtcatgctgctcgtgctgtgcgttacacaggtgcttatgatgcgcaccacatgggctctgtgtgaggccctcaccctggccaccggccctatcagcacactgtgggaagggaaccccggaagattctggaatacgaccattgcggtctccatggctaacatctttcggggcagctatctcgccggggctggacttctgttctctatcatgaagaatacaaccaacacacgcagaggcaccggcaacattggggagacgctgggagaaaaatggaagtcccggctcaatgccctgggcaaaagcgagtttcaaatctacaagaagtctgggattcaggaggtggaccgcacacttgccaaagaaggaatcaagagaggcgagaccgatcatcacgctgtctcccgggggagcgccaaactgcgctggttcgtggaaagaaacatggttaccccggagggaaaggtggtcgacctcggctgcggcagagggggatggtcttattactgtggcgggctgaaaaatgtgcgggaggttaagggactgacaaagggcgggcctggacatgaggaacccattcccatgagcacctatggctggaacctcgtgcgccttcagtccggcgtcgatgtgtttttcatccctcccgaaaaatgcgacacactgctgtgtgacatcggggagtctagccctaatccgacggtggaagcgggacggaccctcagagttctgaaccttgtcgagaattggctgaacaataacacacagttctgcattaaggtgctcaatccctacatgccttccgtgatcgagaaaatggaaaccctgcaacgcaagtacggcggggccctggtccggaaccccctcagcagaaattccacacacgagatgtattgggtttctaacgctagcggaaatattgtgtcctctgtgaacatgatcagccgcatgcttattaaccggtttaccatgagacataaaaaggccacgtacgaacctgatgtcgacctgggctccgggacccgcaatatcggaattgagtctgaaatccccaacctggatatcattggcaagcggatcgagaaaattaagcaggagcacgaaacaagctggcactatgaccaggatcatccgtacaaaacctgggcttatcacggctcctacgagacaaagcagaccgggagcgcctcttccatggtgaatggagttgtgagactcctgacaaaaccttgggacgtccttcccaccgtgacgcaaatggcgatgacagataccacccctttcggccagcagcgcgtttttaaggaaaaggtggacacacggacgcaggagcccaaagaagggaccaagaaactgatgaagatcacagccgagtggctctggaaagagctgggaaagaaaaagacccctagaatgtgtacacgcgaagagttcaccagaaaggtccggagcaacgctgccctgggcgctatttttacagatgaaaataaatggaagtctgcccgcgaggctgtggaggactccagattctgggaactcgtggataaagagcggaacctgcatcttgaagggaagtgcgagacctgtgtctataatatgatgggaaaaagagaaaagaagctgggcgagtttggcaaagccaaggggagccgggcgatctggtacatgtggctcggagcccgcttcctggagtttgaagctcttggcttcctgaacgaggaccactggttttctagagaaaattccctcagcggggttgagggagaaggcctgcacaaactggggtacatcctccgggacgtgtccaagaaagagggcggagccatgtatgctgatgacacggccggctgggatacccgcattacactggaggaccttaagaacgaagagatggtgaccaatcatatggaaggggagcacaagaaactggccgaagcgatcttcaagctcacataccaaaacaaagtcgtgagagttcagcggcccaccccgcgcggaacggtgatggatattatcagcagacgggaccagcgcggctctgggcaagtcggaacatatggcctgaatacctttacaaacatggaggctcagcttattagacagatggagggggaaggcgtgttcaagaatatccagcatctgaccgttacggaggaaatcgccgtgcaaaactggctcgcccgggtcggacgcgagagactgagccggatggctatttccggcgatgactgcgtggttaaacctctggatgaccgcttcgcctctgctctcaccgccctgaacgatatggggaagatcagaaaggacattcagcagtgggagcccagccggggatggaatgattggacacaggtgcccttttgctcccaccatttccacgaacttatcatgaaagacggcagagtcctggtggtcccttgtcgcaaccaagacgagctcattgggcgggcgagaatctctcagggagccggctggagcctgcgcgaaaccgcttgccttgggaagtcctacgcccagatgtggtctctgatgtattttcaccggagagatctccgcctggctgccaatgcgatttgtagcgccgtgccgtcccattgggttcccacaagccggaccacatggtctatccacgctaaacatgagtggatgaccacggaagacatgctgacagtgtggaacagagtctggatccaggagaatccttggatggaggataagacccccgtggaatcctgggaggaaattccttacctcggcaaacgcgaggaccaatggtgcggaagcctgatcggccttacctctcgggccacatgggctaagaacattcaggccgctatcaatcaggtgagatccctgattgggagcgaagagtataccgattacatgccctccatgaagcgcttccggagagaggaagaggaagccggagttctctggtga

SEQ ID NO: 19864 - RNA, 9876 nt, synthetic construct
  misc_feature 1..9876: note = derived and/or modified CDS sequence (opt5) from DENV-2__FJ639828__SS-prME
  source 1..9876: mol_type = other RNA
agcgtgggaatgatcattatgctgatccccaccgtcatggccttccacctgacgacgcggaatggggagcctcatatgattgtttccatccaggaaaagggaaagtctctgctttttaagaccgaggacggcgtgaatatgtgcacactgatggctatggatcttggggaactgtgtgaggacaccattacatacaaatgcccgcttctgcggcaaaacgaacccgaggatatcgactgttggtgcaattccacctccacatgggtgacctatggaacgtgtaccacaaccggcgagcaccgcagagaaaagcggtctgtcgccctcgtgcctcatgttgggatgggactggagacacgcaccgaaacgtggatgagctccgagggcgcgtggaaacacgctcagagaatcgagacatggattctgcggcatcccggcttcaccatcatggccgccattctcgcttacacaatcgggaccacccactttcagcgcacactgattttcatccttctgacggccgtggctccttctatgaccatgagatgcattggaatcagcaaccgggattttgtcgaaggcgtgtccgggggaagctgggttgacatcgtgctcgagcacggctcttgtgtcacaaccatggccaagaataagcccacactggatttcgaacttattaaaaccgaggcgaagcagcctgccacgctgcgcaaatattgcatcgaagctaagctcacaaacaccaccacagagtccagatgtccgacccaaggggagcccagcctgaaagaagaacaggacaagcggtttgtgtgcaagcattctatggtggatcgcggatggggcaatggctgtgggctgttcggaaaaggcgggattgtcacatgcgccatgtttacgtgcaagaaaaacatggaaggaaagatcgttcagcctgagaatctcgaatacaccattgtggtgacaccccactccggcgaggagcatgctgtcgggaacgacaccggaaaacacggcaaggaaatcaaagtgacacctcagagctctatcaccgaggccgaactgacgggctatgggaccgttacaatggagtgttcccccagaaccggacttgatttcaatgaaatggtgctgctccaaatggagaacaaggcgtggctggtccaccggcagtggtttcttgacctgccgctcccttggctgcccggcgccgatacacaggggagcaattggattcagaaggagaccctggtgacgttcaaaaaccctcatgctaagaaacaagacgttgtggtcctcggatcccaggaaggcgccatgcacacagctctgaccggggccacagagatccagatgtctagcggcaatcttctgtttaccggacatctcaagtgccgcctgagaatggacaaacttcaactgaagggcatgtcctacagcatgtgtaccgggaagttcaaagtggtcaaggaaattgccgagacacagcacggaacgatcgtgattcgggttcagtatgagggcgatgggtctccctgcaaaatccccttcgaaatcatggacctcgagaagagatacgtgctgggacgcctgattaccgtcaaccctatcgctacagaaaaagattccccggtgaacattgaggcggaacccccttttggcgacagctacatcattatcggggttgagcccggccagctcaagctgaattggttcaagaaaggatctagcattggccaaatgtttgagaccacaatgagaggggccaagagaatggctatccttggagataccgcctgggacttcggctccctcgggggagtgtttacgtctatcggcaaagccctccatcaggtcttcggggctatttatggcgccgcgtttagcggagtgtcctggacaatgaagatcctgattggcgtgatcattacctggatcgggatgaacagccgctctacctccctgagcgtttctcttgtcctcgtgggagtggtcacactgtacctgggcgtgatggttcaggctgattccgggtgtgtggtcagctggaaaaataaggaactcaagtgcggatccggcatcttcattaccgacaacgtgcacacatggacggagcagtataaatttcaacctgaatctcccagcaagctggcctccgccatccagaaagctcaggaggaagggatttgtggcatccggtctgttaccagacttgagaatctgatgtggaagcagattacaccggagctcaaccacatcctggccgaaaatgaggtgaaactgaccatcatgacaggagatattaagggcatcatgcaagctgggaaacgcagccttcggcctcagcccaccgaactcaagtactcctggaagacgtggggaaaagccaagatgctgagcaccgagtctcataaccagacattcctgattgacggccctgaaaccgcggagtgccccaatacaaacagagcctggaactccctcgaggtcgaagattatgggtttggagtgttcaccacaaacatctggctgaaacttaaggagaaacaggacgctttttgtgacagcaagctgatgtctgccgctattaaggataatcgcgccgttcacgcggacatgggctactggatcgaatccgccctcaacgatacctggaaaatcgagaaggctagcttcattgaggtgaaaaattgccattggcctaagtctcacacgctgtggagcaacggcgtcctggaatccgagatgatcattcccaaaaaccttgccgggccggtgagccaacacaattatcggcctggataccatacacagatcgctggcccctggcacctcgggaagctggaaatggacttcgatttttgtgacggaaccaccgtggtcgttacagaggattgcggcaacagagggccctctctgcgcaccacgacagcctccggaaagctcattaccgaatggtgctgtcggagctgcacactgcctccgcttagataccggggcgaggacggctgttggtatgggatggagatccgccccctgaaagaaaaggaggaaaatctcgtgaactccctggtgaccgccggacatggccaggtcgataatttctctctgggggtgcttggaatggctctctttctggaggaaatgctgagaacacgggttggcaccaaacacgcgattctcctggtggccgtcagcttcgtgacgcttatcaccgggaacatgtcctttaaggacctgggaagagttgtggtcatggtgggcgctacaatgaccgatgacatcggcatgggggttacatacctcgccctgctggccgctttcaaagtgcgccctacctttgccgcgggacttttcctgcggaagctcacgtctaaggagctgatgatgacaaccattggcatcgtcctcctgagccaatccacacttcccgagaccattctggaactcaccgatgctctggccctggggatgatggtgcttaaaatggtgagagacatggagaagtatcagctggccgtcacaatcatggctattctctgcgttcctaatgccgtgatcctgcagaacgcgtggaaagtgtcttgtacgatcctcgctgtcgtgagcgttagccccctgcttctgaccagctctcagcaaaagacagactggattcctctcgccctgaccatcaaaggactgaatcccacagccatttttcttaccacgctgtcccgcacaaacaagaaaagaagctggccgctcaatgaagctatcatggccgtgggcatggtctctattctggcttccagcctcctgaagaacgatatccctatgaccgggccccttgtggccggaggcctgctgaccgtttgctacgtgctcacaggccggtctgcggacctggagcttgaacgcgccaccgatgtcaagtgggaggaccaggctgagatctccgggagctcccctattctgagcatcacaatttctgaagatggaagcatgtccatcaaaaatgaggaagaggagcagacgctcaccattctgatcagaacaggcctcctggtgatttctgggcttttccccgtcagcatcccgatcaccgccgctgcctggtatctgtgggaagtgaagaaacagcgggccggagttctgtgggacgtgccttctccccctcccatgggcaaggctgagctcgaagatggggcgtaccgcattaaacaaagaggaatcctgggctatagccagattggcgccggggtctacaaggagggaacatttcataccatgtggcacgtgacgcggggcgctgttcttacccacaaggggaaacgcatcgaacccagctgggccgacgtgaagaaagatctgatttcctacggaggcgggtggaagctcgagggagagtggaaagaaggcgaggaagtccaggtgctggccctcgagcctggcaagaacccgagagctgtgcagacaaagcccgggctgttcaaaaccaatacaggaaccatcggcgccgtttctcttgactttagccctgggacatccggaagccccatcattgataagaaaggcaaggtcgtggggctgtatggaaacggcgtggtcacgcggtctggcgcgtacgtgtccgctatcgcccaaaccgagaagtccattgaggacaaccctgatatcgaggacgacattttccgcaagagacggctgacaatcatggatctccatcccggggccggaaagaccaaaagatatctgcctgctatcgttcgcgaagccattaagcggggccttagaaccctgatcctcgcgccgacacgcgtggtcgctgccgagatggaagaggccctgcgggggctccccattagataccagacgcctgctatccgcgccgaacacaccggacgggagattgtggacctgatgtgtcatgctacattcaccatgagacttctgtctcccgttcgcgtgcctaattataacctgatcattatggatgaggcccactttacagaccccgcgtccatcgccgctcggggctacatcagcaccagagtcgaaatgggggaggccgctggcattttcatgacggccacaccgcctggatcccgggatccctttccccagtctaatgcccctatcattgacgaagaacgcgagatccccgaaagaagctggaactccggccatgagtgggtgaccgatttcaaagggaagaccgtttggtttgtgcctagcattaaagctggaaatgacatcgcggcctgcctccggaagaacggcaagaaagtcatccaactgtctcgcaagacattcgattccgaatatgtgaaaaccagaacaaatgactgggattttgtggtcaccacggacattagcgagatgggggctaacttcaaggccgaacgggttatcgacccgagacgctgtatgaaacccgtgattcttacagatggagaggagcgggtgatcctggccggccctatgcccgtcacccactctagcgctgcccagagacgcgggcggattggcagaaatcctaagaacgaaaatgaccagtacatctacatgggagagcccctcgaaaacgatgaggactgcgcgcactggaaagaagctaagatgctgctggataatatcaacacaccggagggcattatcccttccatgtttgagcccgaacgcgagaaggtggacgccattgatggggaatatcggctcagaggagaggcccgcaaaaccttcgttgaccttatgagacggggcgatctgcctgtgtggctggcttacaaggtcgccgcggaagggatcaattatgccgaccgcagatggtgttttgatggaattaaaaacaaccagatcctcgaggagaatgtggaagttgagatttggacgaaggaaggcgagcggaaaaagctgaagccccgctggcttgacgctagaatctactctgatcctctggccctcaaagagttcaaggagttcgctgccgggcggaaaagcctgaccctgaacctcatcacagagatgggcagacttcccacctttatgacacaaaagacccgcgacgctctggacaatctggccgtgctccatacagcggaagccggaggccgggcttataaccacgccctgtccgagcttccggaaaccctggagacgctcctgctgctcacacttctggctaccgtcaccgggggaattttcctgtttctcatgtctggcagagggatcggaaaaatgacactgggcatgtgctgcattgtgaccgccagcatccttctgtggtacgcccagattcagcctcattggatcgctgcgtccatcattctcgagttctttctgatcgtcctgctcattcccgaacccgagaagcagcgcacacctcaagataatcagcttacgtatgtggttatcgccattctgaccgtggtggctgccacaatggccaacgaaatgggcttcctggagaagaccaaaaaggacctcgggctgggaagcatcgctacacagcagccggaatctaatatccttgatattgacctgcggcccgcctccgcgtggaccctctacgccgtcgctacgacctttgttacacctatgctgagacacagcatcgagaactcctctgtgaatgtgagcctgaccgccattgctaaccaagccacagtcctcatgggccttgggaaaggatggcccctgtccaagatggatatcggcgcgcctctgctcgccattgggtgttactctcaggtgaatcccatcaccctgacggctgcccttctgctcctggttgctcactatgccattatcggacctggcctgcaggctaaagccacacgggaggcgcagaagcgcgccgctgccggcatcatgaagaacccgaccgtggacgggattacagtcatcgatctcgaccccattccttacgatcccaaattcgaaaagcaacttggacaggtgatgctgctggtcctctgcgtgacccaggttctgatgatgagaaccacatgggctctttgtgaggccctgacgctcgccaccggccctatcagcacactgtgggaagggaatcccggacggttttggaacaccacaattgcggtgtccatggctaatatcttccgcggcagctatctggccggggctggactcctcttttctatcatgaaaaacaccacaaattccagacggggcacaggcaacattggggagaccctgggagaaaagtggaaaagccgcctgaacgccctcggcaagtctgagttccaaatctacaaaaagtccgggattcaggaggtcgacagaaccctggccaaggaaggaatcaaacggggcgagacagatcatcacgctgtgagccgcgggtctgccaaacttagatggtttgttgaacggaatatggtgaccccggagggaaaagtcgtggacctgggctgcggcagagggggatggagctattactgtggcgggctcaagaacgtgcgcgaggttaaaggactgacaaagggcgggcctggacatgaagaacccattcccatgtccacgtatggctggaatctggtccggctccagtctggcgtggatgtgttcttcatccctcccgaaaagtgcgacacccttctgtgtgacatcggggagagctcccctaacccgacagtcgaagcgggaagaaccctgcgcgttctcaatctggtggagaactggcttaataacaatacacagttttgcattaaagtgctgaacccctacatgcctagcgtcatcgagaagatggaaaccctccaacggaaatacggcggggccctggtgagaaatcccctgtcccgcaactctacgcacgagatgtattgggttagcaatgcttccggaaacattgtgtctagcgtcaatatgatctcccggatgctcattaacagattcaccatgcgccataagaaagccacatacgaacctgatgtggaccttggctctgggacccggaacatcggaatcgagagcgaaattcccaatctggatatcattggcaagagaatcgagaagattaaacaggagcacgaaacatcctggcactatgaccaggatcatccgtacaagacctgggcttatcacggcagctacgagacaaaacagaccgggtctgcctccagcatggttaacggagtggtccgcctgctcacgaagccttgggacgtgctgcccacagtgacccaaatggcgatgaccgatacaacgccttttggccagcagcgggtcttcaaagaaaaggttgacaccagaacacaggagcccaaggaagggaccaagaaacttatgaaaatcacagccgagtggctgtggaaagagctcggcaagaagaaaacccctcgcatgtgtacaagagaagagtttacccggaaggtgcgctctaatgctgccctgggcgctattttcacggatgaaaacaagtggaaatccgccagagaggctgtggaggacagccggttttgggaactggtcgataaggagagaaatctccatctggaagggaaatgcgagacctgtgtgtataacatgatgggaaagcgggagaagaaacttggcgagttcggcaaggccaaagggtctcgcgcgatctggtacatgtggctgggagccagatttctcgagttcgaagctctgggctttcttaatgaggaccactggttctcccgggaaaacagcctgtccggggttgagggagaaggcctccaccgcctggggtacatcctgagagacgtgagcaagaaagagggcggagccatgtatgctgatgacacagccggctgggatacccggattacactcgaggacctgaagaatgaagagatggtcaccaaccatatggaaggggagcacaagaaacttgccgaagcgatctttaaactgacgtaccaaaataaagtggttcgcgtgcagagacccacaccgcggggaaccgtcatggatattatctctcgcagagaccagcggggcagcgggcaagtgggaacatatggcctcaacaccttcacgaatatggaggctcagctgattcgccagatggagggggaaggcgttttcaagaacatccagcatcttaccgtgacagaggaaatcgccgtccaaaattggctggccagagtgggacgggagcgcctctccagaatggctatttctggcgatgactgcgtcgtgaaacctctggatgaccggtttgccagcgctctgaccgccctcaacgatatggggaagatcagaaaagacattcagcagtgggagccctcccgcggatggaacgattggacacaggttcccttctgctctcaccattttcacgaactgatcatgaaggacggccgggtgcttgtcgtgccttgtagaaatcaagacgagctgattgggcgcgcgcggatcagccagggagccggctggtccctcagagaaaccgcttgcctggggaagtcttacgcccagatgtggagccttatgtatttccaccgccgggatctgagactcgctgccaacgcgatctgttccgccgtgccgagccattgggttcccacatctcgcaccacgtggtccattcacgctaaacatgagtggatgacaaccgaagacatgctgaccgtgtggaatcgggtctggatccaggagaacccttggatggaggataagacacccgtggaaagctgggaggaaattccttacctgggcaaaagagaggaccaatggtgcggatctctcatcggcctgacctcccgcgccacatgggctaagaatattcaggccgctatcaaccaggttcggagccttattgggaatgaagagtatacggattacatgccctccatgaaaagatttcggagagaggaagaggaagccggagtgctgtggtga

SEQ ID NO: 19865 - RNA, 9876 nt, synthetic construct
  misc_feature 1..9876: note = derived and/or modified CDS sequence (opt5) from DENV-2__FJ639829__SS-prME
  source 1..9876: mol_type = other RNA
agcgtgggaatgatcattatgctgatccccaccgtgatggccttccacctcacgacgcggaatggggagcctcatatgattgtttccatccaggaaaagggaaaatctctgctttttaagaccgaggacggagtgaatatgtgcacactgatggctatggatctcggggaactgtgtgaggacaccattacatacaaatgcccgcttctgcggcaaaacgaacccgaggatatcgactgttggtgcaattccacctccacatgggtgacctatggaacgtgtaccacaaccggcgagcaccgcagagaaaagcggtctgtcgccctcgtgcctcatgttgggatgggactggagacacgcaccgaaacgtggatgagctccgagggcgcgtggaaacacgctcagagaatcgagacatggattctgcggcatcccggcttcaccatcatggccgccattctcgcttacacaatcgggaccacccactttcagcgcacactgattttcatccttctgacggccgtggctccttctatgaccatgagatgcattggaatcagcaaccgggattttgtcgaaggcgtgtccgggggaagctgggttgacatcgtgctcgagcacggctcttgtgtcacaaccatggccaagaataagcccacactggatttcgaacttattaaaaccgaggcgaagcagcctgccacgctgcgcaaatattgcatcgaagctaagctcacaaacaccaccacagagtccagatgtccgacccaaggggagcccagcctgaaagaagaacaggacaagcggtttgtgtgcaagcattctatggtggatcgcggatggggcaatggctgtgggctgttcggaaaaggcgggattgtcacatgcgccatgtttacgtgcaagaaaaacatggaaggaaagatcgttcagcctgagaatctcgaatacaccattgtggtgacaccccactccggcgaggagcatgctgtcgggaacgacaccggaaaacacggcaaggaaatcaaagtgacacctcagagctctatcaccgaggccgaactgacgggctatgggaccgttacaatggagtgttcccccagaaccggacttgatttcaatgaaatggtgctgctccaaatggagaacaaggcgtggctggtccaccggcagtggtttcttgacctgccgctcccttggctgcccggcgccgatacacaggggagcaattggattcagaaggagaccctggtgacgttcaaaaaccctcatgctaagaaacaagacgttgtggtcctcggatcccaggaaggcgccatgcacacagctctgaccggggccacagagatccagatgtctagcggcaatcttctgtttaccggacatctcaagtgccgcctgagaatggacaaacttcaactgaagggcatgtcctacagcatgtgtaccgggaagttcaaagtggtcaaggaaattgccgagacacagcacggaacgatcgtgattcgggttcagtatgagggcgatgggtctccctgcaaaatccccttcgaaatcatggacctcgagaagagatacgtgctgggacgcctgattaccgtcaaccctatcgtgacagaaaaagattccccggttaacattgaggctgaacccccttttggcgacagctacatcattatcggggtggagcccggccagctcaagctgaattggttcaagaaaggatctagcattggccaaatgtttgagaccacaatgagaggggcgaagagaatggccatccttggagataccgcttgggacttcggctccctcggcggggtctttacgtctatcgggaaagccctccatcaggtgttcggggccatttatggcgctgcctttagcggagtgtcctggacaatgaagatcctgattggcgttatcattacctggatcgggatgaacagccgctctacctccctgagcgtctctcttgtgctcgtgggagtcgtgacactgtacctgggcgttatggtgcaggcggattccgggtgtgtcgtgagctggaaaaataaggaactcaagtgcggatccggcatcttcattaccgacaacgttcacacatggacggagcagtataaatttcaacctgaatctcccagcaagctggcttccgccatccagaaagcccaggaggaagggatttgtggcatccggtctgtgaccagacttgagaatctgatgtggaagcagattacaccggagctcaaccacatcctggctgaaaatgaggtcaaactgaccatcatgacaggagatattaagggcatcatgcaagccgggaaacgcagccttcggcctcagcccaccgaactcaagtactcctggaagacgtggggaaaagctaagatgctgagcaccgagtctcataaccagacattcctgattgacggccctgaaaccgccgagtgccccaatacaaacagagcgtggaactccctcgaggtggaagattatgggtttggagttttcaccacaaacatctggctgaaacttaaggagaaacaggacgccttttgtgacagcaagctgatgtctgctgccattaaggataatcgcgctgtgcacgccgacatgggctactggatcgaatccgcgctcaacgatacctggaaaatcgagaaggccagcttcattgaggtcaaaaattgccattggcctaagtctcacacgctgtggagcaacggcgtgctggaatccgagatgatcattcccaaaaaccttgctgggccggtgagccaacacaattatcggcctggataccatacacagatcgccggcccctggcacctcgggaagctggaaatggacttcgatttttgtgacggaaccaccgtcgttgtgacagaggattgcggcaacagagggccctctctgcgcaccacgacagcttccggaaagctcattaccgaatggtgctgtcggagctgcacactgcctccgcttagataccggggcgaggacggctgttggtatgggatggagatccgccccctgaaagaaaaggaggaaaatctcgtgaactccctggtcaccgccggacatggccaggtggataatttctctctgggggttcttggaatggccctctttctggaggaaatgctgagaacacgggtgggcaccaaacacgctattctcctggtcgcggtgagcttcgttacgcttatcaccgggaacatgtcctttaaggacctgggaagagtggtcgtgatggttggcgccacaatgaccgatgacatcggcatgggggtgacatacctcgctctgctggccgccttcaaagtccgccctacctttgctgccggacttttcctgcggaagctcacgtctaaggagctgatgatgacaaccattggcatcgtgctcctgagccaatccacaattcccgagaccatccttgaactgaccgatgcgctcgctctggggatgatggtgctgaaaatggtcagagacatggagaagtatcagcttgccgttacaattatggccatcctgtgcgtgcctaatgctgtgatcctccagaacgcctggaaagtctcttgtacgattctggcggtggttagcgtgagccccctgctgcttaccagctctcagcaaaagacagactggatccctctggctctcaccattaaaggactgaatcccacagccatctttctgaccacgctttcccgcacaaacaagaaaagaagctggccgctgaatgaagccattatggctgtcggcatggtgtctatcctcgcctccagcctgctcaagaacgatatccctatgaccgggcccctggttgctggaggccttctgaccgtgtgctacgtcctgacaggccggtctgccgacctcgagctggaacgcgcgaccgatgtgaagtgggaggaccaggccgagatttccgggagctcccctatccttagcattacaatctctgaagatggaagcatgtccattaaaaatgaggaagaggagcagacgctgaccatcctcattagaacaggcctgctcgtcatctctgggctgttccccgtgagcatcccgattaccgctgccgcttggtatctttgggaagttaagaaacagcgggccggagtgctgtgggacgtcccttctccccctcccatgggcaaggccgagctggaagatggggcttaccgcatcaaacaaagaggcattctcggctatagccagatcggcgcgggggtgtacaaggagggaacatttcataccatgtggcacgttacgcggggcgccgtgctgacccacaaggggaaacgcattgaacccagctgggctgacgtcaagaaagatcttatctcctacggaggcgggtggaagctggagggagagtggaaagaaggcgaggaagtccaggtgctcgccctggagcctggcaagaacccgagagccgttcagacaaagcccggactcttcaaaaccaatacaggaaccatcggcgctgtctctctggactttagccctgggacatccggaagccccattatcgataagaaaggcaaggtggtggggctttatggaaacggcgtcgtgacgcggtctggcgcctacgtttccgcgattgctcaaaccgagaagtccatcgaggacaaccctgatattgaggacgacatcttccgcaagagacggctgacaatcatggatctgcatcccggggccggaaagaccaaaagatatctccctgccattgtgcgcgaagctatcaagcggggcctgagaacccttattctggccccgacacgcgtcgtggcggctgagatggaagaggccctccgggggctgcccatcagataccagacgcctgccattcgcgctgaacacaccggacgggagatcgttgacctcatgtgtcatgccacattcaccatgagactgctttctcccgtgcgcgtccctaattataacctgattatcatggatgaggctcactttacagaccccgcctccatcgcggcccggggctacattagcaccagagtggaaatgggggaggctgccggcatcttcatgacggctacaccgcctggatcccgggatccctttccccagtctaatgcccctattatcgacgaagaacgcgagattcccgaaagaagctggaactccggccatgagtgggttaccgatttcaaagggaagaccgtgtggtttgtccctagcatcaaagccggaaatgacatcgctgcgtgcctgcggaagaacggcaagaaagtgattcaactctctcgcaagacattcgattccgaatatgtgaaaaccagaacaaatgactgggattttgtcgttaccacggacatcagcgagatgggggccaacttcaaggctgaacgggtgattgacccgagacgctgtatgaaacccgtgatcctgacagatggagaggagcgggtcattcttgccggccctatgcccgtgacccactctagcgccgctcagagacgcgggcggatcggcagaaatcctaagaacgaaaatgaccagtacatctacatgggagagcccctggaaaacgatgaggactgcgcccactggaaagaagcgaagatgctcctggataatattaacacaccggagggcatcattccttccatgtttgagcccgaacgcgagaaggttgacgctatcgatggggaatatcggctgagaggagaggcccgcaaaaccttcgtggacctcatgagacggggcgatcttcctgtctggctggcctacaaggtggctgccgaagggattaattatgcggaccgcagatggtgttttgatggaatcaaaaacaaccagattctggaggagaatgttgaagtggagatctggacgaaggaaggcgagcggaaaaagctcaagccccgctggctggacgccagaatctactctgatcctcttgctctgaaagagttcaaggagttcgccgctgggcggaaaagcctcaccctgaacctgattacagagatgggcagactccccacctttatgacacaaaagacccgcgacgcccttgacaatctggctgtcctgcatacagccgaagcgggaggccgggcctataaccacgctctctccgagctgccggaaacccttgagacgctgctcctgctgacactccttgccaccgtgaccgggggaatcttcctgtttctgatgtctggcagagggattggaaaaatgacactcggcatgtgctgcatcgtcaccgctagcattctgctttggtacgcccagatccagcctcattggatcgccgcttccattatcctggagttctttctcattgtgctgctgatccccgaacccgagaagcagcgcacacctcaagataatcagctcacgtatgttgtgattgcgatccttaccgtggtcgccgctacaatggccaacgaaatgggcttcctggagaagaccaaaaaggacctggggctcggaagcatcgccacacagcagccggaatctaatattctggatatcgaccttcggcccgcttccgcctggaccctgtacgcggttgccacgacctttgtgacacctatgctcagacacagcattgagaactcctctgtgaatgtcagcctgaccgctatcgccaaccaagctacagtgctgatgggcctcgggaaaggatggcccctttccaagatggatattggcgcccctctgctggcgatcgggtgttactctcaggttaatcccattaccctcacggccgctctgcttctgctcgtggcccactatgctatcatcggacctggcctgcaggccaaagctacacgggaggcccagaagcgcgcggccgctggcattatgaagaacccgaccgtcgacgggatcacagtgattgatctggaccccatcccttacgatcccaaattcgaaaagcaactcggacaggtcatgcttctggtgctgtgcgttacccaggtgctcatgatgagaaccacatgggccctgtgtgaggctcttacgctggccaccggccctattagcacactctgggaagggaatcccggacggttttggaacaccacaatcgccgtctccatggcgaatatcttccgcggcagctatctggctggggccggactgctcttttctattatgaaaaacaccacaaattccagacggggcacaggcaacatcggggagacccttggagaaaagtggaaaagccgcctgaacgctctgggcaagtctgagttccaaatttacaaaaagtccgggatccaggaggtggacagaaccctcgccaaggaaggaattaaacggggcgagacagatcatcacgccgttagccgcgggtctgctaagctgagatggtttgtggaacggaatatggtcaccccggagggaaaagtggtggaccttggctgcggcagagggggatggagctattactgtggcgggctgaagaacgttcgcgaggtcaaaggactcacaaagggcgggcctggacatgaagaacccatccccatgtccacgtatggctggaatctggtgcggctgcagtctggcgtggatgtcttcttcatccctcccgaaaagtgcgacaccctcctttgtgacattggggagagctcccctaacccgacagttgaagccggaagaaccctgcgcgtgctgaatctcgtggagaactggctgaataacaatacacagttttgcatcaaagtccttaacccctacatgcctagcgtgattgagaagatggaaaccctgcaacggaaatacggcggggcgctcgttagaaatcccctgtcccgcaactctacgcacgagatgtattgggtgagcaatgcctccggaaacatcgtctctagcgtgaatatgatttcccggatgctgatcaacagattcaccatgcgccataagaaagctacatacgaacctgatgttgacctcggctctgggacccggaacatcggaattgagagcgaaatccccaatcttgatattatcggcaagagaattgagaagatcaaacaggagcacgaaacatcctggcactatgaccaggatcatccgtacaagacctgggcctatcacggcagctacgagacaaaacagaccgggtctgcttccagcatggtgaacggagtcgtgcgcctgctgacgaagccttgggacgtgctccccacagtcacccaaatggccatgaccgatacaacgccttttggccagcagcgggttttcaaagaaaaggtggacaccagaacacaggagcccaaggaagggaccaaaaagctgatgaaaattacagcggagtggctttggaaggagctgggcaaaaagaaaacccctcgcatgtgtacaagagaagagtttacccggaaggtgcgctctaatgccgctctcggcgccatcttcacggatgaaaacaagtggaaatccgctagagaggccgtcgaggacagccggttttgggaactggtggataaggagagaaatctgcatctcgaagggaaatgcgagacctgtgtttataacatgatgggaaagcgggagaaaaagctgggcgagttcggcaaggctaaagggtctcgcgccatctggtacatgtggcttggagcgagatttctggagttcgaagccctcggctttctgaatgaggaccactggttctcccgggaaaacagcctttccggggtggagggagaaggcctgcaccgcctcgggtacattctgagagacgtcagcaagaaagagggcggagctatgtatgccgatgacacagctggctgggatacccggatcacactggaggacctcaagaatgaagagatggtgaccaaccatatggaaggggagcacaaaaagctggccgaagccatttttaaacttacgtaccaaaataaagttgtgcgcgtccagagacccacaccgcggggaaccgtgatggatatcatttctcgcagagaccagcggggcagcgggcaagttggaacatatggcctgaacaccttcacgaatatggaggcgcagctcatccgccagatggagggggaaggcgtgttcaagaacatccagcatctgaccgtcacagaggaaattgctgtgcaaaattggcttgccagagtcggacgggagcgcctgtccagaatggccatctctggcgatgactgcgtggttaaacctctcgatgaccggtttgctagcgccctgaccgctctgaacgatatggggaagattagaaaagacatccagcagtgggagccctcccgcggatggaacgattggacacaggtgcccttctgctctcaccattttcacgaactcattatgaaggacggccgggtcctggtggtgccttgtagaaatcaagacgagcttatcgggcgcgcccggatcagccagggagcgggctggtccctgagagaaaccgcctgcctcgggaagtcttacgctcagatgtggagcctgatgtatttccaccgccgggatcttagactggccgctaacgccatttgttccgcggttccgagccattgggtgcccacatctcgcaccacgtggtccatccacgccaaacatgagtggatgacaaccgaagacatgctcaccgtctggaatcgggtgtggattcaggagaacccttggatggaggataagacacccgttgaaagctgggaggaaatcccttacctgggcaaaagagaggaccaatggtgcggatctctgattggcctcacctcccgcgctacatgggccaagaatatccaggtggctattaaccaggtccggagcctgatcgggaatgaagagtatacggattacatgccctccatgaaaagatttcggagagaggaagaggaagccggagtgctttggtga

SEQ ID NO: 19866 - RNA, 9876 nt, synthetic construct
  misc_feature 1..9876: note = derived and/or modified CDS sequence (opt5) from DENV-2__FJ639831__SS-prME
  source 1..9876: mol_type = other RNA
tccgccggcatgatcattatgctgatccccaccgtgatggctttccacctcaccacgcggaatggggagcctcatatgattgtgtccatccaggaaaagggaaaatctctgctttttaagaccgaggacggcgttaatatgtgcacactgatggccatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgtcctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctattgtggatcgcggatggggcaatggctgtgggctgttcggaaaaggcgggatcgtgacctgcgccatgtttacatgcaagaaaaacatggaaggaaagattgtccagcctgagaatctcgaatacacgatcgttgtgacaccccactccggcgaggagcatgcggtggggaacgacacaggaaaacacggcaaggaaatcaaagtcacccctcagagctctgtgacagaggccgaactgaccggctatgggacggttaccatggagtgttcccccagaacaggacttgatttcaatgaaatggtgctgctccaaatggagaacaaggcttggctggtccaccggcagtggtttcttgacctgccgctcccttggctgcccggcgccgatacccaggggagcaattggattcagaaggagacactggtgaccttcaaaaaccctcatgctaagaaacaagacgttgtggtcctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtggtcaaggaaattgcggagacccagcacggaacaatcgtgattcgggttcagtatgagggcgatgggtctccctgcaaaatccccttcgaaatcatggacctcgagaagagatacgtgctgggacgcctgattacggtcaaccctatcgtgaccgaaaaagattccccggttaacattgaggccgaacccccttttggcgacagctacatcattatcggggtggagcccggccagctcaagctgaattggttcaagaaaggatctagcattggccaaatgtttgagacaaccatgagaggggctaagagaatggccatccttggagatacagcctgggacttcggctccctcgggggagtctttacctctatcggcaaagctctccatcaggtgttcggggccatttatggcgcggcttttagcggagtgtcctggacgatgaagatcctgattggcgttatcattacatggatcgggatgaacagccgctctacctccctgagcgtctctcttgtgctcgtgggaatcgtcaccctgtacctgggcgtgatggttcaggccgattccgggtgtgtggtcagctggaaaaataaggaactcaagtgcggatccggcattttcatcacagacaacgtgcacacctggacagagcagtataaatttcaacctgaatctcccagcaagctggcctccgctattcagaaagcccaggaggaagggatctgtggcattcggtctgttacgagacttgagaatctgatgtggaagcagatcaccccggagctcaaccacatcctggctgaaaatgaggtgaaactgacaattatgaccggagatatcaagggcattatgcaagccgggaaacgcagccttcggcctcagcccacagaactcaagtactcctggaagacctggggaaaagcgaagatgctgagcacggagtctcataaccagaccttcctgatcgacggccctgaaacagccgagtgccccaataccaacagagcttggaactccctcgaggtcgaagattatgggtttggagtgttcacaaccaacatttggctgaaacttaaggagaaacaggacgccttttgtgacagcaagctgatgtctgctgccatcaaggataatcgcgcggttcacgccgacatgggctactggatcgaatccgctctcaacgatacatggaaaattgagaaggccagcttcatcgaggtgaaaaattgccattggcctaagtctcacaccctgtggagcaacggcgtcctggaatccgagatgattatccccaaaaaccttgctgggccggtgagccaacacaattatcggcctggataccatacgcagattgccggcccctggcacctcgggaagctggaaatggacttcgatttttgtgacggaacaaccgtggtcgttaccgaggattgcggcaacagagggccctctctgcgcacaaccacggcctccggaaagctcatcacagaatggtgctgtcggagctgcaccctgcctccgcttagataccggggcgaggacggctgttggtatgggatggagattcgccccctgaaagaaaaggaggaaaatctcgtgaactccctggtgacagctggacatggccagatcgataatttctctctgggggtccttggaatggcgctctttctggaggaaatgctgagaacccgggtgggcacaaaacacgccatcctcctggttgctgtgagcttcgtcacccttattacggggaacatgtcctttaaggacctgggaagagtggttgtgatggtcggcgccaccatgacagatgacatcggcatgggggtgacctacctcgccctgctggctgccttcaaagttcgccctacatttgtggcgggacttctgctccggaagctgacctctaaggagctcatgatgacgacaattggcatcgtcctgcttagccaatccaccattcccgagacaatcctggaactcaccgatgctctggccctggggatgatggtgcttaaaatcgtgagagacatggagaagtatcagctggccgtcaccattatggctatcctctgcgttcctaatgccgtgattctgcagaacgcgtggaaagtgtcttgtacaatcctcgctgtcgtgagcgttagccccctgcttctgacgagctctcagcaaaagaccgactggattcctctcgccctgacaatcaaaggactgaatcccaccgccatcttccttacaaccctgtcccgcacgaacaagaaaagaagctggccgctcaatgaagctattatggccgtgggcatggtctctatcctggcttccagcctcctgaagaacgatattcctatgacagggccccttgtggccggaggcctgctgaccgtttgctacgtgctcaccggccggtctgcggacctggagcttgaacgcgccacagatgtcaagtgggaggaccaggctgagatctccgggagctcccctattctgagcatcaccatttctgaagatggaagcatgtccatcaaaaatgaggaagaggagcagacactcacgatcctgattagaaccggcctcctggtgatctctgggctttttcccgtcagcattccgatcacagccgctgcctggtatctgtgggaagtgaagaaacagcgggccggagttctgtgggacgtgccttctccccctcccatgggcaaggctgagctcgaagatggggcgtaccgcattaaacaaaagggagtcctgggctatagccagatcggcgccggggtgtacaaggagggaaccttccatacaatgtggcacgttaccagaggcgctgtgcttatgcacaaagggaagcggatcgaacccagctgggccgacgtcaaaaaggatctgatttcctacggaggcgggtggaaactcgagggagagtggaaggaaggcgaggaagtccaggtgctggccctcgagcctggcaagaacccgcgcgctgttcagacgaaacccgggctgtttaagaccaatacaggaaccatcggcgccgtctctcttgacttcagccctgggacatccggaagccccattatcgataaaaagggcaaagtggtggggctgtatggaaacggcgtcgtgaccagatctggcgcgtacgtttccgctattgcccaaacagaaaagagcatcgaggacaaccctgatatcgaggacgacatttttcggaagcgcagactgacgatcatggatctccatcccggggccggaaaaaccaagcggtatctgcctgctattgtgagagaagccatcaaacgcggccttcggacactgattctcgcgccgaccagagtcgtggctgccgagatggaagaggccctgcgcgggctccccatccggtaccagacccctgctattagagccgaacacacaggacgcgagatcgttgacctgatgtgtcatgctacgttcaccatgcggcttctgtctcccgtgagagtccctaattataacctgatcattatggatgaggcccacttcacagaccccgcgtccatcgccgctcgcggctacattagcacccgggtggaaatgggggaggccgctggcatctttatgacagccaccccgcctggatccagagatcccttcccccagtctaatgcccctattatcgacgaggaacgggagatccccgaacgcagctggaactccggccatgagtgggttacggattttaaggggaaaacagtgtggttcgtccctagcattaaggctggaaatgacatcgcggcctgcctcagaaagaacggcaaaaaggtgattcaactgtctcggaaaacctttgattccgaatatgtgaagacccgcacaaatgactgggatttcgtcgttaccacagacatcagcgagatgggggctaactttaaagccgaaagagtgattgacccgcggagatgtatgaagcccgtgatccttaccgatggagaggagcgcgtcatcctggccggccctatgcccgtgacgcactctagcgctgcccagcggagagggcgcattggccggaatcctaaaaacgaaaatgaccagtacatctacatgggagagcccctcgaaaacgatgaggactgcgcgcactggaaggaagctaagatgctgctggataatattaacacaccggagggcatcattccttccatgttcgagcccgaaagagagaaagttgacgccatcgatggggaatatcgcctccggggagaggccagaaagacctttgtggaccttatgcgcagaggcgatctgcctgtctggctggcttacaaagtggccgcggaagggattaattatgccgaccggcgctggtgtttcgatggaatcaagaacaaccagatcctcgaggagaatgttgaagtggagatttggacaaaagaaggcgagagaaagaagctgaaaccccggtggcttgacgctcgcatctactctgatcctctggccctcaaggagtttaaagagttcgctgccgggagaaagagcctgaccctgaacctcattacggagatgggccggcttcccaccttcatgacacagaaaaccagagacgctctggacaatctggccgtcctccatacagcggaagccggaggccgcgcttataaccacgccctgtccgagcttccggaaaccctggagacactcctgctgctcacccttctggctacggtgacagggggaatctttctgttcctcatgtctggccgggggattggaaagatgaccctgggcatgtgctgcatcatcaccgccagcattcttctgtggtacgcccagatccagcctcattggattgctgcgtccatcattctcgagtttttcctgatcgtcctgctcatccccgaacccgagaagcagagaacacctcaagataatcagcttacctatgtggttattgccatcctgacagtggtggctgccacgatggccaacgaaatgggctttctggagaaaaccaagaaagacctcgggctgggaagcattacaacccagcagccggaatctaatatccttgatattgacctgcgccccgcttccgcctggacactctacgcggtcgccaccacgttcgttacccctatgctgcggcacagcatcgagaactcctctgtgaatgtgagcctgacagctattgccaaccaagctaccgtcctcatgggccttgggaagggatggcccctgtccaaaatggatatcggcgtgcctctgctcgccatcgggtgttactctcaggttaatcccattacactgaccgcggcccttctgctcctggtggctcactatgccatcattggacctggcctgcaggctaaggccacgagagaggctcagaagcgggccgcggccggcatcatgaaaaacccgacagtcgacgggattaccgtgatcgatctcgaccccatcccttacgatcccaagtttgaaaaacaacttggacaggtcatgctgctggtgctctgcgttacacaggtgctgatgatgcgcaccacctgggctatgtgtgaggcccttacactggctacgggccctattagcaccctctgggaagggaatcccggaagattctggaacacaaccatcgccgtctccatggccaatatttttcggggcagctatctggcgggggctggactgctgttctctatcatgaagaacacaaccaatacgcgcagaggcacaggcaacattggggagacccttggagaaaaatggaagtcccggctgaacgccctgggcaaaagcgagtttcaaatctacaagaagtctgggatccaggaggtggaccgcaccctcgctaaagaaggaattaagagaggcgagacagatcatcacgccgtttcccgggggagcgccaaactgcgctggttcgtggaaagaaatatggtcaccccggagggaaaggtggtggaccttggctgcggcagagggggatggtcttattactgtggcgggctgaaaaacgttcgggaggtcaagggactcacaaagggcgggcctggacatgaggaacccatccccatgagcacgtatggctggaatctggtgcgcctgcagtccggcgtggatgtctttttcattcctcccgaaaaatgcgacaccctcctttgtgacatcggggagtctagccctaacccgacagttgaagctggacggaccctgagagtgctgaatctcgtggagaactggctgaataacaatacacagttctgcattaaggtccttaacccctacatgccttccgtgatcgagaaaatggaaaccctgcaacgcaagtacggcggggccctcgttcggaatcccctgagcagaaactccacgcacgagatgtattgggtgtctaatgcgagcggaaacatcgtctcctctgtgaatatgattagccgcatgctgatcaaccggtttaccatgagacataaaaagacaacctacgaacctgatgttgacctcggctccgggacacgcaacattggaatcgagtctgaaattcccaatcttgatatcattggcaagcggatcgagaaaatcaagcaggagcacgaaaccagctggcactatgaccaggatcatccgtacaaaacatgggcctatcacggctcctacgagaccaagcagacggggagcgcttcttccatggtgaacggagtcgtgagactgctgacaaaaccttgggacgtgctccccaccgtcacccaaatggccatgacagatacgacccctttcggccagcagcgcgtttttaaggaaaaggtggacacacggacccaggagcccaaagaagggacaaagaaactgatgaagattaccgctgagtggctttggaaagagctgggaaagaaaaagacacctagaatgtgtacccgcgaagagttcacgagaaaggtgcggagcaatgccgcgctcggcgccatctttaccgatgaaaacaaatggaagtctgctcgcgaggccgtcgaggactccagattctgggaactggtggataaagagcggaagctgcatctcgaagggaaatgcgagacatgtgtttataatatgatgggaaagagagaaaagaaactgggcgagtttggcaaggctaaagggagccgggccatttggtacatgtggcttggagctcgcttcctggagtttgaagccctcggcttcctgaacgaggaccactggttttctagagaaaattcccttagcggggtggagggagaaggcctgcacaagctcgggtacatcctgcgggacgtctccaaaaaggagggcggagcgatgtatgccgatgacaccgctggctgggatacacgcattaccctggaggacctcaagaacgaagagatggtgacgaatcatatggaaggggagcacaaaaagctggccgaagctatcttcaaacttacataccaaaacaaggttgtgagagtccagcggcccaccccgcgcggaacagtgatggatatcattagcagacgggaccagcgcggctctgggcaagttggaacctatggcctgaatacgtttaccaacatggaggcccagctcatcagacagatggagggggaaggcgtgttcaaaaatattcagcatctgacagtcaccgaggaaatcgccgtgcaaaactggcttgcgcgggtcggacgcgagagactgagccggatggctatttccggcgatgactgcgtggttaagcctctcgatgaccgcttcgcctctgccctgacagctctgaatgatatggggaagatcagaaaagacatccagcagtgggagcccagccggggatggaacgattggacccaggtgcccttttgctcccaccatttccacgaactcattatgaaggacggcagagtcctggtggtgccttgtcgcaaccaagacgagcttatcgggcgggccagaatttctcagggagctggctggagcctgcgcgaaacagcctgcctcgggaaatcctacgcgcagatgtggtctctgatctattttcaccggagagatcttcgcctggccgctaatgccatttgtagcgctgttccgtcccattgggtgcccaccagccggacgacatggtctatccacgccaagcatgagtggatgaccaccgaagacatgctcacagtctggaacagagtgtggattcaggagaatccttggatggaggataaaacccccgttgaatcctgggaggaaatcccttacctgggcaagcgcgaggaccaatggtgcggaagcctgatcggcctcacatctcgggcgacgtgggccaagaacattcagaccgctatcaatcaggtgagatccctgattgggaacgaagagtatacagattacatgcccagcatgaaacgcttccggagagaggaagaggaagccggagtcctttggtga

SEQ ID NO: 19867 - RNA, 9876 nt, synthetic construct
  misc_feature 1..9876: note = derived and/or modified CDS sequence (opt5) from DENV-2__FJ639832__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacagactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgctgaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagagaacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaaacgggccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcatgaaaaataccacaaacacccgcagaggcacaggcaacatcggggagaccctgggagagaagtggaaatctcggctgaatgccctcggcaagtccgaatttcaaatttataagaaaagcgggatccaggaggttgaccgcacgctggccaaggaaggaattaaaagaggcgagacagatcaccatgctgtgtctcgggggtccgccaaacttcgctggttcgtcgagagaaacatggtgaccccggaaggaaaagttgtggacctgggctgcggcagagggggatggagctactattgtggcgggctcaagaatgtccgggaggtgaagggactgaccaaaggcgggcctggacacgaagaacccatccccatgtctacatacggctggaacctggtgcgcctccagagcggcgttgatgtctttttcattcctcccgaaaagtgcgacacccttctgtgtgatatcggggagtcctctcctaatccgacagtggaggcgggacggacgctgagagtgctcaacctggtcgaaaattggcttaacaataacacccagttctgcatcaaagttctgaatccctacatgcctagcgtgattgagaagatggaagccctccaacgcaaatatggcggggctctggtgcggaaccccctgtccagaaatagcacacatgagatgtactgggtctccaacgcctctggaaatatcgtgagctccgttaacatgatttctcgcatgctcatcaaccggtttaccatgagacacaagaaggctacatatgaacctgacgtggaccttggcagcgggacccgcaatattggaatcgagtccgaggtccccaacctggatattatcggcaaacggatcgaaaagattaaacaggagcatgaaacgtcttggcactacgaccaggatcacccgtataagacctgggcctaccatggcagctatgagacaaaacagaccgggtccgcgagctctatggtgaatggagttgtgagactgctcacaaagccttgggacgtcctgcccaccgtgacacaaatggccatgaccgatacgacacctttcggccagcagcgcgtgtttaaggaaaaagtcgacacccggacccaggagcccaaggaggggaccaagaaacttatgaaaatcacggctgaatggctgtggaaggagctcggcaaaaagaagacccctagaatgtgtacacgcgaagagttcaccagaaaagttcggtccaacgccgctctgggcgccatttttacagatgagaataagtggaaaagcgctcgcgaagccgtggaggactctagattctgggaactggtggataaggagcggaacctccacctggaagggaaatgcgagacctgtgtctacaatatgatgggaaagagagagaagaaacttggcgaatttggcaaggcgaaagggtcccgggccatctggtacatgtggctgggagctcgcttcctcgagtttgaagccctgggcttccttaacgaggaccattggtttagcagagaaaattctctgtccggggtggagggagagggcctccacaagctggggtatattctgcgggatgttagcaaaaaggaaggcggagctatgtacgccgacgacacagccggctgggatacccgcatcacgctcgaggacctgaagaacgaagagatggtgaccaatcacatggaaggggagcataagaaacttgcggaggctatcttcaaactgacatatcaaaacaaagtcgtgagagttcagcggcccaccccgcgcggaacagtgatggatattatctccagacgggaccagcgcggcagcgggcaagtcggaacctacggcctcaatacgtttacaaacatggaagcccagctgattagacagatggagggggaaggcgtgttcaaaaatatccagcaccttaccgttacagaggaggtggccgtccaaaactggctggctcgggtgggacgcgaaagactctctcggatggccattagcggcgatgactgcgtcgtgaagcctctggatgaccgcttcgctaacgccctgaccgcgctcaatgatatggggaagatcagaaaagacatccagcagtgggagccctccaagggatggaacgattggacgcaggttcccttttgctctcatcacttccatgaactgattatgaaagacggccgggtgcttgtcgtgccttgtagaaatcaagatgagctgatcgggcgcgcccggattagccagggagctggctggtccctcagagaaaccgcctgcctggggaagtcttatgctcagatgtggagccttatgtactttcaccgccgggacctgagactcgccgcgaacgccatctgttccgctgtgccgtctcactgggttcccacaagccgcaccacatggtccattcatgccaaacacgagtggatgaccacagaggacatgctgaccgtgtggaatcgggtctggatcagagaaaacccttggatggaggataagacgcccgtggaaagctgggaggaaattccttatctgggcaagcgcgaggaccagtggtgcggatctctcatcggcctgacatcccgggctacctgggccaaaaatatccaagctgccattaaccaggttagaagccttatcgggaatgaggaatacaccgattacatgccctctatgaagcgcttccggagagaggaagaggaagcgggagtgctgtggtga

SEQ ID NO: 19868 - RNA, 9876 nt, synthetic construct
  misc_feature 1..9876: note = derived and/or modified CDS sequence (opt5) from DENV-2__FJ687434__SS-prME
  source 1..9876: mol_type = other RNA
agcgtgggcatgatcattatgctgatccccaccgtcatggccttccacctcacaacgagaaacggggagcctcatatgattgtttccatccaggaaaagggaaagtctctgctttttaagaccgaggacggcgtgaatatgtgcacactgatggctatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtcgccctcgtgcctcatgttgggatgggactggagacacgcaccgaaacgtggatgagctccgagggcgcgtggaaacacgctcagagaatcgagacatggattctgcggcatcccggcttcaccatcatggccgccattctcgcttacacaatcgggaccacccactttcagcgcacactgattttcatccttctgacggccgtggctccttctatgaccatgagatgcattggaatcagcaaccgggattttgtcgaaggcgtgtccgggggaagctgggttgacatcgtgctcgagcacggctcttgtgtcacaaccatggccaagaataagcccacactggatttcgaacttattaaaaccgaggcgaagcagcctgccacgctgcgcaaatattgcatcgaagctagactcacaaacaccaccacagagtcccggtgtccgacccaaggggagcccagcctgaaggaggaacaagacaaacgctttgtgtgcaagcattctatggtggatagaggatggggcaatggctgtgggctgttcggaaagggcgggattgtcacatgcgccatgtttacgtgcaaaaagaacatggaaggaaaaatcgttcagcctgagaatctcgaatacaccattgtggtgacaccccactccggcgaggagcatgctgtcgggaacgacaccggaaagcacggcaaagaaatcaaggtgacacctcagagctctatcaccgaggccgaactgacgggctatgggaccgttacaatggagtgtagcccccggaccagccttgatttcaatgaaatggtgctgctccaaatggagaacaaagcgtggctggtccaccgccagtggtttcttgacctgccgctcccttggctgcccggagccgatacacagggctccaattggattcagaaggagaccctggtgacgttcaagaaccctcatgctaaaaagcaagacgttgtggtcctcgggtctcaggaaggagccatgcacacagctctgaccggcgccacagagatccagatgagctccgggaatcttctgtttaccggccatctcaaatgcagactgcggatggacaaacttcaactgaaaggaatgagctactctatgtgtaccggcaagttcaaggtggtcaaagaaattgccgagacacagcacgggacgatcgtgattagagttcagtatgagggagatggctccccctgcaagatccccttcgaaatcatggacctcgagaaacgctacgtgctggggcggctgattaccgtcaaccctatcgtgacagaaaaggatagcccggttaacattgaggctgaacccccttttggagactcttacatcattatcggcgtggagcccgggcagctcaaactgaattggttcaagaagggcagctccattggacaaatgtttgagaccacaatgagaggcgcgaaacgcatggccatccttggggataccgcttgggacttcggatctctgggcggggtctttacgagcatcggaaaggccctccatcaggtgttcggcgccatttatggggctgccttttccggcgtgagctggacaatgaaaatcctgattggagttatcattacctggatcggcatgaactctcggtccaccagcctgtctgtctcccttgtgctcgtgggggtcgtgacactgtacctgggagttatggtgcaggcggatagcggctgtgtcgtgtcctggaagaataaagaactcaagtgcgggtctggaatcttcattaccgacaacgttcacacatggacggagcagtataagtttcaacctgaaagcccctccaaactggcttctgccatccagaaggcccaggaggaaggcatttgtgggatcagaagcgtgacccgccttgagaatctgatgtggaaacagattacaccggagctcaaccacatcctggctgaaaatgaggtcaagctgaccatcatgacaggcgatattaaaggaatcatgcaagccggcaagcggtcccttagacctcagcccaccgaactcaaatacagctggaagacgtgggggaaggctaaaatgctgtctaccgagtcccataaccagacattcctgattgacggacctgaaaccgccgagtgccccaatacaaaccgcgcgtggaatagcctcgaggtggaagattatggctttggggttttcaccacaaacatctggctgaaacttaaagagaagcaggacgccttttgtgactctaaactgatgtccgctgccattaaggataatcgggctgtgcacgccgacatgggatactggatcgaaagcgcgctcaacgatacctggaagatcgagaaagcctctttcattgaggtcaagaattgccattggcctaaaagccacacgctgtggtccaacggcgtgctggaaagcgagatgatcattcccaagaaccttgctggcccggtgtctcaacacaattatagacctgggtaccatacacagatcgccggaccctggcacctcggcaaactggaaatggacttcgatttttgtgacgggaccaccgtcgttgtgacagaggattgcggaaaccgcggcccctccctgcggaccacgacagctagcgggaagctcattaccgaatggtgctgtagatcctgcacactgcctccgcttcggtaccgcggagaggacggctgttggtatggcatggagatcagacccctgaaggaaaaagaggaaaatctcgtgaactctctggtcaccgccgggcatggacaggtggataatttcagcctgggcgttcttgggatggccctctttctggaggaaatgctgcggacaagagtgggaaccaagcacgctattctcctggtcgcggtgtccttcgttacgcttatcaccggcaacatgtcttttaaagacctggggcgcgtggtcgtgatggttggagccacaatgaccgatgacatcggcatgggcgtgacatacctcgctctgctggccgccttcaaggtccggcctacctttgctgccgggcttctgctcagaaaactgacgagcaaggagctcatgatgacaaccattggaatcgtgctgctttcccaatctacaattcccgagaccatcctggaactcaccgatgcgctggctctgggcatgatggtgcttaagatggtccgcgacatggagaaatatcagctggccgttacaattatggccatcctctgcgtgcctaatgctgtgatcctgcagaacgcctggaaggtcagctgtacgattctcgcggtggtttccgtgagccccctgcttctgacctcttcccagcagaagacagactggatccctctcgctctgaccattaaggggctgaatcccacagccatcttccttaccacgctgagcagaacaaacaaaaagcggtcttggccgctcaatgaagccattatggctgtcggaatggtgtccatcctggccagctctctcctgaaaaacgatatccctatgaccggcccccttgttgctgggggactgctgaccgtgtgctacgtcctcacaggccgctccgccgacctggagcttgaaagagcgaccgatgtgaagtgggaggaccaggccgagattagcggctccagccctatcctgtctattacaatcagcgaagatgggtccatgtctattaagaatgaggaagaggagcagacgctcaccatcctgattcggacaggactcctggtcatcagcggcctttttcccgtgtccatcccgattaccgctgccgcttggtatctgtgggaagttaaaaagcagcgcgccggggtgctgtgggacgtcccttctccccctcccatgggaaaagccgagctcgaagatggcgcttacagaatcaagcaacgggggattctgggatatagccagatcggcgcgggcgtgtacaaagaggggacattccataccatgtggcacgttacgcgcggagccgtgcttatgcacaagggcaagagaattgaaccctcctgggctgacgtcaaaaaggatctgatctcttacgggggaggctggaaactcgagggggagtggaaggaaggagaggaagtgcaagtgctggccctcgagcctggcaaaaacccgcgggccgttcagaccaagcccggcctgtttaagacaaataccgggacaatcggagctgtcagccttgacttctcccctggcaccagcgggtctcccattatcgataaaaagggaaaagtggtgggcctgtatgggaacggagtcgtgacacgctccggcgcctacgttagcgcgattgctcaaacggaaaagtctatcgaggacaaccctgatattgaggacgacatctttagaaaacggagactgaccatcatggatctccatcccggcgccgggaagacaaagcgctatctgcctgccattgtgcgggaagctatcaaaagaggacttcgcaccctgattctcgccccgacccgggtcgtggcggctgagatggaagaggccctgagaggcctccccatccgctaccagacgcctgctattcgggctgaacacacagggagagagatcgttgacctgatgtgtcatgccaccttcacaatgcgccttctgtcccccgtgcgggtccctaattataacctgattatcatggatgaggctcacttcaccgaccccgccagcatcgcggccagaggatacatttccacacgggtggaaatgggcgaggctgccgggatctttatgaccgctacgccgcctggctctcgcgatcccttcccccagagcaatgcccctattatcgacgaagagagagagattcccgaacggtcctggaacagcggacatgagtgggttacagattttaagggcaaaaccgtgtggttcgtcccttctatcaaggccgggaatgacatcgctgcgtgcctccgcaaaaacggaaagaaggtgattcaactgtccagaaaaacctttgatagcgaatatgtgaagacacggaccaatgactgggatttcgtcgttacaaccgacatctctgagatgggcgccaactttaaagctgaaagagtgattgacccgcgccggtgtatgaagcccgtgatccttacggatggggaggagagagtcattctggccggacctatgcccgtgacacacagctccgccgctcagcgccggggcagaatcgggcgcaatcctaaaaacgaaaatgaccagtacatctacatgggcgagcccctcgaaaacgatgaggactgcgcccactggaaggaagcgaaaatgctgctggataatattaacaccccggagggaatcattccttctatgttcgagcccgaacgggagaaggttgacgctatcgatggcgaatatagactccgcggggaggccagaaagacatttgtggaccttatgcggcgcggagatctgcctgtctggctggcctacaaagtggctgccgaaggcattaattatgcggacagacggtggtgtttcgatgggatcaagaacaaccagattctcgaggagaatgttgaagtggagatctggaccaaagaaggagagcgcaagaaactgaagcccagatggcttgacgcccggatctacagcgatcctctggctctcaaggagtttaaagagttcgccgctggcagaaagtccctgacgctgaacctcattaccgagatggggcgccttcccacattcatgacccagaagacacgggacgccctggacaatctggctgtcctccataccgccgaagcgggcggcagagcctataaccacgctctgtctgagcttccggaaacactggagaccctcctgctgctcacgcttctggccacagtgaccggcgggatctttctgttcctcatgagcggacgcggcattgggaagatgaccctgggaatgtgctgcatcgtcacagcttccattcttctgtggtacgcccagatccagcctcattggatcgccgctagcattatcctcgagtttttcctgattgtgctgctcatccccgaacccgagaaacagcggacccctcaagataatcagcttacatatgttgtgattgcgatcctgacggtggtcgccgctaccatggccaacgaaatgggctttctggagaagacaaagaaagacctcggcctggggtctatcgccacccagcagccggaatccaatattcttgatatcgacctgagacccgctagcgcctggacactctacgcggttgccaccacgttcgtgacccctatgctgcggcactccattgagaactctagcgtgaatgtctccctgacagctatcgccaaccaagctaccgtgctcatgggacttggcaaggggtggcccctgtctaaaatggatattggagcccctctgctcgcgatcggctgttacagccaggttaatcccattacactgaccgccgcccttctgctcctggtggcccactatgctatcatcgggcctggactgcaggccaaggctacgcgcgaggcccagaaaagagcggccgctggcattatgaagaacccgacagtcgacggcatcaccgtgattgatctcgaccccatcccttacgatcccaagtttgaaaaacaacttgggcaggccatgctgctggtcctctgcgtgacacaggttctgatgatgcggaccacctgggctctttgtgaggccctgacactcgccacgggacctatttccaccctgtgggaaggcaatcccgggcgcttctggaacacaaccatcgcggtgagcatggctaatatctttagaggatcttatctggccggcgctgggctccttttctccattatgaagaacacaaccaatagccggcgcggaacgggcaacatcggcgagacactgggggaaaaatggaagtctagactgaacgccctcggaaaatccgagtttcaaatttacaagaaaagcggcatccaggaggtcgaccggaccctggccaaggaagggattaagcgcggagagaccgatcatcacgctgtgtctagaggcagcgccaaacttcggtggttcgttgaaagaaatatggtgacaccggaggggaaggtcgtggacctgggatgcggccgcggcgggtggtcctattactgtggaggcctcaaaaacgtgcgggaggttaaggggctgaccaaaggaggccctgggcatgaggaacccatccccatgtctacatatggatggaatctggtcagactccagagcggcgtggatgtgtttttcatccctcccgaaaagtgcgacacgcttctgtgtgacattggcgagtccagccctaacccgaccgtcgaagcggggcgcacactgcgggttctcaatctggtggagaactggcttaataacaatacccagttctgcatcaaggtgctgaacccctacatgccttccgtcattgagaaaatggaaacactccaaagaaagtacggaggcgccctggtgcgcaatcccctgtctcggaacagcacccacgagatgtattgggtttccaatgcttctgggaacatcgtgagctccgtcaatatgatttctagaatgctcatcaaccgctttacgatgcggcataaaaaggccacctacgaacctgatgtggaccttggaagcggcacaagaaacatcgggattgagtccgaaatccccaatctggatattatcggaaaacgcattgagaagatcaagcaggagcacgaaaccagctggcactatgaccaggatcatccgtacaaaacatgggcttatcacggctcttacgagaccaagcagacaggctccgccagctctatggttaacggggtggtccggctgctcaccaaaccttgggacgtgctgcccacggtgacacaaatggcgatgaccgataccacacctttcggacagcagagagtctttaaggaaaaagttgacacgcgcacccaggagcccaaggaaggcacaaagaaacttatgaagattaccgccgagtggctgtggaaagagctcgggaagaaaaagacacctagaatgtgtacccgggaagagttcacacgcaaagtgagatccaatgctgccctgggagctatctttaccgatgaaaacaagtggaagtccgcccgggaggctgtggaggactctagattctgggaactggtcgataaagagcggaatctccatctggaaggcaagtgcgagacgtgtgtgtataacatgatggggaaacgcgaaaagaaacttggagagtttggcaaggccaagggctccagagcgatctggtacatgtggctgggggcccggttcctcgagtttgaagctctgggattccttaatgaggaccactggtttagccgcgaaaactccctgagcggcgttgagggggaaggactccacaaactgggctacattctgagagacgtgtctaagaaagaagggggagccatgtatgctgatgacaccgccggatgggatacacggatcaccctcgaggacctgaagaatgaagagatggtcacaaaccatatggaaggcgagcacaagaaacttgccgaagcgattttcaaactgacctaccaaaataaagtggttcgcgtgcagagacccacgccgcgggggacagtcatggatatcattagccgcagagaccagcggggatccggccaagtggggacctatggactcaacacatttaccaatatggaggctcagctgatccgccagatggagggcgaaggggttttcaagaacatccagcatcttacggtgaccgaggaaattgccgtccaaaattggctggccagagtgggccgggagcgcctctctagaatggctatcagcggagatgactgcgtcgtgaaacctctggatgaccggttcgcctccgctctgacagccctcaacgatatgggcaagattagaaaagacatccagcagtgggagccctctcgcgggtggaacgattggacccaggttcccttttgcagccaccatttccacgaactgattatgaaggacggacgggtgcttgtcgtgccttgtagaaatcaagacgagctgatcggccgcgcgcggatctcccagggggccggatggtctctcagagaaacagcttgcctgggcaagagctacgcccagatgtggtcccttatgtattttcaccgccgggatctgagactcgctgccaacgcgatttgtagcgccgtgccgtctcattgggttcccacctcccgcacaacctggagcatccacgctaaacatgagtggatgacgacagaagacatgctgaccgtgtggaatcgggtctggattcaggagaacccttggatggaggataagacccccgtggaatcttgggaggaaatcccttacctggggaaaagagaggaccaatggtgcggctccctcattggactgacaagccgcgccacctgggctaagaatatccaggccgctattaaccaggttcggtcccttatcggcaatgaagagtatacagattacatgccctctatgaaaagattccggagagaggaagaggaagccggggtgctgtggtga

SEQ ID NO: 19869 - RNA, 9876 nt, synthetic construct
  misc_feature 1..9876: note = derived and/or modified CDS sequence (opt5) from DENV-2__FJ687439__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagacagaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcaggagtccaattggattcagaaagaaaccctggtcacattcaagaaccctcatgctaaaaagcaagacgtggttgtgctcggaagccaggagggcgccatgcacaccgccctgacgggggctacagaaatccagatgtcctctggcaatcttctgtttaccggacatctcaaatgccgcctgagaatggacaaacttcaactgaagggcatgagctactccatgtgtacagggaaattcaaggtcgtgaaagagattgcggagacccagcacggaaccatcgtcattcgggtgcagtatgaaggcgatgggagcccctgcaagatccccttcgagatcatggacctcgagaagcggtacgttctgggacgcctgattacagtgaaccctatcgccacggagaaggattctccggtcaacattgaagctgagcccccttttggcgactcctacatcattatcggggtggagcccggccagctcaagctgaattggttcaaaaagggaagctctattggccaaatgtttgaaaccacaatgagaggggccaaaagaatggccatccttggagataccgcttgggacttcggcagcctcgggggagtttttacatccatcggcaaggccctccatcaggtgttcggggcgatttatggcgctgccttttctggagtcagctggaccatgaaaatcctgattggcgtgatcattacgtggatcgggatgaactcccgcagcacatctctgtccgtgagccttgttctcgtcggaatcgtgaccctgtacctgggcgtgatggtccaggccgattctgggtgtgtggtttcctggaagaataaggagctcaaatgcggaagcggcattttcatcaccgacaacgtgcacacatggaccgaacagtataagtttcaacctgagtccccctctaaactggctagcgccattcagaaggctcaggaagaggggatctgtggcattcggtccgtcacaagacttgagaatctgatgtggaaacagatcacgccggaactcaaccacatcctggccgagaatgaagtgaagctgaccattatgacaggagatatcaaaggcattatgcaagcggggaagcgctctcttcggcctcagcccaccgagctcaagtacagctggaaaacatggggaaaggccaaaatgctgtccaccgaaagctataaccagacgttcctgatcgacggccctgagaccgctgagtgccccaatacaaacagagcctggaactctctcgaagttgaggattacgggtttggagtgttcaccacaaacatttggctgaaacttaaagaaaagcaggacgctttttgtgactccaagctgatgagcgccgcgatcaaagataatcgcgccgtccatgctgacatgggctattggatcgagtctgccctcaacgatacctggaagattgagaaggctagcttcatcgaagtgaagaattgccactggcctaaaagccatacactgtggtctaacggcgttctggagagcgaaatgattatccccaagaaccttgccgggccggtgtcccaacacaattaccggcctggataccacacccagattgccggcccctggcatctcgggaagctggagatggacttcgatttttgtgacggaacgacagtcatcgtgaccgaagattgcggcaacagagggcccagcctgcgcaccacaaccgcttctggaaaactcattacggagtggtgctgtcggtcctgcacactgcctccgcttagatatcggggcgaggacggctgttggtacgggatggaaatccgccccctgaaggagaaagaagagaatctcgtgaacagcctggtcaccgcgggacacggccaggttgataatttctccctgggggtgcttggaatggccctctttctggaagagatgctgagaacacgggtgggcaccaagcatgctatcctcctggtcgccgtgtctttcgttacacttattaccgggaacatgagctttaaagacctgggaagagtggtcgtgatggttggcgccacgatggctgatgacatcggcatgggggtgacctatctcgccctgctggcggctttcaaggtccgccctacatttgccgccggacttctgctccggaagctgacctccaaagagctcatgatgacaaccattggcatcgtgctgctttctcaaagcacgattcccgaaacaatcctggagctcaccgatgctctggccctggggatgatggttcttaagatcgtgagaaatatggaaaaataccagctggcggtcacaattatggctatcctctgcgtgcctaacgccgtgattctgcagaatgcctggaaggtctcctgtaccatcctcgctgttgtgtctgtgagccccctgcttctgacctccagccagcagaagacggactggattcctctcgccctgacgatcaagggactgaaccccaccgctatcttccttacaaccctgtctcgcacaaataaaaagagatcctggccgctcaacgaggccattatggcggtcggcatggtgagcatcctggcctcttccctcctgaagaatgacattcctatgaccgggccccttgttgctggaggcctgctgacggtgtgctatgtcctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccatcctgattagaacaggcctcctggttatctccgggctttttcccatttctatcccgattacggccgctgcgtggtacctgtgggaggtgaaaaagcagcgggccggagtcctgtgggatgtgccttctccccctcccatgggcaaagctgaactcgaggacggggcctatcgcatcaagcaaaagggaatcctgggctactcccagattggcgccggggtctacaaagaaggaaccttccacacaatgtggcatgtgaccagaggcgctgttcttatgcacaaggggaaacggatcgagccctcctgggccgatgtgaagaaagacctgattagctatggaggcgggtggaagctcgagggagaatggaaggagggcgaagaggtccaggtgctggcgctcgaacctggcaaaaatccgcgcgctgttcagacaaagcccgggctgtttaaaaccaacacgggaaccatcggcgccgtgtcccttgatttctctcctgggacaagcggatcccccattatcgacaagaaaggcaaggtcgtggggctgtacggaaacggcgtggttaccagaagcggcgcctatgtctctgctatcgcccaaacagagaagtccattgaggataatcctgaaatcgaggacgatatttttcggaaacgcagactgaccatcatggacctccaccccggggcgggaaagacaaaacggtacctgcctgctattgtgagagaagccatcaagcgcggccttcggacgctgattctcgccccgaccagagtggtcgctgccgagatggaagaggctctgcgcgggctccccatccggtatcagacccctgccatcagagcggagcataccggacgcgaaattgtggacctgatgtgtcacgccaccttcacaatgcggcttctgagccccgttagagtgcctaactacaatctgatcgtcatggatgaggctcatttcacggaccccgcctctattgctgcccgcggctatatctccacccgggtggaaatgggggaggccgctggcatttttatgacagcgaccccgcctggaagcagagatcccttcccccagtccaacgcccctatcatcgacgaggaacgggagattcccgaacgctcttggaatagcggccacgagtgggttacagattttaaagggaagaccgtgtggttcgtcccttccatcaaggctggaaacgacattgccgcctgcctccgcaaaaatggcaagaaagtgatccaactgagccggaagacgtttgattctgaatacgttaaaacacgcaccaacgactgggatttcgtggtcaccacagacatttccgagatgggggctaattttaaggccgagagagtgatcgatccgcggagatgtatgaaacccgtgatccttaccgacggagaggaacgcgtcattctggcgggccctatgcccgttacacatagctctgctgcccagcggagagggcgcatcggccggaaccctaagaatgaaaacgaccagtacatttatatgggagagcccctcgaaaatgatgaggactgcgcccactggaaggaggctaaaatgctgctggataacatcaataccccggaaggcattatccctagcatgttcgagcccgaaagagagaaggtggacgccattgatggggaataccgcctccggggagaggcgagaaaaacgtttgtggaccttatgcgcagaggcgatctgcctgtctggctggcctataaggtggctgccgaggggatcaactacgctgaccggcgctggtgtttcgatggaatcaaaaacaatcagattctcgaagagaacgttgaagtggagatctggacaaaggagggcgaaagaaagaaactgaagccccggtggcttgacgcccgcatttattccgatcctctggctctcaaagagtttaaggagttcgccgcggggagaaaatctctgaccctgaatctcatcacagagatgggccggcttcccaccttcatgacgcaaaagaccagagacgccctggataacctggctgtcctccacacagccgaagctggaggccgcgcctacaatcatgccctgagcgagcttccggagaccctggaaacactcctgctgctcacccttctggctacagtgaccgggggaatttttctgttcctcatgtccggccgggggatcggaaagatgacgctgggcatgtgctgcatcattacagcgtctatccttctgtggtatgcccagattcagcctcactggatcgctgccagcattatcctcgagtttttcctgatcgttctgctcattcccgaacccgagaaacagagaacccctcaagacaaccagcttacctacgtggtcatcgccattctgacagtggtcgctgccaccatggcgaatgaaatgggctttctggagaagaccaagaaggacctcgggctgggatccatcgccacgcagcagccggagagcaacattcttgatatcgacctgcgccccgcttctgcctggaccctctacgctgtggccacaaccttcgttacacctatgctgcggcattccattgaaaatagctccgtgaacatctctctgaccgcgatcgccaatcaagctacggtgctcatgggccttgggaaaggatggcccctgagcaagatggatattggcgtccctctgctcgccatcgggtgttattcccaggttaaccccattaccctgacagctgcccttctgctcctggtggctcactacgccatcattggacctggcctgcaggcgaaggccaccagagaggctcagaaacgggccgctgccggcatcatgaagaatccgacagtggacgggatcaccgtcattgatctcgaccccatcccttatgatcccaaatttgaaaagcaacttggacaggtgatgctgctgattctctgcgttacacaggtgctgatgatgcgcacaacctgggccctttgtgaggcgctgacactcgctaccggccctatctctaccctgtgggaagggaaccccggaagattctggaatacaacgattgccgtcagcatggctaacatctttcggggctcctacctggccggggccggactccttttcagcatcatgaaaaataccacaaacacccgcagaggcacaggcaacattggggagaccctgggagagaagtggaaatctcggctgaatgctctcggcaagtccgaatttcaaatctataagaaaagcgggattcaggaggtggaccgcacgctggccaaggaaggaatcaaaagaggcgagacagatcaccatgcggtctctcgggggtccgccaaacttcgctggttcgtggagagaaacatggttaccccggaaggaaaagtggtcgacctgggctgcggcagagggggatggagctactattgtggcgggctcaagaatgtgcgggaggttaagggactgaccaaaggcgggcctggacacgaagaacccattcccatgtctacatacggctggaacctggtgcgcctccagagcggcgtcgatgtgtttttcatccctcccgaaaagtgcgacacccttctgtgtgatatcggggagtcctctcctaatccgacagtggaggctggacggacgctgagagttctcaacctggtcgaaaattggcttaacaataacacccagttctgcattaaagtgctgaatccctacatgcctagcgtgatcgagaagatggaagccctccaacgcaaatatggcggggctctggtccggaaccccctgtccagaaatagcacacatgagatgtactgggtttccaacgcctctggaaatattgtgagctccgtgaacatgatctctcgcatgctcattaaccggtttaccatgagacacaagaaggcgacatatgaacctgacgtcgaccttggcagcgggacccgcaatatcggaattgagtccgagatccccaacctggatatcattggcaaacggatcgaaaagattaaacaggagcatgaaacgtcttggcactacgaccaggatcacccgtataagacctgggcctaccatggcagctatgagacaaaacagaccgggtccgctagctctatggtgaatggagttgtgagactgctcacaaagccttgggacgtcctgcccaccgtgacacaaatggccatgaccgatacgacacctttcggccagcagcgcgtttttaaggaaaaagtggacacccggacccaggagcccaaggaggggaccaagaaacttatgaaaatcacggctgaatggctgtggaaggagctcggcaaaaagaagacccctagaatgtgtacacgcgaagagttcaccagaaaagtccggtccaacgccgctctgggcgccatttttacagatgagaataagtggaaaagcgcgcgcgaagccgtggaggactctagattctgggaactggtggataaggagcggaacctccacctggaagggaaatgcgagacctgtgtctacaatatgatgggaaagagagagaagaaacttggcgaatttggcaaggctaaagggtcccgggccatctggtacatgtggctgggagctcgcttcctcgagtttgaagccctgggcttccttaacgaggaccattggtttagcagagaaaattctctgtccggggttgagggagagggcctccacaagctggggtatatcctgcgggatgtgagcaaaaaggaaggcggagccatgtacgcggacgacacagctggctgggatacccgcattacgctcgaggacctgaagaacgaagagatggtgaccaatcacatggaaggggagcataagaaacttgccgaggccatcttcaaactgacatatcaaaacaaagtcgtgagagttcagcggcccaccccgcgcggaacagtgatggatattatctccagacgggaccagcgcggcagcgggcaagtcggaacctacggcctcaatacgtttacaaacatggaagctcagctgattagacagatggagggggaaggcgtgttcaaaaatatccagcaccttaccgttacagaggaggtggccgtccaaaactggctggctcgggtgggacgcgaaagactctctcggatggccatcagcggcgatgactgcgttgtgaagcctctggatgaccgcttcgcgaacgccctgaccgctctcaatgatatggggaagattagaaaagacatccagcagtgggagccctccaagggatggaacgattggacgcaggtccccttttgctctcatcacttccatgaactgattatgaaagacggccgggtgcttgtcgtgccttgtagaaatcaagatgagctgatcgggcgcgcccggattagccagggagctggctggtccctcagagaaaccgcctgcctggggaagtcttatgcgcagatgtggagccttatgtactttcaccgccgggacctgagactcgccgctaacgccatctgttccgctgttccgtctcactgggtgcccacaagccgcaccacatggtccattcatgccaaacacgagtggatgaccacagaggacatgctgaccgtctggaatcgggtgtggatcagagaaaacccttggatggaggataagacgcccgtggaaagctgggaggaaatcccttatctgggcaagcgcgaggaccagtggtgcggatctctcattggcctgacatcccgggctacctgggccaaaaatatccaagcggccattaaccaggttagaagccttatcgggaatgaggaatacaccgattacatgccctctatgaagcgcttccggagagaggaagaggaagctggagtgctgtggtga

SEQ ID NO: 19870 - RNA, 9876 nt, synthetic construct
  misc_feature 1..9876: note = derived and/or modified CDS sequence (opt5) from DENV-2__FJ687440__SS-prME
  source 1..9876: mol_type = other RNA
agcgccggcatgatcattatgctgatccccaccgtgatggctttccacctcaccacgagaaatggggaacctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatggatcacctatggcacgtgtaccacaaccggggagcaccgcagagaaaagcggtccgtggcgctcgtgcctcatgtcggaatgggcctggagacacgcaccgaaacgtggatgtctagcgagggcgcttggaaacacgcccagagaattgagacatggatcctgcggcatcccgggttcaccattatggccgctatcctcgcctacacaattggaaccacccactttcagcgcgctctgatcttcattcttctgacagccgtggcgccttccatgacgatgagatgcatcggcatctctaaccgggattttgttgaaggggtgagcggaggctcctgggtcgacattgtgctcgagcacgggagctgtgttaccacaatggccaagaataagcccaccctggatttcgaacttatcaaaacagaggctaagcagcctgccaccctgcgcaaatattgcattgaagctaagctcacgaacacaaccaccgagtctagatgtccgacacaaggagagccctccctgaaagaagaacaagacaagcggtttgtgtgcaagcatagcatggtcgatcgcggctggggcaatgggtgtggactgttcggcaaagggggaatcgtgacctgcgccatgtttacatgcaagaaaaacatggaaggcaagattgtgcagcctgagaatctcgaatacacgatcgtcgttacaccccactctggggaggagcatgcggtgggaaacgacacaggcaaacacggcaaggaaatcaaagtgacccctcagtccagcattacagaggccgaactgaccgggtatggaacggtcaccatggagtgttctcccagaacaggccttgatttcaatgaaatggtgctgctccaaatggagaacaaggcttggctggttcaccggcagtggtttcttgacctgccgctcccttggctgcccggggccgataagcagggatccaattggatccagaaagagaccctggtgacattcaagaaccctcatgctaaaaagcaagacgtcgtggttctcggcagccaggaaggggccatgcacaccgccctgacgggcgctacagagattcagatgtcctctggaaatcttctgtttaccggccatctcaaatgccgcctgagaatggacaaacttcaactgaaggggatgagctactccatgtgtacaggaaaattcaaggtggtcaaagaaatcgcggagacccagcacggcaccattgtgatccgggtccagtatgagggggatggaagcccctgcaagatccccttcgaaattatggacctcgagaaaagatacgtgctgggccgcctgatcacagttaaccctattgtgacggaaaaggattctccggtcaacatcgaggccgaacccccttttggggactcctacattatcattggcgtggagcccggacagctcaagctgaattggttcaaaaagggcagctctatcgggcaaatgtttgagaccacaatgcggggagctaaaagaatggccatccttggcgataccgcctgggacttcgggagcctgggaggcgtttttacatccattgggaaggctctccatcaggtgttcggcgccatctatggagcggctttttctggcgtcagctggaccatgaaaattctgatcggggtgattatcacgtggatcggaatgaactcccgcagcacatctctgtccgtgagccttgttctcgtcggcattgtgaccctgtacctgggggtgatggtccaggccgattctggatgtgtggtttcctggaagaataaggaactcaaatgcggcagcgggatcttcattaccgacaacgtgcacacatggaccgagcagtataagtttcaacctgaatccccctctaaactggccagcgctatccagaaggcccaggaggaaggcatttgtggaatccggtccgtcacaagacttgagaatctgatgtggaaacagatcacgccggagctcaaccacattctggctgaaaatgaggtgaagctgaccatcatgacaggcgatattaaagggatcatgcaagccggaaagcgctctcttcggcctcagcccaccgaactcaagtacagctggaaaacatggggcaaggcgaaaatgctgtccaccgagagccataaccagacgttcctgattgacgggcctgaaaccgccgagtgccccaatacaaacagagcttggaactctctcgaggttgaagattatggatttggcgtgttcaccacaaacatctggctgaaacttaaagagaagcaggacgccttttgtgactccaagctgatgagcgctgccatcaaagataatcgcgcggtccacgccgacatgggctactggattgaatctgctctcaacgatacctggaagatcgagaaagcctccttcattgaggtgaagaattgccattggcctaaaagccacacactgtggtctaacggggttctggaaagcgagatgatcattcccaagaaccttgctggaccggtgtcccaacacaattatcggcctggctaccatacccagatcgccgggccctggcacctcggaaagctggaaatggacttcgatttttgtgacggcacgacagtcattgtgaccgaggattgcgggaacagaggacccagcctgcgcaccacaaccgcctctggcaaactcatcacggaatggtgctgtcggtcctgcacactgcctccgcttagataccggggcgaggacgggtgttggtatggaatggagatccgccccctgaaggaaaaagaggaaaatctcgtgaacagcctggtcaccgctggccatgggcaggttgataatttctccctgggagtgcttggcatggcgctctttctggaggaaatgctgagaacacgggtggggaccaagcacgccattctcctggtcgctgtgtctttcgttacacttatcaccggaaacatgagctttaaagacctgggcagagtggtcgtgatggttggcgccacgatgaccgatgacattgggatgggagtgacatacctcgccctgctggctgccttcaaggtccgccctacctttgcggctggccttctgctccggaagctgacatccaaagagctcatgatgaccacgatcgggattgtgctgctttctcaaagcacaatccccgagaccatcctggaactcacagatgccctggccctgggaatgatggttcttaagattgtgagaaatatggagaaatatcagctggctgtcaccatcatggccattctctgcgtgcctaacgcggtgatcctgcagaatgcttggaaggtctcctgtaccattctcgccgttgtgtctgtgagccccctgcttctgacatccagccagcagaagacggactggatccctctcgccctgaccatcaagggcctgaaccccacagctattttccttaccacactgtctcgcaccaataaaaagagatcctggccgctcaacgaagccatcatggctgtcgggatggtgagcattctggcctcttccctcctgaagaatgacatccctatgacgggaccccttgttgcgggcggcctgctgacagtgtgctacgtcctcaccgggcggagcgccgatctggagcttgaacgcgctaccgacgtgaaatgggaggatcaggccgagatttctggatccagccctatcctgtccattacaatcagcgaagacggctctatgagcatcaagaacgaggaagaggagcagaccctcacaattctgatcagaacggggctcctggttatttccggactttttcccgtgtctatcccgattaccgctgccgcctggtatctgtgggaagtcaaaaagcagcgggctggcgtgctgtgggatgtcccttctccccctcccatggggaaagcggagctcgaagacggagcctaccgcatcaagcaaaagggcatcctgggctattcccagattggggctggagtgtacaaagagggcacattccataccatgtggcacgttacaagaggggccgtgcttatgcacaagggaaaacggatcgaaccctcctgggccgatgtcaagaaagacctgattagctacggcgggggatggaagctcgagggcgagtggaaggaaggcgaggaagtgcaggttctggctctcgagcctgggaaaaatccgcgcgccgtgcagaccaagcccggactgtttaaaacgaacaccggcacaatcggggcggtctcccttgatttctctcctggaaccagcggctcccccattatcgacaagaaagggaaggtggtgggactgtatggcaacggcgttgtcacaagaagcggggcttacgtgtctgccatcgcccaaaccgaaaagtccattgaggataatcctgagatcgaagacgatatttttcggaaacgcagactgacaatcatggacctccatcccggagctggcaagacgaaacggtatctgcctgccattgtgagagaggcgatcaagcgcgggcttcggaccctgattctcgctccgacaagagtcgtggccgccgaaatggaggaagctctgcgcggactccccatccggtaccagacccctgccatcagagctgagcacaccggccgcgagattgttgacctgatgtgtcatgccacattcacgatgcggcttctgagccccgtgagagtccctaactataatctgatcattatggatgaagcgcacttcaccgaccccgcctctatcgctgcccgcgggtacatttccacacgggtggagatgggcgaagctgccggaatctttatgaccgccacaccgcctggcagcagagatcccttcccccagtccaacgctcctatcattgacgaggagcgggaaatccccgagcgctcttggaatagcgggcatgaatgggttaccgattttacgggaaaaacagtgtggttcgtcccttccattaaggcgggcaacgacatcgccgcttgcctcagaaagaatgggaaaaaggtgattcaactgagccggaaaacctttgattctgagtatgttaagacccgcacaaacgactgggatttcgtggtcaccacagacatctccgaaatgggagccaattttaaagccgagagagtgatcgatccgcggagatgtatgaagcccgtgattcttaccgacggcgaggaacgcgtcatcctggctgggcctatgcccgttacgcacagctctgccgcgcagcggagaggccgcattggacggaaccctaaaaatgagaacgaccagtacatctacatgggcgaacccctcgagaatgatgaagactgcgctcactggaaggaggccaagatgctgctggataacattaatacaccggaggggatcattcctagcatgttcgaacccgagagagaaaaagtggacgccatcgatggagagtatcgcctccggggcgaagctagaaagacctttgtggaccttatgcgcagaggggatctgcctgtctggctggcctacaaagtggcggccgagggaatcaactatgctgaccggcgctggtgtttcgatggcattaagaacaatcagatcctcgaggaaaacgttgaggtggaaatttggacaaaagagggggagagaaagaagctgaaaccccggtggcttgacgcccgcatctactccgatcctctggctctcaaggaatttaaagagttcgccgctggcagaaagtctctgaccctgaatctcattacggaaatgggacggcttcccaccttcatgacacagaagaccagagacgccctggataacctggcggtcctccatacagccgaggctggcgggcgcgcctataatcacgctctgagcgaacttccggagaccctggagacactcctgctgctcacccttctggccacggtgacaggaggcatctttctgttcctcatgtccgggcggggaatcggcaagatgaccctgggcatgtgctgcattatcaccgcctctattcttctgtggtacgctcagatccagcctcattggattgcggccagcatcatcctcgaatttttcctgattgttctgctcatccccgagcccgaaaagcagagaacacctcaagacaaccagcttacctatgtggtcattgctatcctgacagtggtcgccgccacgatggctaatgagatggggtttctggagaagaccaagaaagacctcggactgggctccattgccacacagcagccggagagcaacatccttgatattgacctgcgccccgcgtctgcctggaccctctacgctgtggccacaaccttcgttacgcctatgctgcggcactccatcgagaatagctccgtgaacgtgtctctgaccgctatcgccaatcaagcgacagtcctcatggggcttggaaagggctggcccctgagcaaaatggatattggggttcctctgctcgccatcggatgttactcccaggtgaaccccattaccctgacagctgcccttctgctcctggtggctcactatgccatcattggccctggcctgcaggctaaggccaccagagaagcgcagaagcgggccgctgccgggatcatgaaaaatccgacggtcgacggaatcacagtgattgatctcgaccccatcccttacgatcccaagtttgagaaacaacttggccaggttatgctgctgattctctgcgtgacccaggtcctgatgatgcgcacaacctgggctctttgtgaagccctgaccctcgccacagggcctatctctacgctgtgggagggaaaccccggcagattctggaataccacaattgcggtgagcatggctaacatctttcgggggtcctatctggccggagctggcctccttttcagcatcatgaagaataccacaaacacccgcagaggcacggggaacattggagaaacactgggcgagaaatggaagtctcggctgaatgccctcgggaaatccgagtttcaaatctacaaaaagagcggcattcaagaagtcgaccgcaccctggccaaagagggaatcaagagaggggaaaccgatcatcacgctgtgtctcggggatccgccaaacttcgctggttcgttgagagaaacatggtgacaccggagggcaaggtcgtggacctgggctgcgggcggggaggctggagctattactgtgggggactcaaaaatgttagagaagtgaagggcctgaccaaagggggacctggccatgaggaacccattcccatgtctacatatggctggaacctggtccgcctccagagcggggtggatgtgtttttcatccctcccgagaaatgcgacacgcttctgtgtgatatcggagaatcctctcctaatccgaccgttgaggcgggccggacactgagagtcctcaacctggtggagaattggcttaacaataacacccagttctgcattaaggtgctgaatccctacatgcctagcgtcatcgagaagatggaggccctccaacgcaagtacgggggagctctggttcggaaccccctgtccagaaatagcacacacgaaatgtattgggtgtccaacgcctctggcaatattgtgagctccgtcaacatgatctctcgcatgctcattaaccggtttaccatgagacataaaaaggctacgtacgagcctgacgtggaccttgggagcggaacccgcaatatcggcattgaatccgagatccccaacctggatatcattggcaagcggatcgagaaaattaagcaggaacacgagacatcttggcactatgaccaggatcatccgtacaaaacctgggcctatcacgggagctacgaaacaaagcagaccggatccgcgagctctatggttaatggcgtggtcagactgctcacaaaaccttgggacgtgctgcccaccgttacgcaaatggccatgacagataccacccctttcgggcagcagcgcgtgtttaaggagaaggtcgacacacggacgcaggaacccaaagagggaaccaagaaacttatgaagatcacagctgagtggctgtggaaagaactcggcaagaaaaagacccctagaatgtgtacacgcgaggagttcaccagaaaggtgcggtccaacgccgctctgggggccatttttacagatgagaataaatggaaaagcgctcgcgaggccgtggaagactctagattctgggagctggtcgataaagaacggaacctccatctggagggaaagtgcgaaacctgtgtttataatatgatgggcaaaagagagaagaaacttggcgagtttgggaaagcgaagggatcccgggccatctggtacatgtggctgggcgctcgcttcctcgaatttgaggccctggggttccttaacgaagaccactggtttagcagagaaaattctctgtccggagtggaaggcgaggggctccacaaactgggctacatcctgcgggatgtgagcaagaaagagggaggcgctatgtatgccgacgacacggccgggtgggatacccgcattacactcgaagacctgaagaacgaggaaatggtcaccaatcatatggagggagaacacaagaaacttgcggaggctatcttcaagctgacataccaaaacaaagtggttagagtgcagcggcccaccccgcgcggcacggtcatggatattatctccagacgggaccagcgcgggagcggacaagtgggcacatatgggctcaatacctttacaaacatggaggcccagctgattagacagatggaaggcgagggagttttcaagaatatccagcatcttaccgccacggaagagatcgctgtgcaaaactggctggcccgggtcggccgcgagagactctctcggatggctattagcggggatgactgcgtggttaaacctctggatgaccgcttcgccaacgcgctgaccgccctcaatgatatgggaaagatcagaaaggacattcagcagtgggaaccctccaaaggctggaacgattggacacaggtgcccttttgctctcaccatttccacgagctgatcatgaaggacgggcgggtccttgtggtcccttgtagaaatcaagatgaactgattggacgcgctcggatcagccagggcgccgggtggtccctcagagagaccgcttgcctgggcaaatcttacgcccagatgtggagccttatgtattttcaccgccgggacctgagactcgcggccaacgctatttgttccgccgtgccgtctcattgggttcccacaagccgcaccacatggtccatccacgctaagcatgaatggatgaccacggaggacatgctgacagtgtggaatcgggtctggatcagagagaacccttggatggaagataaaacccccgtggagagctgggaagagattccttacctgggaaagcgcgaagaccagtggtgcggctctctcatcgggctgacctcccgggccacatgggctaagaatattcaagccgcgatcaaccaggtgagaagccttattggaaatgaggagtataccgattacatgccctctatgaaacgcttccggagagaagaggaagaggccggcgttctgtggtga

SEQ ID NO: 19871 - RNA, 9876 nt, synthetic construct
  misc_feature 1..9876: note = derived and/or modified CDS sequence (opt5) from DENV-2__FJ687441__SS-prME
  source 1..9876: mol_type = other RNA
agcgccggaatgatcattatgctgatccccaccgtgatggctttccacctcaccacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatggatcacctatggcacgtgtaccacaaccggggagcacagaagagaaaagcggtccgtggcgctcgtgcctcatgtcggaatgggcctggagacacgcaccgaaacgtggatgtctagcgagggcgcttggaagcacgcccagagaattgagacatggatcctgcggcatcccgggttcaccattatggccgctatcctcgcctacacaattggaaccacccactttcagcgcgctctgatcttcattcttctgacagccgtggcgccttccatgacgatgagatgcatcggcatctctaaccgggattttgttgaaggggtgagcggaggctcctgggtcgacattgtgctcgagcacgggagctgtgttaccacaatggccaagaataagcccaccctggatttcgaacttatcaaaacagaggctaagcagcctgccaccctgcgcaaatattgcattgaagctaagctcacgaacacaaccaccgagtctagatgtccgacacaaggagagccctccctgaaagaggaacaagacaagcggtttgtgtgcaagcatagcatggtcgatcgcggctggggcaatgggtgtggactgttcggcaaagggggaatcgtgacctgcgccatgtttacatgcaagaaaaacatggaaggcaagattgtgcagcctgagaatctcgaatacacgatcgtcgttacaccccactctggggaggagcatgcggtgggaaacgacacaggcaaacacggcaaggaaatcaaagtgacccctcagtccagcattacagaggccgaactgaccgggtatggaacggtcaccatggagtgttctcccagaacaggccttgatttcaatgaaatggtgctgctccaaatggagaacaaggcttggctggttcaccggcagtggtttcttgacctgccgctcccttggctgcccggggccgataagcagggatccaattggatccagaaagagaccctggtgacattcaagaaccctcatgctaaaaagcaagacgtcgtggttctcggcagccaggaaggggccatgcacaccgccctgacgggcgctacagagattcagatgtcctctggaaatcttctgtttaccggccatctcaaatgccgcctgagaatggacaaacttcaactgaaggggatgagctactccatgtgtacaggaaaattcaaggtggtcaaagaaatcgcggagacccagcacggcaccattgtgatccgggtccagtatgagggggatggaagcccctgcaagatccccttcgaaattatggacctcgagaaaagatacgtgctgggccgcctgatcacagttaaccctattgtgacggaaaaggattctccggtcaacatcgaggccgaacccccttttggggactcctacattatcattggcgtggagcccggacagctcaagctgaattggttcaaaaagggcagctctatcgggcaaatgtttgagaccacaatgcggggagctaaaagaatggccatccttggcgataccgcctgggacttcgggagcctgggaggcgtttttacatccattgggaaggctctccatcaggtgttcggcgccatctatggagcggctttttctggcgtcagctggaccatgaaaattctgatcggggtgattatcacgtggatcggaatgaactcccgcagcacatctctgtccgtgagccttgttctcgtcggcattgtgaccctgtacctgggggtgatggtccaggccgattctggatgtgtggtttcctggaagaataaggaactcaaatgcggcagcgggatcttcattaccgacaacgtgcacacatggaccgagcagtataagtttcaacctgaatccccctctaaactggccagcgctatccagaaggcccaggaggaaggcatttgtggaatccggtccgtcacaagacttgagaatctgatgtggaaacagatcacgccggagctcaaccacattctggctgaaaatgaggtgaagctgaccatcatgacaggcgatattaaagggatcatgcaagccggaaagcgctctcttcggcctcagcccaccgaactcaagtacagctggaaaacatggggcaaggcgaaaatgctgtccaccgagagccataaccagacgttcctgattgacgggcctgaaaccgccgagtgccccaatacaaacagagcttggaactctctcgaggttgaagattatggatttggcgtgttcaccacaaacatctggctgaaacttaaagagaagcaggacgccttttgtgactccaagctgatgagcgctgccatcaaagataatcgcgcggtccacgccgacatgggctactggattgaatctgctctcaacgatacctggaagatcgagaaagcctccttcattgaggtgaagaattgccattggcctaaaagccacacactgtggtctaacggggttctggaaagcgagatgatcattcccaagaaccttgctggaccggtgtcccaacacaattatcggcctggctaccatacccagatcgccgggccctggcacctcggaaagctggaaatggacttcgatttttgtgacggcacgacagtcattgtgaccgaggattgcgggaacagaggacccagcctgcgcaccacaaccgcctctggcaaactcatcacggaatggtgctgtcggtcctgcacactgcctccgcttagataccggggcgaggacgggtgttggtatggaatggagatccgccccctgaaggaaaaagaggaaaatctcgtgaacagcctggtcaccgctggccatgggcaggttgataatttctccctgggagtgcttggcatggcgctctttctggaggaaatgctgagaacacgggtggggaccaagcacgccattctcctggtcgctgtgtctttcgttacacttatcaccggaaacatgagctttaaagacctgggcagagtggtcgtgatggttggcgccacgatgaccgatgacattgggatgggagtgacatacctcgccctgctggctgccttcaaggtccgccctacctttgcggctggccttctgctccggaagctgacatccaaagagctcatgatgaccacgatcgggattgtgctgctttctcaaagcacaatccccgagaccatcctggaactcacagatgccctggccctgggaatgatggttcttaagattgtgagaaatatggagaaatatcagctggctgtcaccatcatggccattctctgcgtgcctaacgcggtgatcctgcagaatgcttggaaggtctcctgtaccattctcgccgttgtgtctgtgagccccctgcttctgacatccagccagcagaagacggactggatccctctcgccctgaccatcaagggcctgaaccccacagctattttccttaccacactgtctcgcaccaataaaaagagatcctggccgctcaacgaagccatcatggctgtcgggatggtgagcattctggcctcttccctcctgaagaatgacatccctatgacgggaccccttgttgcgggcggcctgctgacagtgtgctacgtcctcaccgggcggagcgccgatctggagcttgaacgcgctaccgacgtgaaatgggaggatcaggccgagatttctggatccagccctatcctgtccattacaatcagcgaagacggctctatgagcatcaagaacgaggaagaggagcagaccctcacaattctgatcagaacggggctcctggttatttccggactttttcccgtgtctatcccgattaccgctgccgcctggtatctgtgggaagtcaaaaagcagcgggctggcgtgctgtgggatgtcccttctccccctcccatggggaaagcggagctcgaagacggagcctaccgcatcaagcaaaagggcatcctgggctattcccagattggggctggagtgtacaaagagggcacattccataccatgtggcacgttacaagaggggccgtgcttatgcacaagggaaaacggatcgaaccctcctgggccgatgtcaagaaagacctgattagctacggcgggggatggaagctcgagggcgagtggaaggaaggcgaggaagtgcaggttctggctctcgagcctgggaaaaatccgcgcgccgtgcagaccaagcccggactgtttaaaacgaacaccggcacaatcggggcggtctcccttgatttctctcctggaaccagcggctcccccattatcgacaagaaagggaaggtggtgggactgtatggcaacggcgttgtcacaagaagcggggcttacgtgtctgccatcgcccaaaccgaaaagtccattgaggataatcctgagatcgaagacgatatttttcggaaacgcagactgacaatcatggacctccatcccggagctggcaagacgaaacggtatctgcctgccattgtgagagaggcgatcaagcgcgggcttcggaccctgattctcgctccgacaagagtcgtggccgccgaaatggaggaagctctgcgcggactccccatccggtaccagacccctgccatcagagctgagcacaccggccgcgagattgttgacctgatgtgtcatgccacattcacgatgcggcttctgagccccgtgagagtccctaactataatctgatcattatggatgaagcgcacttcaccgaccccgcctctatcgctgcccgcgggtacatttccacacgggtggagatgggcgaagctgccggaatctttatgaccgccacaccgcctggcagcagagatcccttcccccagtccaacgctcctatcattgacgaggagcgggaaatccccgagcgctcttggaatagcgggcatgaatgggttaccgattttaaaggaaagacggtgtggttcgtcccttccattaaggcgggcaacgacatcgccgcttgcctccgcaagaatgggaagaaagtgattcaactgagccggaagacatttgattctgagtatgttaaaacccgcaccaacgactgggatttcgtggtcacaaccgacatctccgaaatgggagccaattttaaggccgagagagtgatcgatccgcggagatgtatgaaacccgtgattcttacagacggcgaggaacgcgtcatcctggctgggcctatgcccgttacccacagctctgccgcgcagcggagaggccgcattggacggaaccctaagaatgagaacgaccagtacatctacatgggcgaacccctcgagaatgatgaagactgcgctcactggaaggaggccaaaatgctgctggataacattaatacgccggaggggatcattcctagcatgttcgaacccgagagagaaaaggtggacgccatcgatggagagtatcgcctccggggcgaagctagaaaaacatttgtggaccttatgcgcagaggggatctgcctgtctggctggcctacaaggtggcggccgagggaatcaactatgctgaccggcgctggtgtttcgatggcattaaaaacaatcagatcctcgaggaaaacgttgaggtggaaatttggaccaaggagggggagagaaagaaactgaagccccggtggcttgacgcccgcatctactccgatcctctggctctcaaagaatttaaggagttcgccgctggcagaaaatctctgacactgaatctcattaccgaaatgggacggcttcccacgttcatgacccaaaagacaagagacgccctggataacctggcggtcctccataccgccgaggctggcgggcgcgcctataatcacgctctgagcgaacttccggagacactggagaccctcctgctgctcacacttctggccaccgtgacgggaggcatctttctgttcctcatgtccgggcggggaatcggcaagatgacactgggcatgtgctgcattatcaccgcctctattcttctgtggtacgctcagatccagcctcattggattgcggccagcatcatcctcgaatttttcctgattgttctgctcatccccgagcccgaaaaacagagaacccctcaagacaaccagcttacatatgtggtcattgctatcctgaccgtggtcgccgccacaatggctaatgagatggggtttctggaaaagacgaaaaaggacctcggactgggctccattgccacccagcagccggagagcaacatccttgatattgacctgcgccccgcgtctgcctggacactctacgctgtggccaccacattcgttacccctatgctgcggcactccatcgagaatagctccgtgaacgtgtctctgacggctatcgccaatcaagcgaccgtcctcatggggcttggaaaaggctggcccctgagcaagatggatattggggttcctctgctcgccatcggatgttactcccaggtgaaccccattacactgaccgctgcccttctgctcctggtggctcactatgccatcattggccctggcctgcaggctaaggccacaagagaagcgcagaaacgggccgctgccgggatcatgaagaatccgaccgtcgacggaatcacggtgattgatctcgaccccatcccttacgatcccaaatttgagaagcaacttggccaggttatgctgctgattctctgcgtgacacaggtcctgatgatgcgcaccacatgggctctttgtgaagccctgaccctcgccaccgggcctatctctacactgtgggagggaaaccccggcagattctggaatacgaccattgcggtgagcatggctaacatctttcgggggtcctatctggccggagctggcctccttttcagcatcatgaaaaatacaaccaacacacgcagaggcaccgggaacattggagaaacgctgggcgagaagtggaaatctcggctgaatgccctcgggaagtccgagtttcaaatctacaagaaaagcggcattcaggaagtcgaccgcacactggccaaggagggcatcaaaagaggggaaaccgatcatcacgctgtgtctcggggatccgccaaacttcgctggttcgttgagagaaacatggtgaccccggagggcaaagtcgtggacctgggctgcgggcggggaggctggagctattactgtgggggactcaagaatgttagagaagtgaagggcctgacaaaagggggacctggccatgaggaacccattcccatgtctacctatggctggaacctggtccgcctccagagcggggtggatgtgtttttcatccctcccgagaagtgcgacacacttctgtgtgatatcggagaatcctctcctaatccgacggttgaggcgggccggaccctgagagtcctcaacctggtggagaattggcttaacaataacacacagttctgcattaaagtgctgaatccctacatgcctagcgtcatcgaaaagatggaggccctccaacgcaaatacgggggagctctggttcggaaccccctgtccagaaatagcacccacgaaatgtattgggtgtccaacgcctctggcaatattgtgagctccgtcaacatgatctctcgcatgctcattaaccggtttacaatgagacataagaaggctacctacgagcctgacgtggaccttgggagcggaacgcgcaatatcggcattgaatccgagatccccaacctggatatcattggcaaacggatcgagaagattaaacaggaacacgagacctcttggcactatgaccaggatcatccgtacaagacatgggcctatcacgggagctacgaaaccaaacagacaggatccgcgagctctatggttaatggcgtggtcagactgctcaccaagccttgggacgtgctgcccacagttacccaaatggccatgacggatacaacccctttcgggcagcagcgcgtgtttaaggagaaagtcgacacccggacacaggaacccaaggagggaacgaagaaacttatgaaaatcaccgctgagtggctgtggaaagaactcggcaaaaagaagacacctagaatgtgtacccgcgaggagttcacaagaaaagtgcggtccaacgccgctctgggggccatttttaccgatgagaataagtggaaaagcgctcgcgaggccgtggaagactctagattctgggagctggtcgataaggaacggaacctccatctggagggaaaatgcgaaacatgtgtttataatatgatgggcaagagagagaagaaacttggcgagtttgggaaggcgaaaggatcccgggccatctggtacatgtggctgggcgctcgcttcctcgaatttgaggccctggggttccttaacgaagaccactggtttagcagagaaaattctctgtccggagtggaaggcgaggggctccacaagctgggctacatcctgcgggatgtgagcaaaaaggagggaggcgctatgtatgccgacgacaccgccgggtgggatacgcgcattaccctcgaagacctgaagaacgaggaaatggtcacaaatcatatggagggagaacacaagaaacttgcggaggctatcttcaaactgacctaccaaaacaaagtggttagagtgcagcggcccacaccgcgcggcaccgtcatggatattatctccagacgggaccagcgcgggagcggacaagtgggcacgtatgggctcaatacatttaccaacatggaggcccagctgattagacagatggaaggcgagggagttttcaaaaatatccagcatcttacagccaccgaagagatcgctgtgcaaaactggctggcccgggtcggccgcgagagactctctcggatggctattagcggggatgactgcgtggttaagcctctggatgaccgcttcgccaacgcgctgacggccctcaatgatatgggaaagatcagaaaagacattcagcagtgggaaccctccaagggctggaacgattggacccaggtgcccttttgctctcaccatttccacgagctgatcatgaaagacgggcgggtccttgtggtcccttgtagaaatcaagatgaactgattggacgcgctcggatcagccagggcgccgggtggtccctcagagagacagcttgcctgggcaagtcttacgcccagatgtggagccttatgtattttcaccgccgggacctgagactcgcggccaacgctatttgttccgccgtgccgtctcattgggttcccaccagccgcacaacctggtccatccacgctaaacatgaatggatgacaaccgaggacatgctgacggtgtggaatcgggtctggatcagagagaacccttggatggaagataagacacccgtggagagctgggaagagattccttacctgggaaagcgcgaagaccagtggtgcggctctctcatcgggctgacctcccgggccacctgggctaaaaatattcaagccgcgatcaaccaggtgagaagccttattggaaatgaggagtatacagattacatgccctctatgaagcgcttccggagagaagaggaagaggccggcgttctgtggtga

SEQ ID NO: 19872 - RNA, 9876 nt, synthetic construct
  misc_feature 1..9876: note = derived and/or modified CDS sequence (opt5) from DENV-2__FJ687445__SS-prME
  source 1..9876: mol_type = other RNA
agcgtgggaatgatcattatgctgatccccaccgtgatggccttccacctcacgacgcggaatggggagcctcatatgattgtttccatccaggaaaagggaaaatctctgctttttaagaccgaggacggagtgaatatgtgcacactgatggctatggatctcggggaactgtgtgaggacaccattacatacaaatgcccgcttctgcggcaaaacgaacccgaggatatcgactgttggtgcaattccacctccacatgggtgacctatggaacgtgtaccacaaccggcgagcaccgcagagaaaagcggtctgtcgccctcgtgcctcatgttgggatgggactggagacacgcaccgaaacgtggatgagctccgagggcgcgtggaaacacgctcagagaatcgagacatggattctgcggcatcccggcttcaccatcatggccgccattctcgcttacacaatcgggaccacccactttcagcgcacactgattttcatccttctgacggccgtggctccttctatgaccatgagatgcattggaatcagcaaccgggattttgtcgaaggcgtgtccgggggaagctgggttgacatcgtgctcgagcacggctcttgtgtcacaaccatggccaagaataagcccacactggatttcgaacttattaaaaccgaggcgaagcagcctgccacgctgcgcaaatattgcatcgaagctaagctcacaaacaccaccacagagtccagatgtccgacccaaggggagcccagcctgaaagaagaacaggacaagcggtttgtgtgcaagcattctatggtggatcgcggatggggcaatggctgtgggctgttcggaaaaggcgggattgtcacatgcgccatgtttacgtgcaagaaaaacatggaaggaaagatcgttcagcctgagaatctcgaatacaccattgtggtgacaccccactccggcgaggagcatgctgtcgggaacgacaccggaaaacacggcaaggaaatcaaagtgacacctcagagctctatcaccgaggccgaactgacgggctatgggaccgttacaatggagtgttcccccagaaccggacttgatttcaatgaaatggtgctgctccaaatggagaacaaggcgtggctggtccaccggcagtggtttcttgacctgccgctcccttggctgcccggcgccgatacacaggggagcaattggattcagaaggagaccctggtgacgttcaaaaaccctcatgctaagaaacaagacgttgtggtcctcggatcccaggaaggcgccatgcacacagctctgaccggggccacagagatccagatgtctagcggcaatcttctgtttaccggacatctcaagtgccgcctgagaatggacaaacttcaactgaagggcatgtcctacagcatgtgtaccgggaagttcaaagtggtcaaggaaattgccgagacacagcacggaacgatcgtgattcgggttcagtatgagggcgatgggtctccctgcaaaatccccttcgaaatcatggacctcgagaagagatacgtgctgggacgcctgattaccgtcaaccctatcgtgacagaaaaagattccccggttaacattgaggctgaacccccttttggcgacagctacatcattatcggggtggagcccggccagctcaagctgaattggttcaagaaaggatctagcattggccaaatgtttgagaccacaatgagaggggcgaagagaatggccatccttggagataccgcttgggacttcggctccctcggcggggtctttacgtctatcgggaaagccctccatcaggtgttcggggccatttatggcgctgcctttagcggagtgtcctggacaatgaagatcctgattggcgttatcattacctggatcgggatgaacagccgctctacctccctgagcgtctctcttgtgctcgtgggagtcgtgacactgtacctgggcgttatggtgcaggcggattccgggtgtgtcgtgagctggaaaaataaggaactcaagtgcggatccggcatcttcattaccgacaacgttcacacatggacggagcagtataaatttcaacctgaatctcccagcaagctggcttccgccatccagaaagcccaggaggaagggatttgtggcatccggtctgtgaccagacttgagaatctgatgtggaagcagattacaccggagctcaaccacatcctggctgaaaatgaggtcaaactgaccatcatgacaggagatattaagggcatcatgcaagccgggaaacgcagccttcggcctcagcccaccgaactcaagtactcctggaagacgtggggaaaagctaagatgctgagcaccgagtctcataaccagacattcctgattgacggccctgaaaccgccgagtgccccaatacaaacagagcgtggaactccctcgaggtggaagattatgggtttggagttttcaccacaaacatctggctgaaacttaaggagaaacaggacgccttttgtgacagcaagctgatgtctgctgccattaaggataatcgcgctgtgcacgccgacatgggctactggatcgaatccgcgctcaacgatacctggaaaatcgagaaggccagcttcattgaggtcaaaaattgccattggcctaagtctcacacgctgtggagcaacggcgtgctggaatccgagatgatcattcccaaaaaccttgctgggccggtgagccaacacaattatcggcctggataccatacacagatcgccggcccctggcacctcgggaagctggaaatggacttcgatttttgtgacggaaccaccgtcgttgtgacagaggattgcggcaacagagggccctctctgcgcaccacgacagcttccggaaagctcattaccgaatggtgctgtcggagctgcacactgcctccgcttagataccggggcgaggacggctgttggtatgggatggagatccgccccctgaaagaaaaggaggaaaatctcgtgaactccctggtcaccgccggacatggccaggtggataatttctctctgggggttcttggaatggccctctttctggaggaaatgctgagaacacgggtgggcaccaaacacgctattctcctggtcgcggtgagcttcgttacgcttatcaccgggaacatgtcctttaaggacctgggaagagtggtcgtgatggttggcgccacaatgaccgatgacatcggcatgggggtgacatacctcgctctgctggccgccttcaaagtccgccctacctttgctgccggacttttcctgcggaagctcacgtctaaggagctgatgatgacaaccattggcatcgtgctcctgagccaatccacaattcccgagaccatccttgaactgaccgatgcgctcgctctggggatgatggtgctgaaaatggtcagagacatggagaagtatcagcttgccgttacaattatggccatcctgtgcgtgcctaatgctgtgatcctccagaacgcctggaaagtctcttgtacgattctggcggtggttagcgtgagccccctgctgcttaccagctctcagcaaaagacagactggatccctctggctctcaccattaaaggactgaatcccacagccatctttctgaccacgctttcccgcacaaacaagaaaagaagctggccgctgaatgaagccattatggctgtcggcatggtgtctatcctcgcctccagcctgctcaagaacgatatccctatgaccgggcccctggttgctggaggccttctgaccgtgtgctacgtcctgacaggccggtctgccgacctcgagctggaacgcgcgaccgatgtgaagtgggaggaccaggccgagatttccgggagctcccctatccttagcattacaatctctgaagatggaagcatgtccattaaaaatgaggaagaggagcagacgctgaccatcctcattagaacaggcctgctcgtcatctctgggctgttccccgtgagcatcccgattaccgctgccgcttggtatctttgggaagttaagaaacagcgggccggagtgctgtgggacgtcccttctccccctcccatgggcaaggccgagctggaagatggggcttaccgcatcaaacaaagaggcattctcggctatagccagatcggcgcgggggtgtacaaggagggaacatttcataccatgtggcacgttacgcggggcgccgtgctgacccacaaggggaaacgcattgaacccagctgggctgacgtcaagaaagatcttatctcctacggaggcgggtggaagctggagggagagtggaaagaaggcgaggaagtccaggtgctcgccctggagcctggcaagaacccgagagccgttcagacaaagcccggactcttcaaaaccaatacaggaaccatcggcgctgtctctctggactttagccctgggacatccggaagccccattatcgataagaaaggcaaggtggtggggctttatggaaacggcgtcgtgacgcggtctggcgcctacgtttccgcgattgctcaaaccgagaagtccatcgaggacaaccctgatattgaggacgacatcttccgcaagagacggctgacaatcatggatctgcatcccggggccggaaagaccaaaagatatctccctgccattgtgcgcgaagctatcaagcggggcctgagaacccttattctggccccgacacgcgtcgtggcggctgagatggaagaggccctccgggggctgcccatcagataccagacgcctgccattcgcgctgaacacaccggacgggagatcgttgacctcatgtgtcatgccacattcaccatgagactgctttctcccgtgcgcgtccctaattataacctgattatcatggatgaggctcactttacagaccccgcctccatcgcggcccggggctacattagcaccagagtggaaatgggggaggctgccggcatcttcatgacggctacaccgcctggatcccgggatccctttccccagtctaatgcccctattatcgacgaagaacgcgagattcccgaaagaagctggaactccggccatgagtgggttaccgatttcaaagggaagaccgtgtggtttgtccctagcatcaaagccggaaatgacatcgctgcgtgcctgcggaagaacggcaagaaagtgattcaactctctcgcaagacattcgattccgaatatgtgaaaaccagaacaaatgactgggattttgtcgttaccacggacatcagcgagatgggggccaacttcaaggctgaacgggtgattgacccgagacgctgtatgaaacccgtgatcctgacagatggagaggagcgggtcattcttgccggccctatgcccgtgacccactctagcgccgctcagagacgcgggcggatcggcagaaatcctaagaacgaaaatgaccagtacatctacatgggagagcccctggaaaacgatgaggactgcgcccactggaaagaagcgaagatgctcctggataatattaacacaccggagggcatcattccttccatgtttgagcccgaacgcgagaaggttgacgctatcgatggggaatatcggctgagaggagaggcccgcaaaaccttcgtggacctcatgagacggggcgatcttcctgtctggctggcctacaaggtggctgccgaagggattaattatgcggaccgcagatggtgttttgatggaatcaaaaacaaccagattctggaggagaatgttgaagtggagatctggacgaaggaaggcgagcggaaaaagctcaagccccgctggctggacgccagaatctactctgatcctcttgctctgaaagagttcaaggagttcgccgctgggcggaaaagcctcaccctgaacctgattacagagatgggcagactccccacctttatgacacaaaagacccgcgacgcccttgacaatctggctgtcctgcatacagccgaagcgggaggccgggcctataaccacgctctctccgagctgccggaaacccttgagacgctgctcctgctgacactccttgccaccgtgaccgggggaatcttcctgtttctgatgtctggcagagggattggaaaaatgacactcggcatgtgctgcatcgtcaccgctagcattctgctttggtacgcccagatccagcctcattggatcgccgcttccattatcctggagttctttctcattgtgctgctgatccccgaacccgagaagcagcgcacacctcaagataatcagctcacgtatgttgtgattgcgatccttaccgtggtcgccgctacaatggccaacgaaatgggcttcctggagaagaccaaaaaggacctggggctcggaagcatcgccacacagcagccggaatctaatattctggatatcgaccttcggcccgcttccgcctggaccctgtacgcggttgccacgacctttgtgacacctatgctcagacacagcattgagaactcctctgtgaatgtcagcctgaccgctatcgccaaccaagctacagtgctgatgggcctcgggaaaggatggcccctttccaagatggatattggcgcccctctgctggcgatcgggtgttactctcaggttaatcccattaccctcacggccgctctgcttctgctcgtggcccactatgctatcatcggacctggcctgcaggccaaagctacacgggaggcccagaagcgcgcggccgctggcattatgaagaacccgaccgtcgacgggatcacagtgattgatctggaccccatccctcatgatcccaaattcgaaaagcaactcggacaggtcatgcttctggtgctgtgcgttacccaggtgctcatgatgagaaccacatgggccctgtgtgaggctcttacgctggccaccggccctattagcacactctgggaagggaatcccggacggttttggaacaccacaatcgccgtctccatggcgaatatcttccgcggcagctacctggctggggccggactgctcttttctattatgaaaaacaccacaaattccagacggggcacaggcaacatcggggagacccttggagaaaagtggaaaagccgcctgaacgctctgggcaagtctgagttccaaatttataaaaagtccgggatccaggaggtggacagaaccctcgccaaggaaggaattaaacggggcgagacagatcaccatgccgttagccgcgggtctgctaagctgagatggtttgtggaacggaatatggtcaccccggagggaaaagtggtggaccttggctgcggcagagggggatggagctactattgtggcgggctgaagaacgttcgcgaggtcaaaggactcacaaagggcgggcctggacacgaagaacccatccccatgtccacgtacggctggaatctggtgcggctgcagtctggcgtggatgtcttcttcatccctcccgaaaagtgcgacaccctcctttgtgacattggggagagctcccctaacccgacagttgaagccggaagaaccctgcgcgtgctgaatctcgtggagaactggctgaataacaatacacagttttgcatcaaagtccttaacccctatatgcctagcgtgattgagaagatggaaaccctgcaacggaaatacggcggggcgctcgttagaaatcccctgtcccgcaactctacgcatgagatgtactgggtgagcaatgcctccggaaacatcgtctctagcgtgaatatgatttcccggatgctgatcaacagattcaccatgcgccacaagaaagctacatatgaacctgatgttgacctcggctctgggacccggaacatcggaattgagagcgaaatccccaatcttgatattatcggcaagagaattgagaagatcaaacaggagcacgaaacatcctggcattacgaccaggatcacccgtataagacctgggcctaccatggcagctatgagacaaaacagaccgggtctgcttccagcatggtgaacggagtcgtgcgcctgctgacgaagccttgggacgtgctccccacagtcacccaaatggccatgaccgatacaacgccttttggccagcagcgggttttcaaagaaaaggtggacaccagaacacaggagcccaaggaagggaccaaaaagctgatgaaaattacagcggagtggctttggaaggagctgggcaaaaagaaaacccctcgcatgtgtacaagagaagagtttacccggaaggtgcgctctaatgccgctctcggcgccatcttcacggatgaaaacaagtggaaatccgctagagaggccgtcgaggacagccggttttgggaactggtggataaggagagaaatctgcacctcgaagggaaatgcgagacctgtgtttacaacatgatgggaaagcgggagaaaaagctgggcgagttcggcaaggctaaagggtctcgcgccatctggtatatgtggcttggagcgagatttctggagttcgaagccctcggctttctgaatgaggaccactggttctcccgggaaaacagcctttccggggtggagggagaaggcctgcatcgcctcgggtacattctgagagacgtcagcaagaaagagggcggagctatgtacgccgatgacacagctggctgggatacccggatcacactggaggacctcaagaatgaagagatggtgaccaaccacatggaaggggagcataaaaagctggccgaagccatttttaaacttacgtatcaaaataaagttgtgcgcgtccagagacccacaccgcggggaaccgtgatggatatcatttctcgcagagaccagcggggcagcgggcaagttggaacatacggcctgaacaccttcacgaatatggaggcgcagctcatccgccagatggagggggaaggcgtgttcaagaacatccagcacctgaccgtcacagaggaaattgctgtgcaaaattggcttgccagagtcggacgggagcgcctgtccagaatggccatctctggcgatgactgcgtggttaaacctctcgatgaccggtttgctagcgccctgaccgctctgaacgatatggggaagattagaaaagacatccagcagtgggagccctcccgcggatggaacgattggacacaggtgcccttctgctctcatcactttcacgaactcattatgaaggacggccgggtcctggtggtgccttgtagaaatcaagacgagcttatcgggcgcgcccggatcagccagggagcgggctggtccctgagagaaaccgcctgcctcgggaagtcttatgctcagatgtggagcctgatgtacttccatcgccgggatcttagactggccgctaacgccatttgttccgcggttccgagccactgggtgcccacatctcgcaccacgtggtccatccatgccaaacacgagtggatgacaaccgaagacatgctcaccgtctggaatcgggtgtggattcaggagaacccttggatggaggataagacacccgttgaaagctgggaggaaatcccttatctgggcaaaagagaggaccaatggtgcggatctctgattggcctcacctcccgcgctacatgggccaagaatatccaggtggctattaaccaggtccggagcctgatcgggaatgaagagtacacggattatatgccctccatgaaaagatttcggagagaggaagaggaagccggagtgctttggtga

SEQ ID NO: 19873 - RNA, 9876 nt, synthetic construct
  misc_feature 1..9876: note = derived and/or modified CDS sequence (opt5) from DENV-2__FJ687447__SS-prME
  source 1..9876: mol_type = other RNA
agcgctggcatgatcattatgctgatccccacagtgatggctttccaccttacaacgagaaatggggagcctcatatgattgtcggaatccaggaaaagggcaaatccctgctttttaagacagaggacggggttaatatgtgcacactgatggccatggatctcggagaactgtgtgaggacaccattacatacaaatgcccgcttctgcggcaaaatgaacccgaggatatcgactgttggtgcaattctacctccacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacatcccttgatttcaatgaaatggttctgctccaaatggagaacaaggcttggctggtgcaccggcagtggtttcttgacctgccgctcccttggctgcccggcgccgataagcaggagagcaattggattcagaaagaaaccctggtcacattcaagaaccctcatgctaaaaagcaagacgtggttgtgctcgggtcccaggagggagccatgcacaccgccctgacgggcgctacagaaatccagatgtctagcgggaatcttctgtttaccggccatctcaaatgccgcctgagaatggacaaacttcaactgaagggaatgtcctacagcatgtgtacaggcaaattcaaggtcgtgaaagagattgcggagacccagcacgggaccatcgtcattcgggtgcagtatgaaggagatggctctccctgcaagatccccttcgagatcatggacctcgagaagcggtacgttctggggcgcctgattacagtgaaccctatcgtcacggagaaggattccccggtgaacattgaagccgagcccccttttggagacagctacatcattatcggcgttgagcccgggcagctcaagctgaattggttcaaaaagggctctagcattggacaaatgtttgaaaccacaatgcggggcgctaaaagaatggccatccttggggataccgcctgggacttcggatccctgggcggggtgtttacatctatcggaaaggctctccatcaggtcttcggcgccatttatggggcggcttttagcggcgtgtcctggaccatgaaaatcctgattggagtgatcattacgtggatcggcatgaacagccgctctacatccctgagcgtttctcttgtcctcgtggggatcgtgaccctgtacctgggagtcatggtgcaggccgattccggctgtgttgtgagctggaagaataaggagctcaaatgcgggtccggaattttcatcaccgacaacgtccacacatggaccgaacagtataagtttcaacctgagtctcccagcaaactggcctccgctattcagaaggcccaggaagagggcatctgtgggattcggtctgtgacaagacttgagaatctgatgtggaaacagatcacgccggaactcaaccacatcctggctgagaatgaagttaagctgaccattatgacaggcgatatcaaaggaattatgcaagccggcaagcgcagccttcggcctcagcccaccgagctcaagtactcctggaaaacatgggggaaggcgaaaatgctgagcaccgaatcttataaccagacgttcctgatcgacggacctgagaccgccgagtgccccaatacaaacagagcttggaactccctcgaagtggaggattacggctttggggtcttcaccacaaacatttggctgaaacttaaagaaaagcaggacgccttttgtgacagcaagctgatgtctgctgccatcaaagataatcgcgcggtgcatgccgacatgggatattggatcgagtccgctctcaacgatacctggaagattgagaaagccagcttcatcgaagttaagaattgccactggcctaaatctcatacactgtggagcaacggcgtgctggagtccgaaatgattatccccaagaaccttgctggcccggtcagccaacacaattaccggcctgggtaccacacccagattgccggaccctggcatctcggcaagctggagatggacttcgatttttgtgacgggacgacagtgatcgtgaccgaagattgcggaaacagaggcccctctctgcgcaccacaaccgcctccgggaaactcattacggagtggtgctgtcggagctgcacactgcctccgcttagatatcggggagaggacggctgttggtacggcatggaaatccgccccctgaaggagaaagaagagaatctcgtcaactccctggttaccgctgggcacggacaggtggataatttctctctgggcgtgcttgggatggcgctctttctggaagagatgctgagaacacgggtcggaaccaagcatgccatcctcctggtggctgttagcttcgtgacacttattaccggcaacatgtcctttaaagacctggggagagtcgtggttatggtgggagccacgatggccgatgacatcggcatgggcgtcacctatctcgctctgctggccgcgttcaaggtgcgccctacatttgctgccgggcttctgctccggaagctgacctctaaagagctcatgatgacaaccattggaatcgttctgcttagccaatccacgattcccgaaacaatcctggagctcaccgatgccctggctctgggcatgatggtgcttaagatcgtcagaaatatggaaaaataccagctggccgtgacaattatggcgatcctctgcgtgcctaacgctgtcattctgcagaatgcctggaaggtttcttgtaccatcctcgccgtggtgagcgtcagccccctgcttctgaccagctctcagcagaagacggactggattcctctcgctctgacgatcaaggggctgaaccccaccgccatcttccttacaaccctgtcccgcacaaataaaaagagaagctggccgctcaacgaggctattatggccgtgggaatggtttctatcctggcgtccagcctcctgaagaatgacattcctatgaccggcccccttgtggccgggggactgctgacggtctgctatgtgctcacaggccggtctgctgatctggaacttgagcgcgccaccgacgttaaatgggaggatcaggctgaaatctccggcagctcccctattctgagcatcaccatttctgaggacgggagcatgtccatcaagaacgaagaggaggaacagacactcaccatcctgattagaacaggactcctggtgatctctggcctttttcccattagcatcccgattacggccgccgcttggtacctgtgggaggtcaaaaagcagcgggcgggggtgctgtgggatgtcccttctccccctcccatcggaaaagccgaactcgaggacggcgcttatcgcatcaagcaaaaggggattctgggatacagccagatcggcgccggcgtgtacaaagaagggaccttccacacaatgtggcatgttaccagaggagccgtgcttatgcacaagggcaaacggattgagcccagctgggctgatgtcaagaaagacctgatctcctatgggggaggctggaagctcgagggggaatggaaggagggagaagaggtgcaggttctggccctcgaacctggcaaaaatccgcgcgcggtgcagacaaagcccggcctgtttaaaaccaacacggggaccattggagctgtctctcttgatttcagccctggcacatccgggagccccatcatcgacaagaaaggaaaggtggtgggcctgtacgggaacggagttgtcaccagatctggcgcctatgtgtccgccattgctcaaacagaaaagtccatcgaggataatcctgaaattgaggacgatatctttcggaaacgcagactgaccattatggacctccaccccggcgccgggaagacaaaacggtacctgcctgcgatcgtgagagaagctattaagcgcggacttcggacgctgatcctcgccccgaccagagtcgtggccgctgagatggaagaggccctgcgcggcctccccatccggtatcagacccctgctattagagccgagcataccgggcgcgaaatcgttgacctgatgtgtcacgcgaccttcacaatgcggcttctgtctcccgtgagagtccctaactacaatctgattatcatggatgaggcccatttcacggaccccgcttccattgccgctcgcggatatatcagcacccgggtggaaatgggcgaggccgccgggatctttatgacagctaccccgcctggctccagagatcccttcccccagtctaacgcgcctattatcgacgaggaacgggagattcccgaacgcagctggaactccggacacgagtgggttacagattttaaaggcaagaccgtgtggttcgtccctagcatcaaggccgggaacgacattgctgcctgcctccgcaagaatggaaagaaagtgatccaactgtctcggaagacgtttgattccgaatacgttaaaacacgcaccaacgactgggatttcgtggtcaccacagacatcagcgagatgggcgccaattttaaggctgagagagtgattgatccgcggagatgtatgaaacccgtgatccttaccgacggggaagaaagagtcattctggccggacctatgcccgttacacattctagcgcggctcagcggagaggccgcatcgggcggaaccctaagaatgaaaacgaccagtacatttatatgggcgagcccctcgaaaatgatgaggactgcgcccactggaaggaggccaaaatgctgctggataacatcaataccccggaaggaattatcccttccatgttcgagcccgaaagagagaaggtggacgctatcgatggcgaataccgcctcagaggggaagccagaaaaacgtttgtggaccttatgcgcagaggagatctgcctgtctggctggcgttcaaggtggccgctgagggcattaactatgccgaccggcgctggtgttttgatgggatcaaaaacaatcagattctcgaagagaacgttgaagtggagatctggacaaaggagggagaaagaaagaaactgaagccccggtggcttgacgctcgcatttactctgatcctctggccctcaaagagttcaaggagttcgctgccggcagaaaaagcctgaccctgaatctcatcacagagatggggcggcttcccacctttatgacgcaaaagaccagagacgcgctggataacctggccgtcctccacacagctgaagccggcggacgcgcttataatcatgccctgtccgagcttccggagaccctggaaacactcctgctgctcacccttctggccacagtgaccggcgggatcttcctgtttctcatgtctggacggggcattgggaagatgacgctgggaatgtgctgcatcattacagctagcatccttctgtggtacgcgcagattcagcctcactggatcgccgcttccatcattctcgagttctttctgatcgttctgctcattcccgaacccgagaaacagagaacccctcaagacaaccagcttacctatgtggtcatcgccattctgacagtggtcgccgctaccatggccaatgaaatgggcttcctggagaagaccaagaaggacctcggcctggggagcatcgcgacgcagcagccggagtctaacattcttgatatcgacctgcgccccgcctccgcttggaccctctacgccgtggctacaacctttgttacacctatgctgcggcatagcatcgaaaattcctctgtgaacgtgagcctgaccgccattgcgaatcaagccacggtcctcatgggacttggcaaagggtggcccctgtccaagatggatatcggagttcctctgctcgctattggctgttactctcaggtgaaccccatcaccctgacagccgcccttctgctcctggtggcccactatgctattatcgggcctggactgcaggccaaggcgaccagagaggcccagaaacgggctgccgctggcatcatgaagaatccgacagtcgacggcattaccgtgatcgatctcgaccccattccttacgatcccaaattcgaaaagcaacttgggcaggttatgctgctgatcctctgcgtgacgcaggtcctgatgatgcgcacaacctgggccctttgtgaggccctgacactcgcgaccggacctattagcaccctgtgggaaggcaaccccgggagattttggaatacaacgatcgctgtgtccatggccaacatcttccggggaagctatctggctggcgccgggctcctcttttctattatgaaaaataccacaaacacccgcagaggaacaggcaacatcggcgagaccctgggggagaagtggaaatcccggctgaatgccctcggaaagagcgagttccaaatttacaagaaatctggcatccaggaggtcgaccgcacgctggctaaggaagggattaaaagaggagagacagatcaccatgccgtgtcccggggcagcgcgaaacttcgctggtttgttgagagaaacatggtgaccccggaagggaaagtcgtggacctgggatgcggccggggcgggtggtcttattactgtggaggcctcaagaatgttagagaggtgaaggggctgaccaaaggaggccctgggcacgaggaacccatccccatgagcacatatggatggaacctggtccgcctccagtccggcgtggatgtgttcttcatccctcccgaaaagtgcgacacccttctgtgtgatattggcgagtctagccctaatccgacagttgaggccgggcggacgctgagagtcctcaacctggtggaaaattggcttaacaataacacccagttttgcatcaaagtgctgaatccctacatgccttccgtcattgagaagatggaagctctccaacgcaaatacggaggcgccctggttcggaaccccctgagcagaaattccacacatgagatgtattgggtgtctaacgctagcgggaatatcgtgtcctctgtcaacatgattagccgcatgctcatcaaccggttcaccatgagacacaagaaggccacatacgaacctgacgtggaccttggatccggcacccgcaatattgggatcgagtctgagatccccaacctggatattatcggaaaacggattgaaaagatcaaacaggagcatgaaacgagctggcactatgaccaggatcacccgtacaagacctgggcgtatcatggctcctacgagacaaaacagaccggcagcgcctcttccatggttaatggggtggtcagactgctcacaaagccttgggacgtgctgcccaccgttacacaaatggctatgaccgatacgacaccttttggacagcagcgcgtgttcaaggaaaaagtcgacacccggacccaggagcccaaggagggcaccaagaaacttatgaaaattacggccgaatggctgtggaaggagctcgggaaaaagaagacccctagaatgtgtacacgcgaagagtttaccagaaaagtgcggagcaacgctgccctgggagctatcttcacagatgagaataagtggaaatctgcccgcgaagcggtggaggactccagattttgggaactggtcgataaggagcggaacctccacctggaaggcaaatgcgagacctgtgtttataatatgatggggaagagagagaagaaacttggagagttcggcaaggccaaaggcagccgggctatctggtacatgtggctgggggcccgctttctcgagttcgaagctctgggatttcttaacgaggaccattggttctctagagaaaattccctgagcggcgtggagggggagggactccacaagctgggctacattctgcgggatgtgtccaaaaaggaagggggcgccatgtatgccgacgacacagcgggatgggatacccgcatcacgctcgaggacctgaagaacgaagagatggtcaccaatcacatggaaggcgagcataagaaacttgctgaggccatttttaaactgacataccaaaacaaagtggttagagtgcagcggcccaccccgcgcgggacagtcatggatatcattagcagacgggaccagcgcggatctggccaagtggggacctatggactcaatacgttcacaaacatggaagcccagctgatcagacagatggagggcgaaggggttttcaaaaatatccagcaccttaccgtgacagaggaggtcgctgtgcaaaactggctggcccgggttggccgcgaaagactcagccggatggctatttccggagatgactgcgtggtcaagcctctggatgaccgctttgccaacgcgctgaccgccctcaatgatatgggcaagatcagaaaagacattcagcagtgggagccctctaaggggtggaacgattggacacaggtgcccttctgcagccatcactttcatgaactgatcatgaaagacggacgggtccttgtggttccttgtagaaatcaagatgagctgattggccgcgctcggatctcccagggggccggatggtctctcagagaaaccgcttgcctgggcaagagctacgcccagatgtggtcccttatgtatttccaccgccgggacctgagactcgcggccaacgctatttgttctgccgtgccgagccactgggtccccacatcccgcaccacatggagcatccatgctaaacacgagtggatgaccacagaggacatgctgaccgtgtggaatcgggtgtggatcagagaaaacccttggatggaggataagacgcccgttgaatcttgggaggaaattccttacctggggaagcgcgaggaccagtggtgcggctccctcatcggactgacaagccgggccacctgggctaaaaatattcaagccgcgatcaaccaggtgagatctcttattggcaatgaggaatataccgattacatgccctccatgaagcgctttcggagagaggaagaggaagccggggtcctgtggtga

SEQ ID NO: 19874 - RNA, 9876 nt, synthetic construct
  misc_feature 1..9876: note = derived and/or modified CDS sequence (opt5) from DENV-2__FJ810411__SS-prME
  source 1..9876: mol_type = other RNA
agcgctggcatgatcattatgctgatccccacagtgatggctttccaccttacaacgagaaatggggagcctcatatgattgtcggaatccaggaaaagggcaaatccctgctttttaagacagaggacggggttaatatgtgcacactgatggccatggatctcggagaactgtgtgaggacaccattacatacaaatgcccgcttctgcggcaaaatgaacccgaggatatcgactgttggtgcaattctacctccacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacatcccttgatttcaatgaaatggttctgctccaaatggagaacaaggcttggctggtgcaccggcagtggtttcttgacctgccgctcccttggctgcccggcgccgataagcaggagagcaattggattcagaaagaaaccctggtcacattcaagaaccctcatgctaaaaagcaagacgtggttgtgctcgggtcccaggagggagccatgcacaccgccctgacgggcgctacagaaatccagatgtctagcgggaatcttctgtttaccggccatctcaaatgccgcctgagaatggacaaacttcaactgaagggaatgtcctacagcatgtgtacaggcaaattcaaggtcgtgaaagagattgcggagacccagcacgggaccatcgtcattcgggtgcagtatgaaggagatggctctccctgcaagatccccttcgagatcatggacctcgagaagcggtacgttctggggcgcctgattacagtgaaccctatcgtcacggagaaggattccccggtgaacattgaagccgagcccccttttggagacagctacatcattatcggcgttgagcccgggcagctcaagctgaattggttcaaaaagggctctagcattggacaaatgtttgaaaccacaatgcggggcgctaaaagaatggccatccttggggataccgcctgggacttcggatccctgggcggggtgtttacatctatcggaaaggctctccatcaggtcttcggcgccatttatggggcggcttttagcggcgtgtcctggaccatgaaaatcctgattggagtgatcattacgtggatcggcatgaacagccgctctacatccctgagcgtttctcttgtcctcgtggggatcgtgaccctgtacctgggagtcatggtgcaggccgattccggctgtgttgtgagctggaagaataaggagctcaaatgcgggtccggaattttcatcaccgacaacgtccacacatggaccgaacagtataagtttcaacctgagtctcccagcaaactggcctccgctattcagaaggcccaggaagagggcatctgtgggattcggtctgtgacaagacttgagaatctgatgtggaaacagatcacgccggaactcaaccacatcctggctgagaatgaagttaagctgaccattatgacaggcgatatcaaaggaattatgcaagccggcaagcgcagccttcggcctcagcccaccgagctcaagtactcctggaaaacatgggggaaggcgaaaatgctgagcaccgaatcttataaccagacgttcctgatcgacggacctgagaccgccgagtgccccaatacaaacagagcttggaactccctcgaagtggaggattacggctttggggtcttcaccacaaacatttggctgaaacttaaagaaaagcaggacgccttttgtgacagcaagctgatgtctgctgccatcaaagataatcgcgcggtgcatgccgacatgggatattggatcgagtccgctctcaacgatacctggaagattgagaaagccagcttcatcgaagttaagaattgccactggcctaaatctcatacactgtggagcaacggcgtgctggagtccgaaatgattatccccaagaaccttgctggcccggtcagccaacacaattaccggcctgggtaccacacccagattgccggaccctggcatctcggcaagctggagatggacttcgatttttgtgacgggacgacagtgatcgtgaccgaagattgcggaaacagaggcccctctctgcgcaccacaaccgcctccgggaaactcattacggagtggtgctgtcggagctgcacactgcctccgcttagatatcggggagaggacggctgttggtacggcatggaaatccgccccctgaaggagaaagaagagaatctcgtcaactccctggttaccgctgggcacggacaggtggataatttctctctgggcgtgcttgggatggcgctctttctggaagagatgctgagaacacgggtcggaaccaagcatgccatcctcctggtggctgttagcttcgtgacacttattaccggcaacatgtcctttaaagacctggggagagtcgtggttatggtgggagccacgatggccgatgacatcggcatgggcgtcacctatctcgctctgctggccgcgttcaaggtgcgccctacatttgctgccgggcttctgctccggaagctgacctctaaagagctcatgatgacaaccattggaatcgttctgcttagccaatccacgattcccgaaacaatcctggagctcaccgatgccctggctctgggcatgatggtgcttaagatcgtcagaaatatggaaaaataccagctggccgtgacaattatggcgatcctctgcgtgcctaacgctgtcattctgcagaatgcctggaaggtttcttgtaccatcctcgccgtggtgagcgtcagccccctgcttctgaccagctctcagcagaagacggactggattcctctcgctctgacgatcaaggggctgaaccccaccgccatcttccttacaaccctgtcccgcacaaataaaaagagaagctggccgctcaacgaggctattatggccgtgggaatggtttctatcctggcgtccagcctcctgaagaatgacattcctatgaccggcccccttgtggccgggggactgctgacggtctgctatgtgctcacaggccggtctgctgatctggaacttgagcgcgccaccgacgttaaatgggaggatcaggctgaaatctccggcagctcccctattctgagcatcaccatttctgaggacgggagcatgtccatcaagaacgaagaggaggaacagacactcaccatcctgattagaacaggactcctggtgatctctggcctttttcccattagcatcccgattacggccgccgcttggtacctgtgggaggtcaaaaagcagcgggcgggggtgctgtgggatgtcccttctccccctcccatcggaaaagccgaactcgaggacggcgcttatcgcatcaagcaaaaggggattctgggatacagccagatcggcgccggcgtgtacaaagaagggaccttccacacaatgtggcatgttaccagaggagccgtgcttatgcacaagggcaaacggattgagcccagctgggctgatgtcaagaaagacctgatctcctatgggggaggctggaagctcgagggggaatggaaggagggagaagaggtgcaggttctggccctcgaacctggcaaaaatccgcgcgcggtgcagacaaagcccggcctgtttaaaaccaacacggggaccattggagctgtctctcttgatttcagccctggcacatccgggagccccatcatcgacaagaaaggaaaggtggtgggcctgtacgggaacggagttgtcaccagatctggcgcctatgtgtccgccattgctcaaacagaaaagtccatcgaggataatcctgaaattgaggacgatatctttcggaaacgcagactgaccattatggacctccaccccggcgccgggaagacaaaacggtacctgcctgcgatcgtgagagaagctattaagcgcggacttcggacgctgatcctcgccccgaccagagtcgtggccgctgagatggaagaggccctgcgcggcctccccatccggtatcagacccctgctattagagccgagcataccgggcgcgaaatcgttgacctgatgtgtcacgcgaccttcacaatgcggcttctgtctcccgtgagagtccctaactacaatctgattatcatggatgaggcccatttcacggaccccgcttccattgccgctcgcggatatatcagcacccgggtggaaatgggcgaggccgccgggatctttatgacagctaccccgcctggctccagagatcccttcccccagtctaacgcgcctattatcgacgaggaacgggagattcccgaacgcagctggaactccggacacgagtgggttacagattttaaaggcaagaccgtgtggttcgtccctagcatcaaggccgggaacgacattgctgcctgcctccgcaagaatggaaagaaagtgatccaactgtctcggaagacgtttgattccgaatacgttaaaacacgcaccaacgactgggatttcgtggtcaccacagacatcagcgagatgggcgccaattttaaggctgagagagtgattgatccgcggagatgtatgaaacccgtgatccttaccgacggggaagaaagagtcattctggccggacctatgcccgttacacattctagcgcggctcagcggagaggccgcatcgggcggaaccctaagaatgaaaacgaccagtacatttatatgggcgagcccctcgaaaatgatgaggactgcgcccactggaaggaggccaaaatgctgctggataacatcaataccccggaaggaattatcccttccatgttcgagcccgaaagagagaaggtggacgctatcgatggcgaataccgcctcagaggggaagccagaaaaacgtttgtggaccttatgcgcagaggagatctgcctgtctggctggcgttcaaggtggccgctgagggcattaactatgccgaccggcgctggtgttttgatgggatcaaaaacaatcagattctcgaagagaacgttgaagtggagatctggacaaaggagggagaaagaaagaaactgaagccccggtggcttgacgctcgcatttactctgatcctctggccctcaaagagttcaaggagttcgctgccggcagaaaaagcctgaccctgaatctcatcacagagatggggcggcttcccacctttatgacgcaaaagaccagagacgcgctggataacctggccgtcctccacacagctgaagccggcggacgcgcttataatcatgccctgtccgagcttccggagaccctggaaacactcctgctgctcacccttctggccacagtgaccggcgggatcttcctgtttctcatgtctggacggggcattgggaagatgacgctgggaatgtgctgcatcattacagctagcatccttctgtggtacgcgcagattcagcctcactggatcgccgcttccatcattctcgagttctttctgatcgttctgctcattcccgaacccgagaaacagagaacccctcaagacaaccagcttacctatgtggtcatcgccattctgacagtggtcgccgctaccatggccaatgaaatgggcttcctggagaagaccaagaaggacctcggcctggggagcatcgcgacgcagcagccggagtctaacattcttgatatcgacctgcgccccgcctccgcttggaccctctacgccgtggctacaacctttgttacacctatgctgcggcatagcatcgaaaattcctctgtgaacgtgagcctgaccgccattgcgaatcaagccacggtcctcatgggacttggcaaagggtggcccctgtccaagatggatatcggagttcctctgctcgctattggctgttactctcaggtgaaccccatcaccctgacagccgcccttctgctcctggtggcccactatgctattatcgggcctggactgcaggccaaggcgaccagagaggcccagaaacgggctgccgctggcatcatgaagaatccgacagtcgacggcattaccgtgatcgatctcgaccccattccttacgatcccaaattcgaaaagcaacttgggcaggttatgctgctgatcctctgcgtgacgcaggtcctgatgatgcgcacaacctgggccctttgtgaggccctgacactcgcgaccggacctattagcaccctgtgggaaggcaaccccgggagattttggaatacaacgatcgctgtgtccatggccaacatcttccggggaagctatctggctggcgccgggctcctcttttctattatgaaaaataccacaaacacccgcagaggaacaggcaacatcggcgagaccctgggggagaagtggaaatcccggctgaatgccctcggaaagagcgagttccaaatttacaagaaatctggcatccaggaggtcgaccgcacgctggctaaggaagggattaaaagaggagagacagatcaccatgccgtgtcccggggcagcgcgaaacttcgctggtttgttgagagaaacatggtgaccccggaagggaaagtcgtggacctgggatgcggccggggcgggtggtcttattactgtggaggcctcaagaatgttagagaggtgaaggggctgaccaaaggaggccctgggcacgaggaacccatccccatgagcacatatggatggaacctggtccgcctccagtccggcgtggatgtgttcttcatccctcccgaaaagtgcgacacccttctgtgtgatattggcgagtctagccctaatccgacagttgaggccgggcggacgctgagagtcctcaacctggtggaaaattggcttaacaataacacccagttttgcatcaaagtgctgaatccctacatgccttccgtcattgagaagatggaagctctccaacgcaaatacggaggcgccctggttcggaaccccctgagcagaaattccacacatgagatgtattgggtgtctaacgctagcgggaatatcgtgtcctctgtcaacatgattagccgcatgctcatcaaccggttcaccatgagacacaagaaggccacatacgaacctgacgtggaccttggatccggcacccgcaatattgggatcgagtctgagatccccaacctggatattatcggaaaacggattgaaaagatcaaacaggagcatgaaacgagctggcactatgaccaggatcacccgtacaagacctgggcgtatcatggctcctacgagacaaaacagaccggcagcgcctcttccatggttaatggggtggtcagactgctcacaaagccttgggacgtgctgcccaccgttacacaaatggctatgaccgatacgacaccttttggacagcagcgcgtgttcaaggaaaaagtcgacacccggacccaggagcccaaggagggcaccaagaaacttatgaaaattacggccgaatggctgtggaaggagctcgggaaaaagaagacccctagaatgtgtacacgcgaagagtttaccaaaaaggtgagaagcaacgctgccctgggagctatcttcacagatgagaataaatggaagtctgcccgggaagcggtggaggactcccgcttttgggaactggtcgataaagagagaaacctccacctggaaggcaagtgcgagacctgtgtttataatatgatggggaagcgggagaagaaacttggagagttcggcaaagccaaaggcagcagagctatctggtacatgtggctgggggcccggtttctcgagttcgaagctctgggatttcttaacgaggaccattggttctctcgcgaaaattccctgagcggcgtggagggggagggactccacaaactgggctacattctgagagatgtgtccaagaaggaagggggcgccatgtatgccgacgacacagcgggatgggatacccggatcacgctcgaggacctgaaaaacgaagagatggtcaccaatcacatggaaggcgagcataagaaacttgctgaggccatttttaagctgacataccaaaacaaagtggttcgcgtgcagagacccaccccgcgggggacagtcatggatatcattagccgcagagaccagcggggatctggccaagtggggacctatggactcaatacgttcacaaacatggaagcccagctgatccgccagatggagggcgaaggggttttcaagaatatccagcaccttaccgtgacagaggaggtcgctgtgcaaaactggctggccagagttggccgggaacgcctcagcagaatggctatttccggagatgactgcgtggtcaagcctctggatgaccggtttgccaacgcgctgaccgccctcaatgatatgggcaaaatccgcaaggacattcagcagtgggagccctctaaagggtggaacgattggacacaggtgcccttctgcagccatcactttcatgaactgatcatgaaggacggaagagtccttgtggttccttgtcggaatcaagatgagctgattggcagagctcgcatctcccagggggccggatggtctctccgggaaaccgcttgcctgggcaaaagctacgcccagatgtggtcccttatgtatttccacagacgcgacctgcggctcgcggccaacgctatttgttctgccgtgccgagccactgggtccccacatccagaaccacatggagcatccatgctaagcacgagtggatgaccacagaggacatgctgaccgtgtggaatcgcgtgtggatccgggaaaacccttggatggaggataagacgcccgttgaatcttgggaggaaattccttacctggggaaaagagaggaccagtggtgcggctccctcatcggactgacaagccgcgccacctgggctaagaatattcaagccgcgatcaaccaggtgcggtctcttattggcaatgaggaatataccgattacatgccctccatgaaaagatttcgccgggaggaagaggaagccggggtcctgtggtga

SEQ ID NO: 19875 - RNA, 9876 nt, synthetic construct
  misc_feature 1..9876: note = derived and/or modified CDS sequence (opt5) from DENV-2__FJ744713__SS-prME
  source 1..9876: mol_type = other RNA
agcgctggcatgatcattatgctgatccccaccgtgatggctttccaccttacaacgagaaatggggagcctcatatgattgtcggaatccaggaaaagggcaagtccctgctttttaagaccgaggacggggttaatatgtgcacactgatggccatggatctcggagaactgtgtgaggacaccattacatacaagtgcccgcttctgcggcaaaatgaacccgaggatatcgactgttggtgcaattctacctccacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacatcccttgatttcaatgaaatggttctgctccaaatggagaacaaggcttggctggtgcaccggcagtggtttcttgacctgccgctcccttggctgcccggcgccgataagcaggagagcaattggattcagaaagaaaccctggtcacattcaagaaccctcatgctaaaaagcaagacgtggttgtgctcgggtcccaggagggagccatgcacaccgccctgacgggcgctacagaaatccagatgtctagcgggaatcttctgtttaccggccatctcaaatgccgcctgagaatggacaaacttcaactgaagggaatgtcctacagcatgtgtacaggcaaattcaaggtcgtgaaagagattgcggagacccagcacgggaccatcgtcattcgggtgcagtatgaaggagatggctctccctgcaagatccccttcgagatcatggacctcgagaagcggtacgttctggggcgcctgattacagtgaaccctatcgtcacggagaaggattccccggtgaacattgaagccgagcccccttttggagacagctacatcattatcggcgttgagcccgggcagctcaagctgaattggttcaaaaagggctctagcattggacaaatgtttgaaaccacaatgcggggcgctaaaagaatggccatccttggggataccgcctgggacttcggatccctgggcggggtgtttacatctatcggaaaggctctccatcaggtcttcggcgccatttatggggcggcttttagcggcgtgtcctggaccatgaaaatcctgattggagtgatcattacgtggatcggcatgaacagccgctctacatccctgagcgtttctcttgtcctcgtggggatcgtgaccctgtacctgggagtcatggtgcaggccgattccggctgtgttgtgagctggaagaataaggagctcaaatgcgggtccggaattttcatcaccgacaacgtccacacatggaccgaacagtataagtttcaacctgagtctcccagcaaactggcctccgctattcagaaggcccaggaagagggcatctgtgggattcggtctgtgacaagacttgagaatctgatgtggaaacagatcacgccggaactcaaccacatcctggctgagaatgaagttaagctgaccattatgacaggcgatatcaaaggaattatgcaagccggcaagcgcagccttcggcctcagcccaccgagctcaagtactcctggaaaacatgggggaaggcgaaaatgctgagcaccgaatcttataaccagacgttcctgatcgacggacctgagaccgccgagtgccccaatacaaacagagcttggaactccctcgaagtggaggattacggctttggggtcttcaccacaaacatttggctgaaacttaaagaaaagcaggacgccttttgtgacagcaagctgatgtctgctgccatcaaagataatcgcgcggtgcatgccgacatgggatattggatcgagtccgctctcaacgatacctggaagattgagaaagccagcttcatcgaagttaagaattgccactggcctaaatctcatacactgtggagcaacggcgtgctggagtccgaaatgattatccccaagaaccttgctggcccggtcagccaacacaattaccggcctgggtaccacacccagattgccggaccctggcatctcggcaagctggagatggacttcgatttttgtgacgggacgacagtgatcgtgaccgaagattgcggaaacagaggcccctctctgcgcaccacaaccgcctccgggaaactcattacggagtggtgctgtcggagctgcacactgcctccgcttagatatcggggagaggacggctgttggtacggcatggaaatccgccccctgaaggagaaagaagagaatctcgtcaactccctggttaccgctgggcacggacaggtggataatttctctctgggcgtgcttgggatggcgctctttctggaagagatgctgagaacacgggtcggaaccaagcatgccatcctcctggtggctgttagcttcgtgacacttattaccggcaacatgtcctttaaagacctggggagagtcgtggttatggtgggagccacgatggccgatgacatcggcatgggcgtcacctatctcgctctgctggccgcgttcaaggtgcgccctacatttgctgccgggcttctgctccggaagctgacctctaaagagctcatgatgacaaccattggaatcgttctgcttagccaatccacgattcccgaaacaatcctggagctcaccgatgccctggctctgggcatgatggtgcttaagatcgtcagaaatatggaaaaataccagctggccgtgacaattatggcgatcctctgcgtgcctaacgctgtcattctgcagaatgcctggaaggtttcttgtaccatcctcgccgtggtgagcgtcagccccctgcttctgaccagctctcagcagaagaccgactggattcctctcgctctgacgatcaaggggctgaaccccaccgccatcttccttacaaccctgtcccgcacaaataaaaagagaagctggccgctcaacgaggctattatggccgtgggaatggtttctatcctggcgtccagcctcctgaagaatgacattcctatgaccggcccccttgtggccgggggactgctgacggtctgctatgtgctcacaggccggtctgctgatctggaacttgagcgcgccaccgacgttaaatgggaggatcaggctgaaatctccggcagctcccctattctgagcatcaccatttctgaggacgggagcatgtccatcaagaacgaagaggaggaacagatcctcacaattctgatcagaaccggactcctggtgatttctggcctttttcccatcagcattccgatcacagccgccgcttggtacctgtgggaggtcaaaaagcagcgggcgggggtgctgtgggatgtcccttctccccctcccatcggaaaagccgaactcgaggacggcgcttatcgcattaagcaaaaggggatcctgggatacagccagattggcgccggcgtgtacaaagaagggacgttccacaccatgtggcatgttacaagaggagccgtgcttatgcacaagggcaaacggatcgagcccagctgggctgatgtcaagaaagacctgatttcctatgggggaggctggaagctcgagggggaatggaaggagggagaagaggtgcaggttctggccctcgaacctggcaaaaatccgcgcgcggtgcagaccaagcccggcctgtttaaaacaaacaccgggacgatcggagctgtctctcttgatttcagccctggcacctccgggagccccatcattgacaagaaaggaaaggtggtgggcctgtacgggaacggagttgtcacaagatctggcgcctatgtgtccgccatcgctcaaaccgaaaagtccattgaggataatcctgaaatcgaggacgatatttttcggaaacgcagactgacaatcatggacctccaccccggcgccgggaagaccaaacggtacctgcctgcgattgtgagagaagctatcaagcgcggacttcggacactgatcctcgccccgacgagagtcgtggccgctgagatggaagaggccctgcgcggcctccccattcggtatcagacccctgctatcagagccgagcatacagggcgcgaaattgttgacctgatgtgtcacgcgaccttcaccatgcggcttctgtctcccgtgagagtccctaactacaatctgatcattatggatgaggcccatttcacagaccccgcttccatcgccgctcgcggatatatcagcacgcgggtggaaatgggcgaggccgccgggatttttatgaccgctacaccgcctggctccagagatcccttcccccagtctaacgcgcctatcattgacgaggaacgggagatccccgaacgcagctggaactccggacacgagtgggttaccgattttaaaggcaagacagtgtggttcgtccctagcattaaggccgggaacgacatcgctgcctgcctccgcaagaatggaaagaaagtgatccaactgtctcggaagacctttgattccgaatacgttaaaacgcgcacaaacgactgggatttcgtggtcaccaccgacattagcgagatgggcgccaattttaaggctgagagagtgatcgatccgcggagatgtatgaaacccgtgattcttacagacggggaagaaagagtcatcctggccggacctatgcccgttacccattctagcgcggctcagcggagaggccgcattgggcggaaccctaagaatgaaaacgaccagtacatctatatgggcgagcccctcgaaaatgatgaggactgcgcccactggaaggaggccaaaatgctgctggataacattaatacaccggaaggaatcatcccttccatgttcgagcccgaaagagagaaggtggacgctattgatggcgaataccgcctcagaggggaagccagaaaaacctttgtggaccttatgcgcagaggagatctgcctgtctggctggcgttcaaggtggccgctgagggcatcaactatgccgaccggcgctggtgttttgatgggattaaaaacaatcagatcctcgaagagaacgttgaagtggagatttggacgaaggagggagaaagaaagaaactgaagccccggtggcttgacgctcgcatctactctgatcctctggccctcaaagagttcaaggagttcgctgccggcagaaaaagcctgacactgaatctcatcaccgagatggggcggcttcccacatttatgacccaaaagacgagagacgcgctggataacctggccgtcctccacaccgctgaagccggcggacgcgcttataatcatgccctgtccgagcttccggagacactggaaaccctcctgctgctcacacttctggccaccgtgacaggcgggattttcctgtttctcatgtctggacggggcatcgggaagatgaccctgggaatgtgctgcattatcacggctagcattcttctgtggtacgcgcagatccagcctcactggatcgccgcttccattatcctcgagttctttctgattgttctgctcatccccgaacccgagaaacagagaacacctcaagacaaccagcttacctatgtggtcattgccatcctgaccgtggtcgccgctacaatggccaatgaaatgggcttcctggagaagaccaaaaaggacctcggcctggggagcattgcgacacagcagccggagtctaacatccttgatatcgacctgcgccccgcctccgcttggacgctctacgccgtggctaccacatttgttacccctatgctgcggcatagcattgaaaattcctctgtgaacgtgagcctgacagccatcgcgaatcaagccaccgtcctcatgggacttggcaaagggtggcccctgtccaagatggatattggagttcctctgctcgctatcggctgttactctcaggtgaaccccattacgctgaccgccgcccttctgctcctggtggcccactatgctatcatcgggcctggactgcaggccaaggcgacaagagaggcccagaaacgggctgccgctggcattatgaagaatccgaccgtcgacggcatcacagtgattgatctcgaccccatcccttacgatcccaaattcgaaaagcaacttgggcaggttatgctgctgattctctgcgtgacccaggtcctgatgatgcgcacgacatgggccctttgtgaggccctgaccctcgcgacaggacctatcagcaccctgtgggaaggcaaccccgggagattttggaataccacaatcgctgtgtccatggccaacattttccggggaagctatctggctggcgccgggctcctcttttctatcatgaaaaatacgaccaacacacgcagaggaaccggcaacattggcgagacactgggggagaagtggaaatcccggctgaatgccctcggaaagagcgagttccaaatctacaagaaatctggcattcaggaggtcgaccgcaccctggctaaggaagggatcaaaagaggagagacggatcaccatgccgtgtcccggggcagcgcgaaacttcgctggtttgttgagagaaacatggtgacaccggaagggaaagtcgtggacctgggatgcggccggggcgggtggtcttattactgtggaggcctcaagaatgttagagaggtgaaggggctgaccaaaggaggccctgggcacgaggaacccatccccatgagcacctatggatggaacctggtccgcctccagtccggcgtggatgtgttcttcattcctcccgaaaagtgcgacacacttctgtgtgatatcggcgagtctagccctaatccgaccgttgaggccgggcggacactgagagtcctcaacctggtggaaaattggcttaacaataacacgcagttttgcattaaagtgctgaatccctacatgccttccgtcatcgagaagatggaagctctccaacgcaaatacggaggcgccctggttcggaaccccctgagcagaaattccacccatgagatgtattgggtgtctaacgctagcgggaatattgtgtcctctgtcaacatgatcagccgcatgctcattaaccggttcacaatgagacacaagaaggccacctacgaacctgacgtggaccttggatccggcacacgcaatatcgggatcgagtctgagattcccaacctggatatcattggaaaacggatcgaaaagattaaacaggagcatgaaaccagctggcactatgaccaggatcacccgtacaagacgtgggcgtatcatggctcctacgagaccaaacagacaggcagcgcctcttccatggttaatggggtggtcagactgctcaccaagccttgggacgtgctgcccacagttacccaaatggctatgacagataccacgccttttggacagcagcgcgtgttcaaggaaaaagtcgacacacggacccaggagcccaaggagggcaccaagaaacttatgaaaatcacagccgaatggctgtggaaagagctcgggaaaaagaagacgcctagaatgtgtacccgcgaagagtttacaagaaaagtgcggagcaacgctgccctgggagctatcttcaccgatgagaataagtggaaatctgcccgcgaagcggtggaggactccagattttgggaactggtcgataaggagcggaacctccacctggaaggcaaatgcgagacatgtgtttataatatgatggggaagagagagaagaaacttggagagttcggcaaggccaaaggcagccgggctatttggtacatgtggctgggggcccgctttctcgagttcgaagctctgggatttcttaacgaggaccattggttctctagagaaaattccctgagcggcgtggagggggagggactccacaagctgggctacatcctgcgggatgtgtccaaaaaggaagggggcgccatgtatgccgacgacaccgcgggatgggatacacgcattaccctcgaggacctgaagaacgaagagatggtcacgaatcacatggaaggcgagcataagaaacttgctgaggccatctttaaactgacctaccaaaacaaagtggttagagtgcagcggcccacaccgcgcgggaccgtcatggatattatcagcagacgggaccagcgcggatctggccaagtggggacatatggactcaataccttcacgaacatggaagcccagctgatcagacagatggagggcgaaggggttttcaaaaatattcagcaccttacagtgaccgaggaggtcgctgtgcaaaactggctggcccgggttggccgcgaaagactcagccggatggctatctccggagatgactgcgtggtcaagcctctggatgaccgctttgccaacgcgctgacagccctcaatgatatgggcaagattagaaaagacatccagcagtgggagccctctaaggggtggaacgattggacccaggtgcccttctgcagccatcactttcatgaactgattatgaaagacggacgggtccttgtggttccttgtagaaatcaagatgagctgatcggccgcgctcggatttcccagggggccggatggtctctcagagaaacggcttgcctgggcaagagctacgcccagatgtggtcccttatgtatttccaccgccgggacctgagactcgcggccaacgctatctgttctgccgtgccgagccactgggtccccacctcccgcacaacctggagcatccatgctaaacacgagtggatgacaaccgaggacatgctgacagtgtggaatcgggtgtggattagagaaaacccttggatggaggataagacccccgttgaatcttgggaggaaatcccttacctggggaagcgcgaggaccagtggtgcggctccctcattggactgacgagccgggccacatgggctaaaaatatccaagccgcgattaaccaggtgagatctcttatcggcaatgaggaatataccgattacatgccctccatgaagcgctttcggagagaggaagaggaagccggggtcctgtggtga

SEQ ID NO: 19876 - RNA, 9876 nt, synthetic construct
  misc_feature 1..9876: note = derived and/or modified CDS sequence (opt5) from DENV-2__FJ744714__SS-prME
  source 1..9876: mol_type = other RNA
agcgccggcatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacagactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagagaatcctgggatactcccagatcggcgctggcgtgtacaaagaagggaccttccacacaatgtggcatgtcacccggggagccgtgcttatgcacaagggcaaacgcattgagccctcctgggccgatgttaagaaagacctgatcagctatgggggaggctggaagctcgagggggaatggaaggagggagaagaggtgcaggtcctggctctcgaacctggcaaaaatccgagagccgtgcagacaaagcccggcctgtttaaaaccaacacggggaccattggagcggtgtcccttgatttctctcctggcacaagcgggtcccccatcattgacaagaaaggaaaggttgtcggcctgtacgggaacggagtggtgacccggagcggcgcttatgtctctgccatcgcccaaacagagaagtccatcgaggataatcctgaaattgaggacgatatctttcgcaaaagacggctgaccattatggacctccaccccggcgctgggaagacaaaaagatacctgcctgccatcgtgcgcgaagcgattaagcggggacttagaacgctgatcctcgctccgacccgcgttgtggccgccgagatggaagaggctctgcggggcctccccattagatatcagacccctgccatccgcgctgagcataccgggcgggaaatcgtcgacctgatgtgtcacgccaccttcacaatgagacttctgagccccgtgcgcgttcctaactacaatctgattatcatggatgaggcgcatttcacggaccccgcctctattgctgcccggggatatatctccaccagagtggaaatgggcgaggctgccgggatttttatgacagccaccccgcctggcagccgggatcccttcccccagtccaacgctcctatcatcgacgaggaacgcgagattcccgaaagatcttggaatagcggacacgagtgggtcacagattttaaaggcaagaccgtgtggttcgttccttccatcaaggcggggaacgacattgccgcttgcctccggaaaaatggaaagaaagtgatccaactgagccgcaagacgtttgattctgaatacgtcaaaacaagaaccaacgactgggatttcgtggtgaccacagacatttccgagatgggcgccaattttaaggccgagcgggtcatcgatccgagacgctgtatgaaacccgttatccttaccgacggggaggaacgggtgattctggctggacctatgcccgtgacacatagctctgccgcgcagagacgcggccggatcgggagaaaccctaagaatgaaaacgaccagtacatttatatgggcgagcccctcgaaaatgatgaggactgcgctcactggaaggaggccaaaatgctgctggataacatcaataccccggaaggaattatccctagcatgttcgagcccgaacgcgagaaggtcgacgccattgatggcgaataccggctcagaggggaggctcgcaaaacgtttgtggaccttatgagacggggagatctgcctgtttggctggcctataaggtggcggccgagggcatcaactacgctgaccgcagatggtgtttcgatgggatcaaaaacaatcagattctcgaagagaacgtcgaagtggagatctggacaaaggagggagaacggaagaaactgaagccccgctggcttgacgccagaatttattccgatcctctggctctcaaagagtttaaggagttcgccgctggccggaaatctctgaccctgaatctcatcacagagatggggagacttcccaccttcatgacgcaaaagacccgcgacgccctggataacctggcggttctccacacagccgaagctggcggacgggcctacaatcatgctctgagcgagcttccggagaccctggaaacactcctgctgctcacccttctggccacagtgaccggcgggatttttctgttcctcatgtccggaagaggcatcgggaagatgacgctgggaatgtgctgcatcattacagcctctatccttctgtggtatgctcagattcagcctcactggatcgcggccagcattatcctcgagtttttcctgatcgtcctgctcattcccgaacccgagaaacagcgcacccctcaagacaaccagcttacctacgtggtcatcgctattctgacagtggttgccgccaccatggctaatgaaatgggctttctggagaagaccaagaaggacctcggcctggggtccatcgccacgcagcagccggagagcaacattcttgatatcgacctgcggcccgcgtctgcctggaccctctacgctgtggccacaaccttcgtgacacctatgctgagacattccattgaaaatagctccgtcaacgtttctctgaccgctatcgccaatcaagcgacggtgctcatgggacttggcaaagggtggcccctgagcaagatggatatcggagtgcctctgctcgccattggctgttattcccaggtcaaccccatcaccctgacagctgcccttctgctcctggtggctcactacgccattatcgggcctggactgcaggctaaggccacccgggaggcgcagaaacgcgccgctgccggcattatgaagaatccgacagttgacggcatcaccgtgatcgatctcgaccccattccttatgatcccaaatttgaaaagcaacttgggcaggtcatgctgctgatcctctgcgtgacgcaggtcctgatgatgagaacaacctgggctctttgtgaggccctgacactcgccaccggacctatttctaccctgtgggaaggcaaccccgggcggttctggaatacaacgatcgcggtgagcatggctaacatttttcgcggatcctacctggccggcgctgggctccttttcagcatcatgaaaaataccacaaacaccagacggggaacaggcaacatcggcgagaccctgggggagaagtggaaatctcgcctgaatgccctcggaaagtccgaatttcaaatttataagaaaagcggcatccaggaggttgacagaacgctggccaaggaagggattaaacggggagagacagatcaccatgctgtgtctcgcggctccgccaaacttagatggttcgtcgagcggaacatggtgaccccggaagggaaagttgtggacctgggatgcggcagaggcgggtggagctactattgtggaggcctcaagaatgtccgcgaggtgaaggggctgaccaaaggaggccctgggcacgaagaacccatccccatgtctacatacggatggaacctggtgcggctccagagcggcgttgatgtctttttcattcctcccgaaaagtgcgacacccttctgtgtgatatcggcgagtcctctcctaatccgacagtggaggcggggagaacgctgcgcgtgctcaacctggtcgaaaattggcttaacaataacacccagttctgcatcaaagttctgaatccctacatgcctagcgtgattgagaagatggaagccctccaacggaaatatggaggcgctctggtgagaaaccccctgtcccgcaatagcacacatgagatgtactgggtctccaacgcctctgggaatatcgtgagctccgttaacatgatttctcggatgctcatcaacagatttaccatgcgccacaagaaggctacatatgaacctgacgtggaccttggaagcggcacccggaatattgggatcgagtccgaggtccccaacctggatattatcggaaaaagaatcgaaaagattaaacaggagcatgaaacgtcttggcactacgaccaggatcacccgtataagacctgggcctaccatggcagctatgagacaaaacagaccggctccgcgagctctatggtgaatggggttgtgcgcctgctcacaaagccttgggacgtcctgcccaccgtgacacaaatggccatgaccgatacgacacctttcggacagcagcgggtgtttaaggaaaaagtcgacaccagaacccaggagcccaaggagggcaccaagaaacttatgaaaatcacggctgaatggctgtggaaggagctcgggaaaaagaagacccctcgcatgtgtacaagagaagagttcacccggaaagttcgctccaacgccgctctgggagccatttttacagatgagaataagtggaaaagcgctagagaagccgtggaggactctcggttctgggaactggtggataaggagagaaacctccacctggaaggcaaatgcgagacctgtgtctacaatatgatggggaagcgggagaagaaacttggagaatttggcaaggcgaaaggctcccgcgccatctggtacatgtggctgggggctagattcctcgagtttgaagccctgggattccttaacgaggaccattggtttagccgggaaaattctctgtccggcgtggagggggagggactccacaagctgggctatattctgcgcgatgttagcaaaaaggaagggggcgctatgtacgccgacgacacagccggatgggataccagaatcacgctcgaggacctgaagaacgaagagatggtgaccaatcacatggaaggcgagcataagaaacttgcggaggctatcttcaaactgacatatcaaaacaaagtcgtgcgggttcagcgccccaccccgagagggacagtgatggatattatctcccggcgcgaccagagaggaagcggccaagtcgggacctacggactcaatacgtttacaaacatggaagcccagctgattcggcagatggagggcgaaggggtgttcaaaaatatccagcaccttaccgttacagaggaggtggccgtccaaaactggctggctcgcgtgggcagagaacggctctctcgcatggccattagcggagatgactgcgtcgtgaagcctctggatgacagattcgctaacgccctgaccgcgctcaatgatatgggcaagatccggaaagacatccagcagtgggagccctccaaggggtggaacgattggacgcaggttcccttttgctctcatcacttccatgaactgattatgaaagacggaagagtgcttgtcgtgccttgtcgcaatcaagatgagctgatcggccgggccagaattagccagggggctggatggtccctccgcgaaaccgcctgcctgggcaagtcttatgctcagatgtggagccttatgtactttcaccggagagacctgcgcctcgccgcgaacgccatctgttccgctgtgccgtctcactgggttcccacaagccggaccacatggtccattcatgccaaacacgagtggatgaccacagaggacatgctgaccgtgtggaatagagtctggatccgcgaaaacccttggatggaggataagacgcccgtggaaagctgggaggaaattccttatctggggaagcgggaggaccagtggtgcggctctctcatcggactgacatccagagctacctgggccaaaaatatccaagctgccattaaccaggttcgcagccttatcggcaatgaggaatacaccgattacatgccctctatgaagcggttcagacgggaggaagaggaagcgggggtgctgtggtga

SEQ ID NO: 19877 - RNA, 9876 nt, synthetic construct
  misc_feature 1..9876: note = derived and/or modified CDS sequence (opt5) from DENV-2__FJ744716__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacagactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagagaatcctgggatactcccagatcggcgctggcgtgtacaaagaagggaccttccacacaatgtggcatgtcacccggggagccgtgcttatgcacaagggcaaacgcattgagccctcctgggccgatgttaagaaagacctgatcagctatgggggaggctggaagctcgagggggaatggaaggagggagaagaggtgcaggtcctggctctcgaacctggcaaaaatccgagagccgtgcagacaaagcccggcctgtttaaaaccaacacggggaccattggagcggtgtcccttgatttctctcctggcacaagcgggtcccccatcattgacaagaaaggaaaggttgtcggcctgtacgggaacggagtggtgacccggagcggcgcttatgtctctgccatcgcccaaacagagaagtccatcgaggataatcctgaaattgaggacgatatctttcgcaaaagacggctgaccattatggacctccaccccggcgctgggaagacaaaaagatacctgcctgccatcgtgcgcgaagcgattaagcggggacttagaacgctgatcctcgctccgacccgcgttgtggccgccgagatggaagaggctctgcggggcctccccattagatatcagacccctgccatccgcgctgagcataccgggcgggaaatcgtcgacctgatgtgtcacgccaccttcacaatgagacttctgagccccgtgcgcgttcctaactacaatctgattatcatggatgaggcgcatttcacggaccccgcctctattgctgcccggggatatatctccaccagagtggaaatgggcgaggctgccgggatttttatgacagccaccccgcctggcagccgggatcccttcccccagtccaacgctcctatcatcgacgaggaacgcgagattcccgaaagatcttggaatagcggacacgagtgggtcacagattttaaaggcaagaccgtgtggttcgttccttccatcaaggcggggaacgacattgccgcttgcctccggaaaaatggaaagaaagtgatccaactgagccgcaagacgtttgattctgaatacgtcaaaacaagaaccaacgactgggatttcgtggtgaccacagacatttccgagatgggcgccaattttaaggccgagcgggtcatcgatccgagacgctgtatgaaacccgttatccttaccgacggggaggaacgggtgattctggctggacctatgcccgtgacacatagctctgccgcgcagagacgcggccggatcgggagaaaccctaagaatgaaaacgaccagtacatttatatgggcgagcccctcgaaaatgatgaggactgcgctcactggaaggaggccaaaatgctgctggataacatcaataccccggaaggaattatccctagcatgttcgagcccgaacgcgagaaggtcgacgccattgatggcgaataccggctcagaggggaggctcgcaaaacgtttgtggaccttatgagacggggagatctgcctgtttggctggcctataaggtggcggccgagggcatcaactacgctgaccgcagatggtgtttcgatgggatcaaaaacaatcagattctcgaagagaacgtcgaagtggagatctggacaaaggagggagaacggaagaaactgaagccccgctggcttgacgccagaatttattccgatcctctggctctcaaagagtttaaggagttcgccgctggccggaaatctctgaccctgaatctcatcacagagatggggagacttcccaccttcatgacgcaaaagacccgcgacgccctggataacctggcggttctccggacagccgaagctggcggcagagcctacaatcacgctctgagcgagcttccggagaccctggaaacactcctgctgctcacccttctggccacagtgaccggcgggatttttctgttcctcatgtccggacgcggcatcgggaagatgacgctgggaatgtgctgcatcattacagcctctatccttctgtggtatgctcagattcagcctcattggatcgcggccagcattatcctcgagtttttcctgatcgtcctgctcattcccgaacccgagaaacagcggacccctcaagacaaccagcttacctacgtggtcatcgctattctgacagtggttgccgccaccatggctaatgaaatgggctttctggagaagaccaagaaggacctcggcctggggtccatcgccacgcagcagccggagagcaacattcttgatatcgacctgagacccgcgtctgcctggaccctctacgctgtggccacaaccttcgtgacacctatgctgcggcactccattgaaaatagctccgtcaacgtttctctgaccgctatcgccaatcaagcgacggtgctcatgggacttggcaaagggtggcccctgagcaagatggatatcggagtgcctctgctcgccattggctgttattcccaggtcaaccccatcaccctgacagctgcccttctgctcctggtggctcattacgccattatcgggcctggactgcaggctaaggccacccgcgaggcgcagaaaagagccgctgccggcattatgaagaatccgacagttgacggcatcaccgtgatcgatctcgaccccattccttatgatcccaaatttgaaaagcaacttgggcaggtcatgctgctgatcctctgcgtgacgcaggtcctgatgatgcggacaacctgggctctttgtgaggccctgacactcgccaccggacctatttctaccctgtgggaaggcaaccccgggcgcttctggaatacaacgatcgcggtgagcatggctaacatttttagaggatcctacctggccggcgctgggctccttttcagcatcatgaaaaataccacaaacacccggcgcggaacaggcaacatcggcgagaccctgggggagaagtggaaatctagactgaatgccctcggaaagtccgaatttcaaatttataagaaaagcggcatccaggaggttgaccggacgctggccaaggaagggattaaacgcggagagacagatcaccacgctgtgtctagaggctccgccaaacttcggtggttcgtcgagagaaacatggtgaccccggaagggaaagttgtggacctgggatgcggccgcggcgggtggagctactattgtggaggcctcaagaatgtccgggaggtgaaggggctgaccaaaggaggccctgggcatgaagaacccatccccatgtctacatacggatggaacctggtgagactccagagcggcgttgatgtctttttcattcctcccgaaaagtgcgacacccttctgtgtgatatcggcgagtcctctcctaatccgacagtggaggcggggcgcacgctgcgggtgctcaacctggtcgaaaattggcttaacaataacacccagttctgcatcaaagttctgaatccctacatgcctagcgtgattgagaagatggaagccctccaaagaaaatatggaggcgctctggtgcgcaaccccctgtcccggaatagcacacacgagatgtactgggtctccaacgcctctgggaatatcgtgagctccgttaacatgatttctagaatgctcatcaaccgctttaccatgcggcataagaaggctacatatgaacctgacgtggaccttggaagcggcaccagaaatattgggatcgagtccgaggtccccaacctggatattatcggaaaacgcatcgaaaagattaaacaggagcacgaaacgtcttggcattacgaccaggatcacccgtataagacctgggcctaccacggcagctatgagacaaaacagaccggctccgcgagctctatggtgaatggggttgtgcggctgctcacaaagccttgggacgtcctgcccaccgtgacacaaatggccatgaccgatacgacacctttcggacagcagagagtgtttaaggaaaaagtcgacacccgcacccaggagcccaaggagggcaccaagaaacttatgaaaatcacggctgaatggctgtggaaggagctcgggaaaaagaagacccctagaatgtgtacacgggaagagttcacccgcaaagttagatccaacgccgctctgggagccatttttacagatgagaataagtggaaaagcgctcgggaagccgtggaggactctagattctgggaactggtggataaggagcggaacctccatctggaaggcaaatgcgagacctgtgtctacaatatgatggggaagcgcgagaagaaacttggagaatttggcaaggcgaaaggctccagagccatctggtacatgtggctgggggctcggttcctcgagtttgaagccctgggattccttaacgaggaccactggtttagccgcgaaaattctctgtccggcgtggagggggagggactccataagctgggctatattctgagagatgttagcaaaaaggaagggggcgctatgtacgccgacgacacagccggatgggatacccggatcacgctcgaggacctgaagaacgaagagatggtgaccaatcacatggaaggcgagcacaagaaacttgcggaggctatcttcaaactgacatatcaaaacaaagtcgtgcgcgttcagagacccaccccgcgggggacagtgatggatattatctcccgcagagaccagcggggaagcggccaagtcgggacctacggactcaatacgtttacaaacatggaagcccagctgattcgccagatggagggcgaaggggtgttcaaaaatatccagcatcttaccgttacagaggaggtggccgtccaaaactggctggctagagtgggccgggaacgcctctctagaatggccattagcggagatgactgcgtcgtgaagcctctggatgaccggttcgctaacgccctgaccgcgctcaatgatatgggcaagatcagaaaagacatccagcagtgggagccctccaaggggtggaacgattggacgcaggttcccttttgctctcaccatttccacgaactgattatgaaagacggacgcgtgcttgtcgtgccttgtcggaatcaagatgagctgatcggcagagcccgcattagccagggggctggatggtccctccgggaaaccgcctgcctgggcaagtcttatgctcagatgtggagccttatgtactttcatagacgcgacctgcggctcgccgcgaacgccatctgttccgctgtgccgtctcactgggttcccacaagcagaaccacatggtccattcacgccaaacatgagtggatgaccacagaggacatgctgaccgtgtggaatcgcgtctggatccgggaaaacccttggatggaggataagacgcccgtggaaagctgggaggaaattccttatctggggaagagagaggaccagtggtgcggctctctcatcggactgacatcccgcgctacctgggccaaaaatatccaagctgccattaaccaggttcggagccttatcggcaatgaggaatacaccgattacatgccctctatgaagagattccggagagaggaagaggaagcgggggtgctgtggtga

SEQ ID NO: 19878 - RNA, 9876 nt, synthetic construct
  misc_feature 1..9876: note = derived and/or modified CDS sequence (opt5) from DENV-2__FJ744718__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcggcggggtctttacatccatcgggaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacagactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgctgaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagagaacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaaacgggccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgcgcacaacctgggctctttgtgaggccctgacactcgccaccggccctatttctaccctgtgggaagggagccccggaagattctggaacacaacgatcgcggtgtccatggctaatatttttcggggcagctacctggccggggctggactccttttctctatcatgaaaaacaccacaaatacccgcagaggcacaggcaacatcggggagaccctgggagagaagtggaaatcccggctgaacgccctcggcaagagcgaatttcaaatttataagaaatctgggatccaggaggttgaccgcacgctggccaaggaaggaattaaaagaggcgagacagatcaccatgctgtgtcccgggggagcgccaaacttcgctggttcgtcgagagaaatatggtgaccccggaaggaaaagttgtggacctgggctgcggcagagggggatggtcttactattgtggcgggctcaagaacgtccgggaggtgaagggactgaccaaaggcgggcctggacacgaagaacccatccccatgagcacatacggctggaatctggtgcgcctccagtccggcgttgatgtctttttcattcctcccgaaaagtgcgacacccttctgtgtgatatcggggagtctagccctaacccgacagtggaggcgggacggacgctgagagtgctcaatctggtcgaaaactggcttaataacaatacccagttctgcatcaaagttctgaacccctacatgccttccgtgattgagaagatggaagccctccaacgcaaatatggcggggctctggtgcggaatcccctgagcagaaactccacacatgagatgtactgggtctctaatgccagcggaaacatcgtgtcctctgttaatatgattagccgcatgctcatcaaccggtttaccatgagacacaagaaggctacatatgaacctgacgtggaccttggctccgggacccgcaacattggaatcgagtctgaggtccccaatctggatattatcggcaaacggatcgaaaagattaaacaggagcatgaaacgagctggcactacgaccaggatcacccgtataagacctgggcctaccatggctcctatgagacaaaacagaccgggagcgcgtcttccatggtgaacggagttgtgagactgctcacaaagccttgggacgtcctgcccaccgtgacacaaatggccatgaccgatacgacacctttcggccagcagcgcgtgtttaaggaaaaagtcgacacccggacccaggagcccaaggaggggaccaagaaacttatgaaaatcacggctgaatggctgtggaaggagctcggcaaaaagaagacccctagaatgtgtacacgcgaagagttcaccagaaaagttcggagcaatgccgctctgggcgccatttttacagatgagaacaagtggaaatctgctcgcgaagccgtggaggactccagattctgggaactggtggataaggagcggaatctccacctggaagggaaatgcgagacctgtgtctacaacatgatgggaaagagagagaagaaacttggcgaatttggcaaggcgaaagggagccgggccatctggtacatgtggctgggagctcgcttcctcgagtttgaagccctgggcttccttaatgaggaccattggttttctagagaaaactccctgagcggggtggagggagagggcctccacaagctggggtatattctgcgggatgtttccaaaaaggaaggcggagctatgtacgccgacgacacagccggctgggatacccgcatcacgctcgaggacctgaagaatgaagagatggtgaccaaccacatggaaggggagcataagaaacttgcggaggctatcttcaaactgacatatcaaaataaagtcgtgagagttcagcggcccaccccgcgcggaacagtgatggatattatcagcagacgggaccagcgcggctctgggcaagtcggaacctacggcctcaacacgtttacaaatatggaagcccagctgattagacagatggagggggaaggcgtgttcaaaaacatccagcaccttaccgttacagaggaggtggccgtccaaaattggctggctcgggtgggacgcgaaagactcagccggatggccatttccggcgatgactgcgtcgtgaagcctctggatgaccgcttcgctaacgccctgaccgcgctcaacgatatggggaagatcagaaaagacatccagcagtgggagccctctaagggatggaatgattggacgcaggttcccttttgcagccatcacttccatgaactgattatgaaagacggccgggtgcttgtcgtgccttgtagaaaccaagatgagctgatcgggcgcgcccggatttcccagggagctggctggtctctcagagaaaccgcctgcctgggaaagagctatgctcagatgtggtcccttatgtactttcaccgccgggacctgagactcgccgcgaatgccatctgttctgctgtgccgagccactgggttcccacatcccgcaccacatggagcattcatgccaaacacgagtggatgaccacagaggacatgctgaccgtgtggaaccgggtctggatcagagaaaatccttggatggaggataagacgcccgtggaatcttgggaggaaattccttatctgggcaagcgcgaggaccagtggtgcggatccctcatcggcctgacaagccgggctacctgggccaaaaacatccaagctgccattaatcaggttagatctcttatcgggaacgaggaatacaccgattacatgccctccatgaagcgcttccggagagaggaagaggaagcgggagtgctgtggtga

SEQ ID NO: 19879 - RNA, 9876 nt, synthetic construct
  misc_feature 1..9876: note = derived and/or modified CDS sequence (opt5) from DENV-2__FJ744722__SS-prME
  source 1..9876: mol_type = other RNA
agcgtgggaatgatcattatgctgatccccaccgtgatggccttccacctcacaacgcggaacggggagcctcatatgattgtttccatccaggaaaagggaaaatctctgctttttaagaccgaggacggcgtgaatatgtgcacactgatggctatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtcgccctcgtgcctcatgttgggatgggactggagacacgcaccgaaacgtggatgagctccgagggcgcgtggaaacacgctcagagaatcgagacatggattctgcggcatcccggcttcaccatcatggccgccattctcgcttacacaatcgggaccacccactttcagcgcacactgattttcatccttctgacggccgtggctccttctatgaccatgagatgcattggaatcagcaaccgggattttgtcgaaggcgtgtccgggggaagctgggttgacatcgtgctcgagcacggctcttgtgtcacaaccatggccaagaataagcccacactggatttcgaacttattaaaaccgaggcgaagcagcctgccacgctgcgcaaatattgcatcgaagctaagctcacaaacaccaccacagagtccagatgtccgacccaaggggagcccaatctgaaagaagaacaggacaagcggtttgtgtgcaagcatagcatggtggatcgcggatggggcaacggctgtgggctgttcggaaaaggcgggattgtcacatgcgccatgtttacgtgcaagaaaaatatggaaggaaagatcgttcagcctgagaacctcgaatacaccattgtggtgacaccccactctggcgaggagcatgctgtcgggaatgacaccggaaaacacggcaaggaaatcaaagtgacacctcagtccagcatcaccgaggccgaactgacgggctatgggaccgttacaatggagtgttctcccagaaccggacttgatttcaacgaaatggtgctgctccaaatggagaataaggcgtggctggtccaccggcagtggtttcttgacctgccgctcccttggctgcccggcgccgatacacaggggtccaactggattcagaaggagaccctggtgacgttcaaaaatcctcatgctaagaaacaagacgttgtggtcctcggaagccaggaaggcgccatgcacacagctctgaccggggccacagagatccagatgtcctctggcaaccttctgtttaccggacatctcaagtgccgcctgagaatggacaaacttcaactgaagggcatgagctactccatgtgtaccgggaagttcaaagtggtcaaggaaattgccgagacacagcacggaacgatcgtgattcgggttcagtatgagggcgatgggagcccctgcaaaatccccttcgaaatcatggacctcgagaagagatacgtgctgggacgcctgattaccgtcaaccctatcgtgacagaaaaagattctccggttaatattgaggctgaacccccttttggcgactcctacatcattatcggggtggagcccggccagctcaagctgaactggttcaagaaaggaagctctattggccaaatgtttgagaccacaatgagaggggcgaagagaatggccatccttggagataccgcttgggacttcggcagcctcggaggggtctttacgtccatcggcaaagccctccatcaggtgttcggggccatttatggcgctgccttttctggagtgagctggacaatgaagatcctgattggcgttatcattacctggatcgggatgaatagccgcagcacctctctgtccgtcagccttgtgctcgtgggagtcgtgacactgtacctgggcgttatggtgcaggcggattctgggtgtgtcgtgtcctggaaaaacaaggaactcaagtgcggaagcggcatcttcattaccgacaatgttcacacatggacggagcagtataaatttcaacctgaatccccctctaagctggctagcgccatccagaaagcccaggaggaagggatttgtggcatccggtccgtgaccagacttgagaacctgatgtggaagcagattacaccggagctcaatcacatcctggctgaaaacgaggtcaaactgaccatcatgacaggagatattaagggcatcatgcaagccgggaaacgctctcttcggcctcagcccaccgaactcaagtacagctggaagacgtggggaaaagctaagatgctgtccaccgagagccataatcagacattcctgattgacggccctgaaaccgccgagtgccccaacacaaatagagcgtggaactctctcgaggtggaagattatgggtttggagttttcaccacaaatatctggctgaaacttaaggagaaacaggacgccttttgtgactccaagctgatgagcgctgccattaaggataaccgcgctgtgcacgccgacatgggctactggatcgaatctgcgctcaatgatacctggaaaatcgagaaggcctccttcattgaggtcaaaaactgccattggcctaagagccacacgctgtggtctaacggcgtgctggaaagcgagatgatcattcccaaaaatcttgctgggccggtgtcccaacacaactatcggcctggataccatacacagatcgccggcccctggcacctcgggaagctggaaatggacttcgatttttgtgacggaaccaccgtcgttgtgacagaggattgcggcaatagagggcccagcctgcgcaccacgacagcttctggaaagctcattaccgaatggtgctgtcggtcctgcacactgcctccgcttagataccggggcgaggacggctgttggtatgggatggagatccgccccctgaaagaaaaggaggaaaacctcgtgaatagcctggtcaccgccggacatggccaggtggataacttctccctgggggttcttggaatggccctctttctggaggaaatgctgagaacacgggtgggcaccaaacacgctattctcctggtcgcggtgtctttcgttacgcttatcaccgggaatatgagctttaaggacctgggaagagtggtcgtgatggttggcgccacaatgaccgatgacatcggcatgggggtgacatacctcgctctgctggccgccttcaaagtccgccctacctttgctgccggacttttcctgcggaagctcacgtccaaggagctgatgatgacaaccattggcatcgtgctcctgtctcaaagcacaattcccgagaccatccttgaactgaccgatgcgctcgctctggggatgatggtgctgaaaatggtcagagacatggagaagtatcagcttgccgttacaattatggccatcctgtgcgtgcctaacgctgtgatcctccagaatgcctggaaagtctcctgtacgattctggcggtggtttctgtgagccccctcctgcttacctccagccagcaaaagacagactggatccctctggctctcaccattaaaggactgaaccccacagccatctttctgaccacgctttctcgcacaaataagaaaagatcctggccgctgaacgaagccattatggctgtcggcatggtgagcatcctcgcctcttccctgctcaagaatgatatccctatgaccgggcccctggttgctggaggccttctgaccgtgtgctacgtcctgacaggccggagcgccgacctcgagctggaacgcgcgaccgatgtgaagtgggaggaccaggccgagatttctgggtccagccctatcctttccattacaatcagcgaagatggatctatgagcattaaaaacgaggaagaggagcagacgctgaccatcctcattagaacaggcctgctcgtcatctccgggctgttccccgtgtctatcccgattaccgctgccgcttggtatctttgggaagttaagaaacagcgggccggagtgctgtgggacgtcccttctccccctcccatgggcaaggccgagctggaagatggggcttaccgcatcaaacaaagagggattctgggctattcccagatcggcgcgggggtgtacaaggagggaacatttcataccatgtggcacgttacgcggggcgccgtgctgacccacaaggggaaacgcattgaaccctcctgggctgacgtcaagaaagatcttatcagctacggaggcgggtggaagctggagggagagtggaaagaaggcgaggaagtccaggtgctcgccctggagcctggcaagaatccgagagccgttcagacaaagcccggactcttcaaaaccaacacaggaaccatcggcgctgtctccctggacttttctcctgggacaagcggatcccccattatcgataagaaaggcaaggtggtggggctttatggaaacggcgtcgtgacgcggagcggcgcctacgtttctgcgattgctcaaaccgaaaaatccatcgaggacaatcctgatattgaggacgacatcttccgcaagagacggctgacaatcatggatctgcatcccggggccggaaagaccaaaagatatctccctgccattgtgcgcgaagctatcaagcggggcctgagaacccttattctggccccgacacgcgtcgtggcggctgagatggaagaggccctccgggggctgcccatcagataccagacgcctgccattcgcgctgaacacaccggacgggagatcgttgacctcatgtgtcatgccacattcaccatgagactgcttagccccgtgcgcgtccctaactataatctgattatcatggatgaggctcactttacagaccccgcctctatcgcggcccggggctacatttccaccagagtggaaatgggggaggctgccggcatcttcatgacggctacaccgcctggaagccgggatccctttccccagtccaacgcccctattatcgacgaagaacgcgagattcccgaaagatcttggaatagcggccatgagtgggttaccgatttcaaagggaagaccgtgtggtttgtcccttccatcaaagccggaaacgacatcgctgcgtgcctgcggaagaatggcaagaaagtgattcaactcagccgcaagacattcgattctgaatatgtgaaaaccagaacaaacgactgggattttgtcgttaccacggacatctccgagatgggggccaatttcaaggctgaacgggtgattgacccgagacgctgtatgaaacccgtgatcctgacagatggagaggagcgggtcattcttgccggccctatgcccgtgacccacagctctgccgctcagagacgcgggcggatcggcagaaaccctaagaatgaaaacgaccagtacatctacatgggagagcccctggaaaatgatgaggactgcgcccactggaaagaagcgaagatgctcctggataacattaatacaccggagggcatcattcctagcatgtttgagcccgaacgcgagaaggttgacgctatcgatggggaatatcggctgagaggagaggcccgcaaaaccttcgtggacctcatgagacggggcgatcttcctgtctggctggcctacaaggtggctgccgaagggattaactatgcggaccgcagatggtgttttgatggaatcaaaaacaatcagattctggaggagaacgttgaagtggagatctggacgaaggaaggcgagcggaaaaagctcaagccccgctggctggacgccagaatctactccgatcctcttgctctgaaagagttcaaggagttcgccgctgggcggaaatctctcaccctgaatctgattacagagatgggcagactccccacctttatgacacaaaagacccgcgacgcccttgacaacctggctgtcctgcatacagccgaagcgggaggccgggcctataatcacgctctcagcgagctgccggaaacccttgagacgctgctcctgctgacactccttgccaccgtgaccgggggaatcttcctgtttctgatgtccggcagagggattggaaaaatgacactcggcatgtgctgcatcgtcaccgcttctattctgctttggtacgcccagatccagcctcattggatcgccgctagcattatcctggagttctttctcattgtgctgctgatccccgaacccgagaagcagcgcacacctcaagataaccagctcacgtatgttgtgattgcgatccttaccgtggtcgccgctacaatggccaatgaaatgggcttcctggagaagaccaaaaaggacctggggctcggatccatcgccacacagcagccggaaagcaacattctggatatcgaccttcggcccgcttctgcctggaccctgtacgcggttgccacgacctttgtgacacctatgctcagacactccattgagaatagctccgtgaacgtctctctgaccgctatcgccaatcaagctacagtgctgatgggcctcgggaaaggatggccccttagcaagatggatattggcgcccctctgctggcgatcgggtgttactcccaggttaaccccattaccctcacggccgctctgcttctgctcgtggcccactatgctatcatcggacctggcctgcaggccaaagctacacgggaggcccagaagcgcgcggccgctggcattatgaagaatccgaccgtcgacgggatcacagtgattgatctggaccccatcccttacgatcccaaattcgaaaagcaactcggacaggtcatgcttctggtgctgtgcgttacccaggtgctcatgatgagaaccacatgggccctgtgtgaggctcttacgctggccaccggccctatttctacactctgggaagggaaccccggacggttttggaataccacaatcgccgtcagcatggcgaacatcttccgcggctcctatctggctggggccggactgctctttagcattatgaaaaataccacgaactctagacggggcacaggcaacatcggggagacccttggagaaaagtggaaatcccgcctgaatgctctgggcaagagcgagttccaaatttacaaaaagtctgggatccaggaggtggacagaaccctcgccaaggaaggaattaaacggggcgagacagatcatcacgccgtttcccgcgggagcgctaagctgagatggtttgtggaacggaacatggtcaccccggagggaaaagtggtggaccttggctgcggcagagggggatggtcttattactgtggcgggctgaagaatgttcgcgaggtcaaaggactcacaaagggcgggcctggacatgaggaacccatccccatgagcacgtatggctggaacctggtgcggctgcagtccggcgtggatgtcttcttcatccctcccgaaaagtgcgacaccctcctttgtgacattggggagtctagccctaatccgacagttgaagccggaagaaccctgcgcgtgctgaacctcgtggagaattggctgaacaataacacacagttttgcatcaaagtccttaatccctacatgccttccgtgattgagaagatggaaaccctgcaacggaaatacggcggggcgctcgttagaaaccccctgagccgcaattccacgcacgagatgtattgggtgtctaacgccagcggaaatatcgtctcctctgtgaacatgattagccggatgctgatcaacagattcaccatgcgccataagaaagctacatacgaacctgatgttgacctcggctccgggacccggaatatcggaattgagtctgaaatccccaaccttgatattatcggcaagagaattgagaagatcaaacaggagcacgaaacaagctggcactatgaccaggatcatccgtacaagacctgggcctatcacggctcctacgagacaaaacagaccgggagcgcttcttccatggtgaatggagtcgtgcgcctgctgacgaagccttgggacgtgctccccacagtcacccaaatggccatgaccgatacaacgccttttggccagcagcgggttttcaaagaaaaggtggacaccagaacacaggagcccaaggaagggaccaaaaagctgatgaaaattacagcggagtggctttggaaggagctgggcaagaagaaaacccctcgcatgtgtacaagagaagagtttacccggaaggtgcgcagcaacgccgctctcggcgccatcttcacggatgaaaataagtggaaatctgctagagaggccgtcgaggactcccggttttgggaactggtggataaggagagaaacctgcatctcgaagggaaatgcgagacctgtgtttataatatgatgggaaagcgggagaaaaagctgggcgagttcggcaaggctaaagggagccgcgccatctggtacatgtggcttggagcgagatttctggagttcgaagccctcggctttctgaacgaggaccactggttctctcgggaaaattcccttagcggggtggagggagaaggcctgcaccgcctcgggtacattctgagagacgtctccaagaaagagggcggagctatgtatgccgatgacacagctggctgggatacccggatcacactggaggacctcaagaacgaagagatggtgaccaatcatatggaaggggagcacaaaaagctggccgaagccatttttaaacttacgtaccaaaacaaagttgtgcgcgtccagagacccacaccgcggggaaccgtgatggatatcattagccgcagagaccagcggggctctgggcaagttggaacatatggcctgaataccttcacgaacatggaggcgcagctcatccgccagatggagggggaaggcgtgttcaagaatatccagcatctgaccgtcacagaggaaattgctgtgcaaaactggcttgccagagtcggacgggagcgcctgagcagaatggccatctccggcgatgactgcgtggttaaacctctcgatgaccggtttgcttctgccctgaccgctctgaacgatatggggaagattagaaaagacatccagcagtgggagcccagccgcggatggaatgattggacacaggtgcccttctgctcccaccattttcacgaactcattatgaaggacggccgggtcctggtggtgccttgtagaaaccaagacgagcttatcgggcgcgcccggatctctcagggagcgggctggagcctgagagaaaccgcctgcctcgggaagtcctacgctcagatgtggtctctgatgtatttccaccgccgggatcttagactggccgctaatgccatttgtagcgcggttccgtcccattgggtgcccacaagccgcaccacgtggtctatccacgccaaacatgagtggatgacaaccgaagacatgctcaccgtctggaaccgggtgtggattcaggagaatccttggatggaggataagacacccgttgaatcctgggaggaaatcccttacctgggcaaaagagaggaccaatggtgcggaagcctgattggcctcacctctcgcgctacatgggccaagaacatccaggtggctattaatcaggtccggtccctgatcgggaacgaagagtatacggattacatgcccagcatgaaaagatttcggagagaggaagaggaagccggagtgctttggtga

SEQ ID NO: 19880 - RNA, 9876 nt, synthetic construct
  misc_feature 1..9876: note = derived and/or modified CDS sequence (opt5) from DENV-2__FJ744723__SS-prME
  source 1..9876: mol_type = other RNA
agcgtgggaatgatcattatgctgatccccaccgtgatggccttccacctcacgacgcggaatggggagcctcatatgattgtttccatccaggaaaagggaaaatctctgctttttaagaccgaggacggagtgaatatgtgcacactgatggctatggatctcggggaactgtgtgaggacaccattacatacaaatgcccgcttctgcggcaaaacgaacccgaggatatcgactgttggtgcaattccacctccacatgggtgacctatggaacgtgtaccacaaccggcgagcaccgcagagaaaagcggtctgtcgccctcgtgcctcatgttgggatgggactggagacacgcaccgaaacgtggatgagctccgagggcgcgtggaaacacgctcagagaatcgagacatggattctgcggcatcccggcttcaccatcatggccgccattctcgcttacacaatcgggaccacccactttcagcgcacactgattttcatccttctgacggccgtggctccttctatgaccatgagatgcattggaatcagcaaccgggattttgtcgaaggcgtgtccgggggaagctgggttgacatcgtgctcgagcacggctcttgtgtcacaaccatggccaagaataagcccacactggatttcgaacttattaaaaccgaggcgaagcagcctgccacgctgcgcaaatattgcatcgaagctaagctcacaaacaccaccacagagtccagatgtccgacccaaggggagcccagcctgaaagaagaacaggacaagcggtttgtgtgcaagcattctatggtggatcgcggatggggcaatggctgtgggctgttcggaaaaggcgggattgtcacatgcgccatgtttacgtgcaagaaaaacatggaaggaaagatcgttcagcctgagaatctcgaatacaccattgtggtgacaccccactccggcgaggagcatgctgtcgggaacgacaccggaaaacacggcaaggaaatcaaagtgacacctcagagctctatcaccgaggccgaactgacgggctatgggaccgttacaatggagtgttcccccagaaccggacttgatttcaatgaaatggtgctgctccaaatggagaacaaggcgtggctggtccaccggcagtggtttcttgacctgccgctcccttggctgcccggcgccgatacacaggggagcaattggattcagaaggagaccctggtgacgttcaaaaaccctcatgctaagaaacaagacgttgtggtcctcggatcccaggaaggcgccatgcacacagctctgaccggggccacagagatccagatgtctagcggcaatcttctgtttaccggacatctcaagtgccgcctgagaatggacaaacttcaactgaagggcatgtcctacagcatgtgtaccgggaagttcaaagtggtcaaggaaattgccgagacacagcacggaacgatcgtgattcgggttcagtatgagggcgatgggtctccctgcaaaatccccttcgaaatcatggacctcgagaagagatacgtgctgggacgcctgattaccgtcaaccctatcgtgacagaaaaagattccccggttaacattgaggctgaacccccttttggcgacagctacatcattatcggggtggagcccggccagctcaagctgaattggttcaagaaaggatctagcattggccaaatgtttgagaccacaatgagaggggcgaagagaatggccatccttggagataccgcttgggacttcggctccctcggcggggtctttacgtctatcgggaaagccctccatcaggtgttcggggccatttatggcgctgcctttagcggagtgtcctggacaatgaagatcctgattggcgttatcattacctggatcgggatgaacagccgctctacctccctgagcgtctctcttgtgctcgtgggagtcgtgacactgtacctgggcgttatggtgcaggcggattccgggtgtgtcgtgagctggaaaaataaggaactcaagtgcggatccggcatcttcattaccgacaacgttcacacatggacggagcagtataaatttcaacctgaatctcccagcaagctggcttccgccatccagaaagcccaggaggaagggatttgtggcatccggtctgtgaccagacttgagaatctgatgtggaagcagattacaccggagctcaaccacatcctggctgaaaatgaggtcaaactgaccatcatgacaggagatattaagggcatcatgcaagccgggaaacgcagccttcggcctcagcccaccgaactcaagtactcctggaagacgtggggaaaagctaagatgctgagcaccgagtctcataaccagacattcctgattgacggccctgaaaccgccgagtgccccaatacaaacagagcgtggaactccctcgaggtggaagattatgggtttggagttttcaccacaaacatctggctgaaacttaaggagaaacaggacgccttttgtgacagcaagctgatgtctgctgccattaaggataatcgcgctgtgcacgccgacatgggctactggatcgaatccgcgctcaacgatacctggaaaatcgagaaggccagcttcattgaggtcaaaaattgccattggcctaagtctcacacgctgtggagcaacggcgtgctggaatccgagatgatcattcccaaaaaccttgctgggccggtgagccaacacaattatcggcctggataccatacacagatcgccggcccctggcacctcgggaagctggaaatggacttcgatttttgtgacggaaccaccgtcgttgtgacagaggattgcggcaacagagggccctctctgcgcaccacgacagcttccggaaagctcattaccgaatggtgctgtcggagctgcacactgcctccgcttagataccggggcgaggacggctgttggtatgggatggagatccgccccctgaaagaaaaggaggaaaatctcgtgaactccctggtcaccgccggacatggccaggtggataatttctctctgggggttcttggaatggccctctttctggaggaaatgctgagaacacgggtgggcaccaaacacgctattctcctggtcgcggtgagcttcgttacgcttatcaccgggaacatgtcctttaaggacctgggaagagtggtcgtgatggttggcgccacaatgaccgatgacatcggcatgggggtgacatacctcgctctgctggccgccttcaaagtccgccctacctttgctgccggacttttcctgcggaagctcacgtctaaggagctgatgatgacaaccattggcatcgtgctcctgagccaatccacaattcccgagaccatccttgaactgaccgatgcgctcgctctggggatgatggtgctgaaaatggtcagagacatggagaagtatcagcttgccgttacaattatggccatcctgtgcgtgcctaatgctgtgatcctccagaacgcctggaaagtctcttgtacgattctggcggtggttagcgtgagccccctgctgcttaccagctctcagcaaaagacagactggatccctctggctctcaccattaaaggactgaatcccacagccatctttctgaccacgctttcccgcacaaacaagaaaagaagctggccgctgaatgaagccattatggctgtcggcatggtgtctatcctcgcctccagcctgctcaagaacgatatccctatgaccgggcccctggttgctggaggccttctgaccgtgtgctacgtcctgacaggccggtctgccgacctcgagctggaacgcgcgaccgatgtgaagtgggaggaccaggccgagatttccgggagctcccctatccttagcattacaatctctgaagatggaagcatgtccattaaaaatgaggaagaggagcagacgctgaccatcctcattagaacaggcctgctcgtcatctctgggctgttccccgtgagcatcccgattaccgctgccgcttggtatctttgggaagttaagaaacagcgggccggagtgctgtgggacgtcccttctccccctcccatgggcaaggccgagctggaagatggggcttaccgcatcaaacaaagaggcattctcggctatagccagatcggcgcgggggtgtacaaggagggaacatttcataccatgtggcacgttacgcggggcgccgtgctgacccacaaggggaaacgcattgaacccagctgggctgacgtcaagaaagatcttatctcctacggaggcgggtggaagctggagggagagtggaaagaaggcgaggaagtccaggtgctcgccctggagcctggcaagaacccgagagccgttcagacaaagcccggactcttcaaaaccaatacaggaaccatcggcgctgtctctctggactttagccctgggacatccggaagccccattatcgataagaaaggcaaggtggtggggctttatggaaacggcgtcgtgacgcggtctggcgcctacgtttccgcgattgctcaaaccgagaagtccatcgaggacaaccctgatattgaggacgacatcttccgcaagagacggctgacaatcatggatctgcatcccggggccggaaagaccaaaagatatctccctgccattgtgcgcgaagctatcaagcggggcctgagaacccttattctggccccgacacgcgtcgtggcggctgagatggaagaggccctccgggggctgcccatcagataccagacgcctgccattcgcgctgaacacaccggacgggagatcgttgacctcatgtgtcatgccacattcaccatgagactgctttctcccgtgcgcgtccctaattataacctgattatcatggatgaggctcactttacagaccccgcctccatcgcggcccggggctacattagcaccagagtggaaatgggggaggctgccggcatcttcatgacggctacaccgcctggatcccgggatccctttccccagtctaatgcccctattatcgacgaagaacgcgagattcccgaaagaagctggaactccggccatgagtgggttaccgatttcaaagggaagaccgtgtggtttgtccctagcatcaaagccggaaatgacatcgctgcgtgcctgcggaagaacggcaagaaagtgattcaactctctcgcaagacattcgattccgaatatgtgaaaaccagaacaaatgactgggattttgtcgttaccacggacatcagcgagatgggggccaacttcaaggctgaacgggtgattgacccgagacgctgtatgaaacccgtgatcctgacagatggagaggagcgggtcattcttgccggccctatgcccgtgacccactctagcgccgctcagagacgcgggcggatcggcagaaatcctaagaacgaaaatgaccagtacatctacatgggagagcccctggaaaacgatgaggactgcgcccactggaaagaagcgaagatgctcctggataatattaacacaccggagggcatcattccttccatgtttgagcccgaacgcgagaaggttgacgctatcgatggggaatatcggctgagaggagaggcccgcaaaaccttcgtggacctcatgagacggggcgatcttcctgtctggctggcctacaaggtggctgccgaagggattaattatgcggaccgcagatggtgttttgatggaatcaaaaacaaccagattctggaggagaatgttgaagtggagatctggacgaaggaaggcgagcggaaaaagctcaagccccgctggctggacgccagaatctactctgatcctcttgctctgaaagagttcaaggagttcgccgctgggcggaaaagcctcaccctgaacctgattacagagatgggcagactccccacctttatgacacaaaagacccgcgacgcccttgacaatctggctgtcctgcatacagccgaagcgggaggccgggcctataaccacgctctctccgagctgccggaaacccttgagacgctgctcctgctgacactccttgccaccgtgaccgggggaatcttcctgtttctgatgtctggcagagggattggaaaaatgacactcggcatgtgctgcatcgtcaccgctagcattctgctttggtacgcccagatccagcctcattggatcgccgcttccattatcctggagttctttctcattgtgctgctgatccccgaacccgagaagcagcgcacacctcaagataatcagctcacgtatgttgtgattgcgatccttaccgtggtcgccgctacaatggccaacgaaatgggcttcctggagaagaccaaaaaggacctggggctcggaagcatcgccacacagcagccggaatctaatattctggatatcgaccttcggcccgcttccgcctggaccctgtacgcggttgccacgacctttgtgacacctatgctcagacacagcattgagaactcctctgtgaatgtcagcctgaccgctatcgccaaccaagctacagtgctgatgggcctcgggaaaggatggcccctttccaagatggatattggcgcccctctgctggcgatcgggtgttactctcaggttaatcccattaccctcacggccgctctgcttctgctcgtggcccactatgctatcatcggacctggcctgcaggccaaagctacacgggaggcccagaagcgcgcggccgctggcattatgaagaacccgaccgtcgacgggatcacagtgattgatctggaccccatcccttacgatcccaaattcgaaaagcaactcggacaggtcatgcttctggtgctgtgcgttacccaggtgctcatgatgagaaccacatgggccctgtgtgaggctcttacgctggccaccggccctattagcacactctgggaagggaatcccggacggttttggaacaccacaatcgccgtctccatggcgaatatcttccgcggcagctatctggctggggccggactgctcttttctattatgaaaaacaccacaaattccagacggggcacaggcaacatcggggagacccttggagaaaagtggaaaagccgcctgaacgctctgggcaagtctgagttccaaatttacaaaaagtccgggatccaggaggtggacagaaccctcgccaaggaaggaattaaacggggcgagacagatcatcacgccgttagccgcgggtctgctaagctgagatggtttgtggaacggaatatggtcaccccggagggaaaagtggtggaccttggctgcggcagagggggatggagctattactgtggcgggctgaagaacgttcgcgaggtcaaaggactcacaaagggcgggcctggacatgaagaacccatccccatgtccacgtatggctggaatctggtgcggctgcagtctggcgtggatgtcttcttcatccctcccgaaaagtgcgacaccctcctttgtgacattggggagagctcccctaacccgacagttgaagccggaagaaccctgcgcgtgctgaatctcgtggagaactggctgaataacaatacacagttttgcatcaaagtccttaacccctacatgcctagcgtgattgagaagatggaaaccctgcaacggaaatacggcggggcgctcgttagaaatcccctgtcccgcaactctacgcacgagatgtattgggtgagcaatgcctccggaaacatcgtctctagcgtgaatatgatttcccggatgctgatcaacagattcaccatgcgccataagaaagctacatacgaacctgatgttgacctcggctctgggacccggaacatcggaattgagagcgaaatccccaatcttgatattatcggcaagagaattgagaagatcaaacaggagcacgaaacatcctggcactatgaccaggatcatccgtacaagacctgggcctatcacggcagctacgagacaaaacagaccgggtctgcttccagcatggtgaacggagtcgtgcgcctgctgacgaagccttgggacgtgctccccacagtcacccaaatggccatgaccgatacaacgccttttggccagcagcgggttttcaaagaaaaggtggacaccagaacacaggagcccaaggaagggaccaaaaagctgatgaaaattacagcggagtggctttggaaggagctgggcaaaaagaaaacccctcgcatgtgtacaagagaagagtttacccggaaggtgcgctctaatgccgctctcggcgccatcttcacggatgaaaacaagtggaaatccgctagagaggccgtcgaggacagccggttttgggaactggtggataaggagagaaatctgcatctcgaagggaaatgcgagacctgtgtttataacatgatgggaaagcgggagaaaaagctgggcgagttcggcaaggctaaagggtctcgcgccatctggtacatgtggcttggagcgagatttctggagttcgaagccctcggctttctgaatgaggaccactggttctcccgggaaaacagcctttccggggtggagggagaaggcctgcaccgcctcgggtacattctgagagacgtcagcaagaaagagggcggagctatgtatgccgatgacacagctggctgggatacccggatcacactggaggacctcaagaatgaagagatggtgaccaaccatatggaaggggagcacaaaaagctggccgaagccatttttaaacttacgtaccaaaataaagttgtgcgcgtccagagacccacaccgcggggaaccgtgatggatatcatttctcgcagagaccagcggggcagcgggcaagttggaacatatggcctgaacaccttcacgaatatggaggcgcagctcatccgccagatggagggggaaggcgtgttcaagaacatccagcatctgaccgtcacagaggaaaccgctgtgcaaaattggcttgccagagtcggacgggagcgcctgtccagaatggccatttctggcgatgactgcgtggttaaacctctcgatgaccggtttgctagcgccctgacagctctgaacgatatggggaagatcagaaaagacattcagcagtgggagccctcccgcggatggaacgattggacccaggtgcccttctgctctcaccattttcacgaactcatcatgaaggacggccgggtcctggtggtgccttgtagaaatcaagacgagcttattgggcgcgcccggatcagccagggagcgggctggtccctgagagaaacagcctgcctcgggaagtcttacgctcagatgtggagcctgatgtatttccaccgccgggatcttagactggccgctaacgccatctgttccgcggttccgagccattgggtgcccacctctcgcacgacatggtccattcacgccaaacatgagtggatgaccaccgaagacatgctcacagtctggaatcgggtgtggatccaggagaacccttggatggaggataagacccccgttgaaagctgggaggaaattccttacctgggcaaaagagaggaccaatggtgcggatctctgatcggcctcacatcccgcgctacgtgggccaagaatattcaggtggctatcaaccaggtccggagcctgattgggaatgaagagtataccgattacatgccctccatgaaaagatttcggagagaggaagaggaagccggagtgctttggtga

SEQ ID NO: 19881 - RNA, 9876 nt, synthetic construct
  misc_feature 1..9876: note = derived and/or modified CDS sequence (opt5) from DENV-2__FJ744724__SS-prME
  source 1..9876: mol_type = other RNA
agcgccggaatgatcattatgctgatccccacagtgatggctttccacctgacgacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcattgtggatcgcggctggggcaatgggtgtggactgttcggcaaagggggaatcgtcacatgcgctatgtttacatgcaagaaaaacatggaaggcaagattgttcagcctgagaatctcgaatacacgatcgtggtgacaccccactctggggaggagcatgccgtcggaaacgacacaggcaaacacggcaaggaaatcaaagtgacccctcagtccagcgttacagaggcggaactgaccgggtatggaacggtgaccatggagtgttctcccagaacaggccttgatttcaatgaaatggtcctgctccaaatggagaacaaggcctggctggtgcaccggcagtggtttcttgacctgccgctcccttggctgcccggggctgataagcaggagtccaattggattcagaaagaaaccctggttacattcaagaaccctcatgccaaaaagcaagacgtggtcgtgctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtcgtgaaagagattgctgagacccagcacggaaccatcgttattcgggtgcagtatgaaggcgatgggagcccctgcaagatccccttcgagatcatggacctcgagaagcggtacgtcctgggacgcctgattacagtgaaccctatcgttacggagaaggattctccggtgaacattgaagcggagcccccttttggcgactcctacatcattatcggggtcgagcccggccagctcaagctgaattggttcaaaaagggaagctctattggccaaatgtttgaaaccacaatgagaggggccaaaagaatggctatccttggagataccgcctgggacttcggcagcctcgggggagtgtttacatccatcggcaaggccctccatcaggtgttcggggctatttatggcgccgcgttttctggagttagctggaccatgaaaatcctgattggcgtcatcattacgtggatcgggatgaactcccgcagcacatctctgtccgtgagccttgtgctcgtcggaatcgtgaccctgtacctgggcgttatggtgcaggctgattctgggtgtgtcgtgtcctggaagaataaggagctcaaatgcggaagcggcattttcatcaccgacaacgttcacacatggaccgaacagtataagtttcaacctgagtccccctctaaactggccagcgccattcagaaggctcaggaagaggggatctgtggcattcggtccgtgacaagacttgagaatctgatgtggaaacagatcacgccggaactcaaccacatcctggccgagaatgaagtcaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtggaggattacgggtttggagttttcaccacaaacatttggctgaaacttaaagaaaagcaggacgctttttgtgactccaagctgatgagcgccgctatcaaagataatcgcgccgtgcatgcggacatgggctattggatcgagtctgccctcaacgatacctggaagattgagaaggctagcttcatcgaagtcaagaattgccactggcctaaaagccatacactgtggtctaacggcgtgctggagagcgaaatgattatccccaagaaccttgccgggccggtgtcccaacacaattaccggcctggataccacacccagattgctggcccctggcatctcgggaagctggagatggacttcgatttttgtgacggaacgacagtcgttgtgaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaattcgccccctgaaggagaaagaagagaatctcgtgaacagcctggtcaccgccggacacggccagatcgataatttctccctgggggtgcttggaatggctctctttctggaagagatgctgagaacacgggttggcaccaagcatgcgatcctcctggtggccgtctctttcgtgacacttattaccgggaacatgagctttaaagacctgggaagagttgtggtcatggtgggcgctacgatggccgatgacatcggcatgggggttacctatctcgccctgctggctgccttcaaggtgcgccctacatttgcggctggacttctgctccggaagctgacctccaaagagctcatgatgacaaccattggcatcgtcctgctttctcaaagcacgattcccgaaacagtgctggagctcaccgatgccctggccctggggatgatggtgcttaagatcgtcagagacatggaaaaataccagctggctgttacaatcatggccattctctgcgtgcctaatgcggtgatcctgcagaacgcttggaaggtctcctgtaccattctcgccgtggtttctgtgagccccctgcttctgacctccagccagcagaagacggactggatccctctcgccctgacgattaagggactgaatcccaccgctatcttccttacaaccctgtctcgcacaaacaaaaagagatcctggccgctcaatgaggccatcatggctgtcggcatggtgagcattctggcctcttccctcctgaagaacgatatccctatgaccgggccccttgttgcgggaggcctgctgacggtgtgctatgtcctcacaggccggagcgccgacctggaacttgagcgcgctaccgatgtgaaatgggaggaccaggccgaaatttctgggtccagccctatcctgtccattaccatcagcgaggatggatctatgagcattaagaatgaagaggaggaacagacactcaccatcctgatcagaacaggcctcctggtcatttccgggctttttcccatctctattccgatcacggctgccgcctggtacctgtgggaggtgaaaaagcagcgggctggagttctgtgggacgtgccttctccccctcccatgggcaaagcggaactcgaggatggggcctatcgcattaagcaaaagggaatcctgggctactcccagatcggcgctggggtctacaaagaaggaaccttccacacaatgtggcatgtgaccagaggcgccgttcttatgcacaaggggaaacggattgagccctcctgggccgacgtgaagaaagatctgatcagctatggaggcgggtggaagctcgagggagaatggaaggagggcgaagaggtccaggtgctggctctcgaacctggcaaaaacccgcgcgccgtgcagacaaagcccgggctgtttaaaaccaatacgggaaccattggcgcggtttcccttgacttctctcctgggacaagcggatcccccatcattgataagaaaggcaaggtcgtggggctgtacggaaacggcgtggtcaccagaagcggcgcttatgtgtctgccatcgcccaaacagagaagtccatcgaggacaaccctgaaattgaggatgacatctttcggaaacgcagactgaccattatggacctccaccccggggctggaaagacaaaacggtacctgcctgccatcgttagagaagcgattaagcgcggccttcggacgctgatcctcgctccgaccagagtggtcgccgccgagatggaagaggctctgcgcgggctccccattcggtatcagacccctgccatcagagctgagcataccggacgcgaaatcgtggatctgatgtgtcacgccaccttcacaatgcggcttctgagccccgttagagtgcctaattacaacctgattatcatggacgaggcgcatttcacggatcccgcctctattgctgcccgcggctatatctccacccgggtcgaaatgggggaggctgccggcatttttatgacagccaccccgcctggaagcagagaccccttcccccagtccaatgctcctatcatcgatgaggaacgggagattcccgaacgctcttggaacagcggccacgagtgggtgacagactttaaagggaagaccgtttggttcgtgccttccatcaaggcgggaaatgatattgccgcttgcctccgcaaaaacggcaagaaagtcatccaactgagccggaagacgtttgactctgaatacgtgaaaacacgcaccaatgattgggacttcgtggtcaccacagatatttccgagatgggggccaactttaaggccgagagagttatcgacccgcggagatgtatgaaacccgtgatccttaccgacggagaggaacgcgtgattctggctggccctatgcccgtcacacatagctctgccgcgcagcggagagggcgcatcggccggaatcctaagaacgaaaatgatcagtacatttatatgggagagcccctcgaaaacgacgaggattgcgctcactggaaggaggccaaaatgctgctggacaatatcaacaccccggaaggcattatccctagcatgttcgagcccgaaagagagaaggtggatgccattgacggggaataccgcctccggggagaggctagaaaaacgtttgttgatcttatgcgcagaggcgacctgcctgtgtggctggcctataaggtcgcggccgaggggatcaattacgctgatcggcgctggtgtttcgacggaatcaaaaacaaccagattctcgaagagaatgtggaagttgagatctggacaaaggagggcgaaagaaagaaactgaagccccggtggcttgatgcccgcatttattccgaccctctggctctcaaagagtttaaggagttcgccgctgggagaaaatctctgaccctgaacctcatcacagagatgggccggcttcccaccttcatgacgcaaaagaccagagatgccctggacaatctggcggtgctccacacagccgaagctggaggccgcgcctacaaccatgctctgagcgagcttccggagaccctggaaacactcctgctgctcacccttctggccacagtcaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtgctgctcattcccgaacccgagaaacagagaacccctcaagacaatcagcttacctacgtcgtgatcgctattctgacagttgtggccgccaccatggctaacgaaatgggctttctggagaagaccaagaaggatctcgggctgggatccatcgccacgcagcagccggagagcaatattcttgacatcgatctgcgccccgcgtctgcctggaccctctacgctgtggccacaaccttcgtcacacctatgctgcggcattccattgaaaacagctccgttaatgtgtctctgaccgctatcgccaaccaagcgacggtgctcatgggccttgggaaaggatggcccctgagcaagatggacatcggcgtccctctgctcgccattgggtgttattcccaggtgaatcccatcaccctgacagctgcccttctgctcctggttgctcactacgccattatcggacctggcctgcaggctaaggccaccagagaggcgcagaaacgggccgctgccggcattatgaagaacccgacagtggatgggatcaccgtcatcgacctcgatcccattccttatgaccccaaatttgaaaagcaacttggacaggtgatgctgctgatcctctgcgtcacacaggtgctgatgatgcgcacaacctgggctctttgtgaggccctgacactcgccaccggccctatttctaccctgtgggaagggaatcccggaagattctggaacacaacgatcgcggttagcatggctaatatttttcggggctcctacctggccggggctggactccttttcagcatcatgaaaaacaccacaaatacccgcagaggcacaggcaacatcggggagaccctgggagagaagtggaaatctcggctgaacgccctcggcaagtccgaatttcaaatttataagaaaagcgggatccaggaggtggatcgcacgctggccaaggaaggaattaaaagaggcgagacagaccaccatgctgtctctcgggggtccgccaaacttcgctggttcgtggagagaaatatggttaccccggaaggaaaagtggtcgatctgggctgcggcagagggggatggagctactattgtggcgggctcaagaacgtgcgggaggtgaagggactgaccaaaggcgggcctggacacgaagaacccatccccatgtctacatacggctggaatctggttcgcctccagagcggcgtcgacgtgtttttcattcctcccgaaaagtgcgatacccttctgtgtgacatcggggagtcctctcctaacccgacagtggaggcgggacggacgctgagagtcctcaatctggttgaaaactggcttaataacaatacccagttctgcatcaaagtgctgaacccctacatgcctagcgtgattgagaagatggaagccctccaacgcaaatatggcggggctctggtccggaatcccctgtccagaaacagcacacatgagatgtactgggtgtccaatgcctctggaaacatcgttagctccgtgaatatgatttctcgcatgctcatcaaccggtttaccatgagacacaagaaggctacatatgaacctgacgtcgatcttggcagcgggacccgcaacattggaatcgagtccgaggtgcccaatctggacattatcggcaaacggatcgaaaagattaaacaggagcatgaaacgtcttggcactacgatcaggaccacccgtataagacctgggcctaccatggcagctatgagacaaaacagaccgggtccgcgagctctatggttaacggagtggtcagactgctcacaaagccttgggatgtgctgcccaccgtgacacaaatggccatgaccgacacgacacctttcggccagcagcgcgtctttaaggaaaaagttgatacccggacccaggagcccaaggaggggaccaagaaacttatgaaaatcacggctgaatggctgtggaaggagctcggcaaaaagaagacccctagaatgtgtacacgcgaagagttcaccagaaaagtgcggtccaatgccgctctgggcgccatttttacagacgagaacaagtggaaaagcgctcgcgaagccgtggaggattctagattctgggaactggtcgacaaggagcggaatctccacctggaagggaaatgcgagacctgtgtgtacaacatgatgggaaagagagagaagaaacttggcgaatttggcaaggcgaaagggtcccgggccatctggtacatgtggctgggagctcgcttcctcgagtttgaagccctgggcttccttaatgaggatcattggtttagcagagaaaactctctgtccggggttgagggagagggcctccacaagctggggtatattctgcgggacgtgagcaaaaaggaaggcggagctatgtacgccgacgatacagccggctgggacacccgcatcacgctcgaggatctgaagaatgaagagatggtcaccaaccacatggaaggggagcataagaaacttgcggaggctatcttcaaactgacatatcaaaataaagtggttagagtgcagcggcccaccccgcgcggaacagtcatggacattatctccagacgggatcagcgcggcagcgggcaagtgggaacctacggcctcaacacgtttacaaatatggaagcccagctgattagacagatggagggggaaggcgttttcaaaaacatccagcaccttaccgtgacagaggaggtcgccgtgcaaaattggctggctcgggtcggacgcgaaagactctctcggatggccattagcggcgacgattgcgtggttaagcctctggacgatcgcttcgctaacgccctgaccgcgctcaacgacatggggaagatcagaaaagatatccagcagtgggagccctccaagggatggaatgactggacacaggtgcccttttgctctcatcacttccatgaactgattatgaaagatggccgggtccttgtggtgccttgtagaaaccaagacgagctgatcgggcgcgcccggattagccagggagctggctggtccctcagagaaaccgcctgcctggggaagtcttatgctcagatgtggagccttatgtactttcaccgccgggacctgagactcgccgcgaatgccatctgttccgctgttccgtctcactgggtgcccacaagccgcaccacatggtccattcatgccaaacacgagtggatgaccacagaggatatgctgaccgtctggaaccgggtgtggatcagagaaaatccttggatggaggacaagacgcccgttgaaagctgggaggaaattccttatctgggcaagcgcgaggatcagtggtgcggatctctcatcggcctgacatcccgggctacctgggccaaaaacatccaaaccgctattaatcaggtgagaagccttatcgggaacgaggaatacacagactacatgccctctatgaagcgcttccggagagaggaagaggaagccggagtcctgtggtga

SEQ ID NO: 19882 - RNA, 9876 nt, synthetic construct
  misc_feature 1..9876: note = derived and/or modified CDS sequence (opt5) from DENV-2__FJ906957__SS-prME
  source 1..9876: mol_type = other RNA
agcgctggaatgatcattatgctgatccccaccgtgatggctttccacctgaccacgcggaatggggagcctcatatgattgtctccatccaggagaagggaaagtctctgctttttaagaccgaggacggcgttaatatgtgcacgctgatggccatggatctcggggaactgtgtgaggacaccattacatacaagtgcccgcttctgcggcaaaatgaacccgaggatatcgactgttggtgcaattccacctccacatgggtgacctatggaacgtgtaccacaaccggcgagcacagaagagaaaagcggtctgtggcgctcgttcctcatgtggggatgggactggagacacgcaccgaaacgtggatgagctccgagggcgcttggaagcacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaggaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgataagcaggggagcaattggattcagaaagagaccctggtcacattcaagaaccctcatgctaaaaagcaagacgtggttgtgctcggatcccaggaaggcgccatgcacaccgccctgacgggggctacagagatccagatgtctagcggcaatcttctgtttaccggacatctcaaatgccgcctgagaatggacaaacttcaactgaagggcatgtcctacagcatgtgtacagggaaattcaaggtcgtgaaagaaattgcggagacccagcacggaaccatcgtcattcgggtgcagtatgagggcgatgggtctccctgcaagatccccttcgaaatcatggacctcgagaaaagatacgttctgggacgcctgattacagtgaaccctatcgtcacggaaaaggattccccggtgaacattgaggccgaacccccttttggcgacagctacatcattatcggggttgagcccggccagctcaagctgaattggttcaaaaagggatctagcattggccaaatgtttgagaccacaatgagaggggctaaaagaatggccatccttggagataccgcctgggacttcggctccctcgggggagtgtttacatctatcggcaaggctctccatcaggtcttcggggccatttatggcgcggcttttagcggagtgtcctggaccatgaaaatcctgattggcgtgatcattacgtggatcgggatgaacagccgctctacatccctgagcgtttctcttgtcctcgtgggaatcgtgaccctgtacctgggcgtcatggtgcaggccgattccgggtgtgttgtgagctggaagaataaggaactcaaatgcggatccggcattttcatcaccgacaacgtccacacatggaccgagcagtataagtttcaacctgaatctcccagcaaactggcctccgctattcagaaggcccaggaggaagggatctgtggcattcggtctgtgacaagacttgagaatctgatgtggaaacagatcacgccggagctcaaccacatcctggctgaaaatgaggttaagctgaccattatgacaggagatatcaaaggcattatgcaagccgggaagcgcagccttcggcctcagcccaccgaactcaagtactcctggaaaacatggggaaaggcgaaaatgctgagcaccgagtctcataaccagacgttcctgatcgacggccctgaaaccgccgagtgccccaatacaaacagagcttggaactccctcgaggtggaagattatgggtttggagtcttcaccacaaacatttggctgaaacttaaagagaagcaggacgccttttgtgacagcaagctgatgtctgctgccatcaaagataatcgcgcggtgcacgccgacatgggctactggatcgaatccgctctcaacgatacctggaagattgagaaagccagcttcatcgaggttaagaattgccattggcctaaatctcacacactgtggagcaacggcgtgctggaatccgagatgattatccccaagaaccttgctgggccggtcagccaacacaattatcggcctggataccatacccagattgccggcccctggcacctcgggaagctggaaatggacttcgatttttgtgacggaacgacagtggtggtcaccgaggattgcggcaacagagggccctctctgcgcaccacaaccgcctccggaaaactcatcacggaatggtgctgtcggagctgcacactgcctccgcttagataccggggcgaggacggctgttggtatgggatggagattcgccccctgaaggaaaaagaggaaaatctcgttaactccctggtgaccgctggacatggccaggtggataatttctctctgggggtccttggaatggcgctctttctggaggaaatgctgagaacacgggtgggcaccaagcacgccatcctcctggttgctgccagcttcgtgacacttatcaccgggaacatgtcctttaaagacctgggaagagtcgtggttatggtgggcgccacgatgaccgatgacattggcatgggggtcacatacctcgctctgctggccgcgttcaaggtgcgccctacctttgctgccggacttctgctccggaagctgacatctaaagagctcatgatgaccacgatcggcattgttctgcttagccaatccacaatccccgagaccattctggaactcacagatgccctggctctggggatgatggtgcttaagatcgtcagaaatatggagaaatatcagctggccgtgaccatcatggcgattctctgcgtgcctaacgctgtcatcctgcagaatgcctggaaggtttcttgtaccattctcgccgtggtgagcgtcagccccctgcttctgacaagctctcagcagaagacggactggatccctctcgctctgaccattaagggactgaaccccacagccatcttccttaccacactgtcccgcaccaataaaaagagaagctggccgctcaacgaagctatcatggccgtgggcatggtttctattctggcgtccagcctcctgaagaatgacatccctatgacggggccccttgtggccggaggcctgctgacagtctgctacgtgctcaccggccggtctgctgatctggagcttgaacgcgccaccgacgttaaatgggaggatcaggctgagatttccgggagctcccctatcctgagcattacaatctctgaagacggaagcatgtccattaagaacgaggaagaggagcagaccctcacaatcctgatcagaacgggcctcctggtgatttctgggctttttcccgtcagcatcccgattaccgccgccgcttggtatctgtgggaagtgaaaaagcagcgggcgggagtcctgtgggatgtgccttctccccctcccatgggcaaagccgagctcgaagacggggcttaccgcatcaagcaaaaggggattctgggctatagccagatcggcgccggggtttacaaagagggaacattccataccatgtggcacgtgacaagaggcgccgtccttatgcacaaggggaaacggatcgaacccagctgggctgatgtgaagaaagacctgatttcctacggaggcgggtggaagctcgagggagagtggaaggaaggcgaggaagttcaggtgctggccctcgagcctggcaaaaatccgcgcgcggtccagaccaagcccgggctgtttaaaacgaacaccggaacaatcggcgctgtgtctcttgatttcagccctgggacctccggaagccccattatcgacaagaaaggcaaggtggttgggctgtatggaaacggcgtcgtgacaagatctggcgcctacgtgtccgccattgctcaaaccgaaaagagcatcgaggataatcctgagatcgaagacgatatttttcggaaacgcagactgacaatcatggacctccatcccggggccggaaagacgaaacggtatctgcctgcgattgtcagagaggctatcaagcgcggccttcggaccctgattctcgccccgacaagagtggttgccgctgaaatggaggaagccctgcgcgggctccccatccggtaccagacccctgctattagagccgagcacaccggacgcgagatcgtggacctgatgtgtcatgcgacattcacgatgcggcttctgtctcccgtcagagtgcctaactataatctgatcattatggatgaagcccacttcaccgaccccgcttccatcgccgctcgcggctacattagcacacgggttgagatgggggaagccgccggcatctttatgaccgctacaccgcctggatccagagatcccttcccccagtctaacgcgcctattatcgacgaggagcgggaaatccccgagcgcagctggaactccggccatgaatgggtgaccgattttaaagggaagacggtctggttcgtgcctagcattaaggccggaaacgacatcgctgcctgcctccgcaaaaatggcaagaaagttattcaactgtctcggaagacatttgattccgagtatgtgaaaacccgcaccaacgactgggatttcgtcgtgacaaccgacatcagcgaaatgggggccaattttaaggctgagagagtgattgatccgcggagatgtatgaaacccgtcatccttacagacggagaggaacgcgttatcctggccggccctatgcccgtgacccactctagcgcggctcagcggagagggcgcattggccggaaccctaagaatgagaacgaccagtacatctacatgggagaacccctcgagaatgatgaagactgcgcccactggaaggaggccaaaatgctgctggataacattaatacgccggagggcatcattccttccatgttcgaacccgagagagaaaaggtggacgctatcgatggggagtatcgcctccggggagaagccagaaaaacatttgtcgaccttatgcgcagaggcgatctgcctgtgtggctggcgtacaaggttgccgctgaggggattaactatgccgaccggcgctggtgtttcgatggaatcaaaaacaatcagatcctcgaggaaaacgtggaggtcgaaatttggaccaaggagggcgagagaaagaaactgaagccccggtggcttgacgctcgcatctactctgatcctctggccctcaaagaatttaaggagttcgctgccgggagaaaaagcctgacactgaatctcattaccgaaatgggccggcttcccacgttcatgacccaaaagacaagagacgcgctggataacctggccgtgctccataccgctgaggccggaggccgcgcttataatcacgccctgtccgaacttccggagacactggagaccctcctgctgctcacacttctggccaccgttacagggggaatctttctgttcctcatgtctggccgggggattggaaagatgacactgggcatgtgctgcatcatcaccgctagcattcttctgtggtacgcgcagatccagcctcattggattgccgcttccatcattctcgaatttttcctgatcgtgctgctcatccccgagcccgaaaaacagagaacccctcaagacaaccagcttacatatgtcgtgattgccatcctgaccgtcgtggccgctacaatggccaatgagatgggctttctggaaaagacgaaaaaggacctcgggctgggaagcattgcgacccagcagccggagtctaacatccttgatattgacctgcgccccgcctccgcttggacactctacgccgttgctaccacattcgtgacccctatgctgcggcacagcatcgaaaattcctctgtgaacgtcagcctgacggccattgcgaatcaagccaccgttctcatgggccttgggaaaggatggcccctgtccaagatggatatcggcgtgcctctgctcgctatcgggtgttactctcaggtgaaccccattacactgaccgccgcccttctgctcctggtcgcccactatgctatcattggacctggcctgcaggccaaggcgacaagagaagcccagaaacgggctgccgctggcatcatgaagaatccgaccgtggacgggattacggttatcgatctcgaccccatcccttacgatcccaaatttgagaagcaacttggacaggtgatgctgctgattctctgcgtcacacaggtgctgatgatgcgcaccacatgggccctttgtgaagccctgaccctcgcgaccggccctatcagcacactgtgggaggggaaccccggaagattctggaatacgaccattgctgtctccatggccaacatctttcggggcagctatctggctggggccggactccttttctctattatgaaaaatacaaccaacacacgcagaggcaccggcaacatcggggaaacgctgggagagaagtggaaatcccggctgaatgccctcggcaagagcgagtttcaaatctacaagaaatctgggattcaggaagtggaccgcacactggctaaggagggaatcaaaagaggcgaaaccgatcatcacgccgtttcccgggggagcgcgaaacttcgctggttcgtggagagaaacatggtcaccccggagggaaaagtggttgacctgggctgcggccggggaggatggtcttattactgtggcgggctcaagaatgtgagagaagtcaagggactgacaaaaggcgggcctggacatgaggaacccattcccatgagcacctatggctggaacctggtgcgcctccagtccggcgtggatgtctttttcatccctcccgagaagtgcgacacacttctgtgtgatattggggaatctagccctaatccgacggtcgaggccggacggaccctgagagtgctcaacctggtggagaattggcttaacaataacacacagttctgcatcaaagtcctgaatccctacatgccttccgttatcgaaaagatggaggctctccaacgcaaatacggcggggccctggtgcggaaccccctgagcagaaattccacccacgaaatgtattgggtgtctaacgctagcggaaatattgtctcctctgtgaacatgatcagccgcatgctcattaaccggtttacaatgagacataagaaggccacctacgagcctgacgttgaccttggctccgggacgcgcaatatcggaattgaatctgagatccccaacctggatattatcggcaaacggatcgagaagattaaacaggaacacgagaccagctggcactatgaccaggatcatccgtacaagacatgggcgtatcacggctcctacgaaaccaaacagacagggagcgcctcttccatggtgaatggagtcgtgagactgctcaccaagccttgggacgttctgcccacagtgacccaaatggctatgacggatacaacccctttcggccagcagcgcgtctttaaggagaaagtggacacccggacacaggaacccaaggaggggacgaagaaacttatgaaaatcaccgccgagtggctgtggaaagaactcggcaagaagaagacacctagaatgtgtacccgcgaggagttcacaagaaaagtgcggagcaacgctgccctgggcgctatttttaccgatgagaataagtggaaatctgcccgcgaggcggtcgaagactccagattctgggagctggttgataaggaacggaacctccatctggaggggaaatgcgaaacatgtgtgtataatatgatgggaaagagagagaagaaacttggcgagtttggcaaggccaaagggagccgggctatctggtacatgtggctgggagcccgcttcctcgaatttgaggctctgggcttccttaacgaagaccactggttttctagagaaaattccctgagcggggtggaaggagagggcctccacaagctggggtacattctgcgggatgtctccaaaaaggagggcggagccatgtatgccgacgacaccgcgggctgggatacgcgcatcaccctcgaagacctgaagaacgaggaaatggtgacaaatcatatggagggggaacacaagaaacttgctgaggccatcttcaaactgacctaccaaaacaaagttgtgagagtccagcggcccacaccgcgcggaaccgtgatggatattatcagcagacgggaccagcgcggctctgggcaagttggaacgtatggcctcaatacatttaccaacatggaggcccagctgattagacagatggaaggggagggcgtgttcaaaaatatccagcatcttacagtcaccgaagagattgctgtgcaaaactggctggcccgggttggacgcgagagactcagccggatggctatctccggcgatgactgcgtggtcaagcctctggatgaccgcttcgccaacgcgctgacggccctcaatgatatggggaagatcagaaaagacattcagcagtgggaaccctctaagggatggaacgattggacccaggtgcccttttgcagccaccatttccacgagctgatcatgaaagacggccgggtccttgtggttccttgtagaaatcaagatgaactgattgggcgcgctcggatctcccagggagccggctggtctctcagagagacagcttgcctggggaagtcctacgcccagatgtggtcccttatgtattttcaccgccgggacctgagactcgcggccaacgctatttgttctgccgtgccgagccattgggtccccacctcccgcacaacctggagcatccacgctaaacatgaatggatgacaaccgaggacatgctgacggtgtggaatcgggtgtggattcaggagaacccttggatggaagataagacacccgttgagtcttgggaagagatcccttacctgggcaagagagaagaccaatggtgcggatccctcatcggcctgaccagccgcgccacctgggctaaaaatattcaggccgcgatcaaccaggtgcggtctcttattgggaatgaggagtatacagattacatgccctccatgaagagattccgccgggaagaggaagaggccggagtcctgtggtga

SEQ ID NO: 19883 - RNA, 9876 nt, synthetic construct
  misc_feature 1..9876: note = derived and/or modified CDS sequence (opt5) from DENV-2__FJ906958__SS-prME
  source 1..9876: mol_type = other RNA
tccgtcggcatgatcattatgctgatccccaccgtcatggccttccacctgaccacgcggaatggggagcctcatatgattgtttccatccaggaaaagggaaagtctctgctttttaagaccgaggacggcgtgaatatgtgcacactgatggctatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtcgccctcgtgcctcatgttgggatgggactggagacacgcaccgaaacgtggatgtcctccgagggcgcgtggaaacacgctcagagaatcgagacatggattctgcggcatcccggcttcaccatcatggccgccattctcgcttacacaatcgggaccacccactttcagcgcgccctgattttcatccttctgacagctgtggccccttctatgacgatgagatgcattggaatcagcaaccgggattttgtcgaaggcgtgtccgggggaagctgggttgacatcgtgctcgagcacggctcttgtgtcaccacaatggcgaagaataagcccaccctggatttcgaacttattaaaacagaggccaagcagcctgctaccctgcgcaaatattgcatcgaagccaagctcacgaacacaaccaccgagtccagatgtccgacacaaggggagcccagcctgaaagaagaacaggacaagcggtttgtgtgcaagcattctatggtggatcgcggatggggcaatggctgtgggctgttcggaaaaggcgggattgtgacctgcgctatgtttacatgcaagaaaaacatggaaggaaagatcgttcagcctgagaatctcgaatacacgattgtggtgacaccccactccggcgaggagcatgccgtcgggaacgacacaggaaaacacggcaaggaaatcaaagtgacccctcagagctctatcacagaggcggaactgaccggctatgggacggttaccatggagtgttcccccagaacaggacttgatttcaatgaaatggtgctgctccaaatggagaacaaggcctggctggtccaccggcagtggtttcttgacctgccgctcccttggctgcccggcgctgatacccaggggagcaattggattcagaaggagacactggtgaccttcaaaaaccctcatgccaagaaacaagacgttgtggtcctcggatcccaggaaggcgctatgcacacggccctgacaggggccaccgagatccagatgtctagcggcaatcttctgtttacaggacatctcaagtgccgcctgagaatggacaaacttcaactgaagggcatgtcctacagcatgtgtaccgggaagttcaaagtggtcaaggaaattgctgagacccagcacggaacaatcgtgattcgggttcagtatgagggcgatgggtctccctgcaaagtgcccttcgaaatcatggacctcgagaagagatacgtcctgggacgcctgatcacggtgaaccctgttgtgaccgaaaaagattccccggtcaacattgaggcggaacccccttttggcgacagctacatcattatcggggtggagcccggccagctcaagctgaattggttcaagaaaggatctagcattggccaaatgtttgagacaaccatgagaggggccaagagaatggctatccttggagatacagcctgggacttcggctccctcgggggagtgtttacctctattggcaaagccctccatcaggttttcggggctatctatggcgccgcgtttagcggagtctcctggacgatgaagatcctgattggcgtgatcattacatggatcgggatgaacagccgctctacctccctgagcgtgtctcttgtcctcgtgggaattgttaccctgtacctgggcgtgatggtccaggctgattccgggtgtgtggttagctggaaaaataaggaactcaagtgcggatccggcatcttcatcacagacaacgtgcacacctggacagagcagtataaatttcaacctgaatctcccagcaagctggcctccgccattcagaaagctcaggaggaagggatctgtggcattcggtctgtcacgagacttgagaatctgatgtggaagcagatcaccccggagctcaaccacattctggccgaaaatgaggtgaaactgacaatcatgaccggagatatcaagggcattatgcaagctgggaaacgcagccttcggcctcagcccacagaactcaagtactcctggaagacctggggaaaagccaagatgctgagcacggagtctcataaccagaccttcctgatcgacggccctgaaacagcggagtgccccaataccaacagagcctggaactccctcgaggttgaagattatgggtttggagtgttcacaaccaacatttggctgaaacttaaggagaaacaggacgctttttgtgacagcaagctgatgtctgccgctgtcaaggataatcgcgccgtgcacgcggacatgggctactggatcgaatccgccctcaacgatacatggaaaattgagaaggctagcttcatcgaggtgaaaaattgccattggcctaagtctcacaccctgtggagcaacggcgtcctggaatccgagatgatcattcccaaaaaccttgccgggccggttagccaacacaattatcggcctggataccatacgcagatcgctggcccctggcacctcgggaagctggaaatggacttcgatttttgtgacggaacaaccgtggtggtcaccgaggattgcggcaacagagggccctctctgcgcacaaccacggcctccggaaagctcattacagaatggtgctgtcggagctgcaccctgcctccgcttagataccggggcgaggacggctgttggtatgggatggagatccgccccctgaaagaaaaggaggaaaatctcgtgaactccctggttacagccggacagggccaagtggataatttctctctgggggtccttggaatggctctctttctggaggaaatgctgagaacccgggtgggcacaaaacatgcgattctcctggttgccgtgagcttcgtcacccttatcacggggaacatgtcctttaaggacctgggaagagtggttgtgatggtcggcgctaccatgacagatgacattggcatgggggtgacctacctcgccctgctggccgctttcaaagtgcgccctacatttgccgcgggacttctgctccggaagctgacctctaaggagctcatgatgacgacaatcggcatcgtcctgcttagccagtccaccattcccgagacaatcctggaactcaccgatgctctggccctggggatgatggttcttaaaattgtgagagacatggagaagtatcagctggccgtgaccatcatggctattctctgcgtccctaatgccgtgatcctgcagaacgcgtggaaagtttcttgtacaatcctcgctgtggtcagcgtgagccccctgcttctgacgagctctcaacagaagaccgactggattcctctcgccctgacaatcaaaggactgaatcccaccgccattttccttacaaccctgtcccgcacgaacaagaaaagaagctggccgctcaatgaagctatcatggccgttggcatggtgtctattctggcttccagcctcctgaagaacgatatccctatgacagggccccttgtcgccggaggcctgctgaccgtgtgctacgtcctcaccggccggtctgcggacctggagcttgaacgcgccacagatgtgaagtgggaggaccaggctgagatctccgggagctcccctattctgagcatcaccatttctgaagatggaagcatgtccatcaaaaatgaggaagaggagcagacactcacgattctgatcagaaccggcctcctggttatttctgggctttttcccgtgagcatcccgatcacagccgctgcctggtatctgtgggaagtcaagaaacaacgggccggagtgctgtgggacgttccttctccccctcccatgggcaaggctgagctcgaagatggggcgtaccgcattaaacagaagggaatcctgggctatagccagattggcgccggggtgtacaaggagggaaccttccacacaatgtggcatgtcaccagaggcgctgtgcttatgcacaaagggaagcggatcgaacccagctgggccgacgtgaaaaaggatctgatttcctacggaggcgggtggaaactcgagggagagtggaaggaaggcgaggaagttcaggtcctggccctcgagcctggcaagaacccgcgcgctgtgcaaacgaaacccgggctgtttaagaccaatacaggaaccatcggcgccgtgtctcttgacttcagccctgggacatccggaagccccatcattgataaaaagggcaaagtcgtggggctgtatggaaacggcgttgtgaccagatctggcgcgtacgtctccgctatcgcccagacagaaaagagcattgaggacaaccctgatatcgaggacgacatttttcggaagcgcagactgacgatcatggatctccaccccggggccggaaaaaccaagcggtatctgcctgctatcgtgagagaagccattaaacgcggccttcggacactgatcctcgcgccgaccagagttgtggctgccgagatggaagaggccctgcgcgggctccccattcggtaccagacccctgctatcagagccgaacatacaggacgcgagattgtcgacctgatgtgtcacgctacgttcaccatgcggcttctgtctcccgtgagagttcctaattataacctgatcattatggatgaggcccatttcacagaccccgcgtccatcgccgctcgcggctacatcagcacccgggtggaaatgggggaggccgctggcatttttatgacagccaccccgcctggatccagagatcccttcccccaatctaatgcccctatcattgacgaggaacgggagatccccgaacgcagctggaactccggccacgagtgggtcacggattttaaggggaaaacagtgtggttcgtgcctagcattaaggctggaaatgacatcgcggcctgcctcagaaagaacggcaaaaaggtcatccagctgtctcggaaaacctttgattccgaatatgctaagacccgcacaaatgactgggatttcgttgtgaccacagacattagcgagatgggggccaactttaaagccgaaagagtgatcgacccgcggagatgtatgaagcccgtcattcttaccgatggagaggagcgcgtgatcctggctggccctatgcccgttacgcattctagcgccgcgcagcggagagggcgcattggccggaatcctaaaaacgaaaatgaccagtacatctacatgggagagcccctcgaaaacgatgaggactgcgctcactggaaggaagccaagatgctgctggataatatcaacacaccggagggcattatcccttccatgttcgagcccgaaagagagaaagtggacgccattgatggggaatatcgcctccggggagaggctagaaagacctttgtcgaccttatgcgcagaggcgatctgcctgtgtggctggcctacaaagttgcggccgaagggatcaattatgctgaccggcgctggtgtttcgatggaattaagaacaaccaaatcctcgaggagaatgtggaagtcgagatttggacaaaagaaggcgagagaaagaagctgaaaccccggtggcttgacgcccgcatctactctgatcctctggctctcaaggagtttaaagagttcgccgctgggagaaagagcctgaccctgaacctcatcacggagatgggccggcttcccaccttcatgacacagaaaaccagagacgccctggacaatctggcggtgctccacacagccgaagctggaggccgcgcctataaccatgctctgtccgagcttccggaaaccctggagacactcctgctgctcacccttctggccacggtcacagggggaatttttctgttcctcatgtctggccgggggatcggaaagatgaccctgggcatgtgctgcattgtgaccgccagcatccttctgtggtacgctcagattcagcctcactggatcgcggcctccatcattctcgagtttttcctgatcgttctgctcattcccgaacccgagaagcaaagaacacctcaggataatcagcttacctatgtggtgatcgctattctgacagtcgttgccgccacgatggctaacgaaatgggctttctggagaaaaccaagaaagacctcgggctgggaagcatcgccacacagcaaccggaatctaatatccttgatattgacctgcgccccgcgtccgcctggaccctctacgctgtggccacaaccttcgtgacgcctatgctgcggcatagcatcgagaactcctctgtcaatgtgagcctgaccgctattgccaaccaggcgacagttctcatgggccttgggaagggatggcccctgtccaaaatggatatcggcgtgcctctgctcgccattgggtgttactctcaggtcaatcccatcaccctgacagctgcccttctgctcctggtggctcactatgccattatcggacctggcctgcaggctaaggccaccagagaggcgcaaaagcgggccgctgccggcatcatgaaaaacccgacggtcgacgggattacagtgatcgatctcgaccccattccttacgatcccaagtttgaaaaacagcttggacaggttatgctgctggtgctctgcgtcacccaagtgctgatgatgcgcacaacctgggctctttgtgaggccctgaccctcgccacaggccctatcagcacgctgtgggaagggaatcccggaagattctggaacaccacaattgcggtttccatggctaatatctttcggggcagctatctggccggggctggactccttttctctatcatgaagaacaccacaaatacccgcagaggcacgggcaacattggggagacactgggagaaaaatggaagtcccggctgaacgccctcggcaaaagcgagtttcagatctacaagaagtctgggattcaggaggtggaccgcaccctggccaaagaaggaatcaagagaggcgagaccgatcaccatgctgtctcccgggggagcgccaaacttcgctggttcgtggaaagaaatatggtgacaccggagggaaaggttgtcgacctgggctgcggcagagggggatggtcttattactgtggcgggctcaaaaacgtgcgggaggtgaagggactgaccaagggcgggcctggacacgaggaacccattcccatgagcacatatggctggaatctggtccgcctccagtccggcgttgatgtgtttttcatccctcccgaaaaatgcgacacgcttctgtgtgacatcggggagtctagccctaacccgaccgtggaagcgggacggacactgagagtcctcaatctggtggagaactggcttaataacaatacccaattctgcattaaggttctgaacccctacatgccttccgtgatcgagaaaatggaaacactccagcgcaagtacggcggggccctggtccggaatcccctgagcagaaactccacccatgagatgtattgggtgtctaatgctagcggaaacattgtttcctctgtgaatatgatcagccgcatgctcattaaccggtttacgatgagacacaaaaaggccacctacgaacctgatgtcgaccttggctccgggacacgcaacatcggaatcgagtctgaaattcccaatctggatatcattggcaagcggatcgagaaaattaagcaggagcatgaaaccagctggcactatgaccaggatcacccgtacaaaacatgggcttatcatggctcctacgagaccaagcaaacagggagcgcctcttccatggtgaacggagtggtcagactgctcaccaaaccttgggacgttctgcccacggtgacacagatggcgatgaccgataccacacctttcggccagcagcgcgtgtttaaggaaaaggtcgacacgcggacccaagagcccaaagaagggacaaagaaacttatgaagatcaccgccgagtggctgtggaaagagctcggaaagaaaaagacacctagaatgtgtacccgcgaagagttcacaagaaaggtgcggagcaatgctgccctgggcgctatttttaccgatgaaaacaaatggaagtctgcccgcgaggctgttgaggactccagattctgggaactggtggataaagagcggaatctccacctggaagggaagtgcgagacgtgtgtctataacatgatgggaaaaagagaaaagaaacttggcgagtttggcaaagccaaggggagccgggcgatctggtacatgtggctgggagcccgcttcctcgagtttgaagctctgggcttccttaatgaggaccattggttttctagagaaaactccctgagcggggtggagggagaaggcctccacaaactggggtacatcctgcgggacgtttccaagaaagagggcggagccatgtatgctgatgacaccgccggctgggatacacgcattaccctcgaggacctgaagaatgaagagatggtgacaaaccacatggaaggggagcataagagacttgccgaagcgatcttcaaactgacctaccagaataaggtcgtgcgggttcagcgccccacgccgagaggaacagtgatggatattatcagccggcgcgaccaaagaggctctgggcaggtcggaacctatggcctcaacacatttaccaatatggaggctcagctgattcggcagatggagggggaaggcgtgttcaaaaacatccaacaccttacggtcaccgaggaaatcgccgtgcagaattggctggcccgcgttggaagagagcggctcagccgcatggctatttccggcgatgactgcgtggtcaagcctctggatgacagattcgcctctgctctgacagccctcaacgatatggggaaaatccggaaggacattcagcagtgggagcccagcagaggatggaacgattggacccaagtgcccttttgctcccatcacttccatgaactgatcatgaaggacggccgcgtgcttgttgtgccttgtcggaatcaggacgagctgattgggagagcgcgcatctctcagggagccggctggagcctccgggaaacagcttgcctggggaaatcctacgcccagatgtggtctcttatgtattttcacagacgcgatctgcggctcgctgccaacgcgatctgtagcgccgtcccgtcccactgggtgcccaccagcagaacaacctggtctattcatgctaagcacgagtggatgacgacagaagacatgctgaccgtttggaatcgcgtgtggatccaagagaacccttggatggaggataaaacccccgtcgaatcctgggaggaaattccttacctgggcaagcgggaggaccagtggtgcggaagcctcatcggcctgacatctagagccacctgggctaaaaatattcaggccgctatcaaccaggtgcgctcccttattgggaatgaagagtatacagattacatgcccagcatgaagcggttcagacgggaggaagaggaagccggagtcctgtggtga

SEQ ID NO: 19884 - RNA, 9876 nt, synthetic construct
  misc_feature 1..9876: note = derived and/or modified CDS sequence (opt5) from DENV-2__FJ898452__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgctgaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagagaacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaaacgggccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcatgaaaaataccacaaacacccgcagaggcacaggcaacatcggggagaccctgggagagaagtggaaatctcggctgaatgccctcggcaagtccgaatttcaaatttataagaaaagcgggatccaggaggttgaccgcacgctggccaaggaaggaattaaaagaggcgagacagatcaccatgctgtgtctcgggggtccgccaaacttcgctggttcgtcgagagaaacatggtgaccccggaaggaaaagttgtggacctgggctgcggcagagggggatggagctactattgtggcgggctcaagaatgtccgggaggtgaagggactgaccaaaggcgggcctggacacgaagaacccatccccatgtctacatacggctggaacctggtgcgcctccagagcggcgttgatgtctttttcattcctcccgaaaagtgcgacacccttctgtgtgatatcggggagtcctctcctaatccgacagtggaggcgggacggacgctgagagtgctcaacctggtcgaaaattggcttaacaataacacccagttctgcatcaaagttctgaatccctacatgcctagcgtgattgagaagatggaagccctccaacgcaaatatggcggggctctggtgcggaaccccctgtccagaaatagcacacatgagatgtactgggtctccaacgcctctggaaatatcgtgagctccgttaacatgatttctcgcatgctcatcaaccggtttaccatgagacacaagaaggctacatatgaacctgacgtggaccttggcagcgggacccgcaatattggaatcgagtccgagattcccaacctggatatcatcggcaaacggattgaaaagatcaaacaggagcatgaaacgtcttggcactacgaccaggatcacccgtataagacctgggcctaccatggcagctatgagacaaaacagaccgggtccgcgagctctatggtcaatggagtggttagactgctcacaaagccttgggacgtgctgcccaccgtcacacaaatggccatgaccgatacgacacctttcggccagcagcgcgtgtttaaggaaaaagtggacacccggacccaggagcccaaggaggggaccaagaaacttatgaaaattacggctgaatggctgtggaaggagctcggcaaaaagaagacccctagaatgtgtacacgcgaagagttcaccagaaaagtccggtccaacgccgctctgggcgccatctttacagatgagaataagtggaaaagcgctcgcgaagccgttgaggactctagattctgggaactggtggataaggagcggaacctccacctggaagggaaatgcgagacctgtgtgtacaatatgatgggaaagagagagaagaaacttggcgaatttggcaaggcgaaagggtcccgggccatttggtacatgtggctgggagctcgcttcctcgagtttgaagccctgggcttccttaacgaggaccattggtttagcagagaaaattctctgtccggggtcgagggagagggcctccacaagctggggtatatcctgcgggatgtgagcaaaaaggaaggcggagctatgtacgccgacgacacagccggctgggatacccgcatcacgctcgaggacctgaagaacgaagagatggttaccaatcacatggaaggggagcataagaaacttgcggaggctattttcaaactgacatatcaaaacaaagtggtcagagtgcagcggcccaccccgcgcggaacagttatggatatcatttccagacgggaccagcgcggcagcgggcaagtgggaacctacggcctcaatacgtttacaaacatggaagcccagctgatcagacagatggagggggaaggcgtcttcaaaaatattcagcaccttaccgtgacagaggaggttgccgtgcaaaactggctggctcgggtcggacgcgaaagactctctcggatggccatcagcggcgatgactgcgtggtcaagcctctggatgaccgcttcgctaacgccctgaccgcgctcaatgatatggggaagatcagaaaagacattcagcagtgggagccctccaagggatggaacgattggacacaggtgcccttttgctctcatcacttccatgaactgatcatgaaagacggccgggttcttgtggtcccttgtagaaatcaagatgagctgattgggcgcgcccggatcagccagggagctggctggtccctcagagaaaccgcctgcctggggaagtcttatgctcagatgtggagccttatgtactttcaccgccgggacctgagactcgccgcgaacgccatttgttccgctgtgccgtctcactgggtgcccacaagccgcaccacatggtccatccatgccaaacacgagtggatgaccacagaggacatgctgaccgtttggaatcgggtgtggattagagaaaacccttggatggaggataagacgcccgtcgaaagctgggaggaaatcccttatctgggcaagcgcgaggaccagtggtgcggatctctcatcggcctgacatcccgggctacctgggccaaaaatattcaagctgccatcaaccaggtgagaagccttattgggaatgaggaatacaccgattacatgccctctatgaagcgcttccggagagaggaagaggaagcgggagttctgtggtga

SEQ ID NO: 19885 - RNA, 9876 nt, synthetic construct
  misc_feature 1..9876: note = derived and/or modified CDS sequence (opt5) from DENV-2__GQ868591__SS-prME
  source 1..9876: mol_type = other RNA
agcgccggcatgatcattatgctgatccccaccgtgatggctttccacctcacaacgagaaacggggagcctcatatgattgtctcccggcaggaaaagggaaaatctctgctttttaagaccgaggacggcgttaatatgtgcacactgatggccatggatctcggggaactgtgtgaggacaccatcacatacaaatgcccgcttctgcgccaaaacgaacccgaggatattgactgttggtgcaatagcacctccacatgggtgacctatggaacgtgtaccacaatgggcgagcacagacgggaaaagcgctctgtggcgctcgtccctcatgtggggatgggactggagaccagaacagaaacctggatgagctccgagggcgcttggaaacacgttcagcggatcgagacgtggatcctgcgccatcccggcttcacaatgatggccgccattctcgcttacaccatcgggacaacccactttcagagagccctgattttcatccttctgaccgctgtgacaccttctatgacgatgcggtgcattggaatgagcaaccgcgattttgtcgaaggcgtgtccgggggaagctgggttgacatcgtgctcgagcacggctcttgtgtcaccacaatggccaagaataagcccaccctggatttcgaacttattaaaacagaggcgaagcagcctgccaccctgagaaaatattgcatcgaagctaagctcacgaacacaaccaccgagtcccggtgtccgacacaaggggagcccagcctgaatgaagagcaggacaaacgctttgtgtgcaagcattctatggtggatagaggatggggcaacggctgtgggctgttcggaaagggcgggatcgtcacctgcgccatgtttcggtgcaaaaagaatatggaaggaaaagttgtgcagcctgagaacctcgaatacacaattgtgatcacgccccactccggcgaggagcatgctgtcgggaatgacaccggaaagcacggcaaagaaattaagatcacacctcagagctctattaccgaggccgaactgacaggctatgggaccgtgacgatggagtgttccccccgcaccggacttgatttcaacgaaatggttctgctccaaatggagaataaagcgtggctggtgcacagacagtggtttcttgacctgccgctcccttggctgcccggcgccgatacacaggggagcaactggatccagaaggagaccctggtcacattcaagaatcctcatgctaaaaagcaagacgtggttgtgctcggatcccaggaaggcgccatgcacaccgctctgacgggggccacagagatccagatgtctagcggcaaccttctgtttaccggacatctcaaatgccggctgagaatggacaagcttcaactgaaaggcatgtcctacagcatgtgtacagggaagttcaaggtcgtgaaagaaattgccgagacccagcacggaaccatcgtcattcgcgtgcagtatgagggcgatgggtctccctgcaagatccccttcgaaattatggacctcgagaaacggcatgttctgggaagactgatcacagtgaaccctatcgtcacggaaaaggattccccggtgaatattgaggctgaacccccttttggcgacagctacatcattatcggggttgagcccggccagctcaaactgaactggttcaagaagggatctagcattggccaaatgtttgagaccacaatgcgcggggcgaaacggatggccatccttggagataccgcttgggacttcggctccctggggggagtgtttacatctattggcaaggccctccaccaggtcttcggggccatctacggcgctgcctttagcggagtgtcctggaccatgaaaatcctgattggcgtgatcattacgtggatcgggatgaatagcagatctacatccctgagcgttacccttgtcctcgtgggaattgtgaccctgtatctgggcgtcatggtgcaggcggattctgggtgtgttgtgtcctggaagaacaaagaactcaagtgcggaagcggcatcttcatcacagacaatgtccacacctggacagagcagtacaagtttcaacctgaatccccctctaaactggctagcgccattcagaaggcccatgaggaagggatctgtggcattcgctccgtgacgcggcttgagaacctgatgtggaaacagatcaccccggagctcaatcacattctgtctgaaaacgaggttaagctgacaatcatgaccggagatatcaaaggcattatgcaggctgggaagagaagccttcgccctcaacccacagaactcaaatattcctggaagacctggggaaaggccaaaatgctgagcacggagtctcataatcagaccttcctgatcgacggccctgaaacagctgagtgccccaacaccaatcgggcctggaactccctcgaggtggaagattacgggtttggagtcttcacaaccaatatttggctgaagcttaaagagaagcaggacgtgttttgtgacagcaaactgatgtctgcggccatcaaggataacagagctgttcacgccgacatgggctattggattgaatccgctctcaatgatacatggaagatcgagaaagccagcttcatcgaggtgaagaactgccactggcctaaatctcataccctgtggagcaacggcgtcctggaatccgagatgattatccccaagaatcttgcggggccggtgagccagcacaactaccgccctggatatcatacgcaaattacaggcccctggcacctcgggaaactggaaatggacttcgatttttgtgacggaaccaccgtggtcgttacagaggattgcggcaatcgggggccctctctgagaaccacgacagcctccggaaagctcatcaccgaatggtgctgtcggagctgcacactgcctccgcttcgctacagaggcgaggacggctgttggtacgggatggagattcggcccctgaaggaaaaagaggaaaacctcgtgaattccctggtgaccgctggacatggccaggtcgataacttctctctgggggtgcttggaatggccctctttctggaggaaatgctgagaacacgcgttggcaccaagcacgctatcctcctggtggccgtcagcttcgtgacgcttattaccgggaatatgtcctttcgggacctgggaagagttatggtgatggtcggcgccacaatgaccgatgacatcggcatgggggtgacatatctcgctctgctggcggccttcaaagttcgccctacctttgctgccggacttctgctcagaaagctgacgtctaaagagctcatgatgacaaccatcggcattgtgctgcttagccagtccacaatccccgagaccattctggaactcaccgatgccctggctctggggatgatggtccttaagatggtgcggaacatggagaagtaccaactggccgtgacaatcatggcgattctctgcgtccctaatgctgttatcctgcagaacgcctggaaagtgtcttgtacgatcctcgccgtggtcagcgtgtcccccctgcttctgaccagctctcagcagaagacagactggattcctctcgctctgaccatcaaaggactgaatcccacagccattttccttaccacgctgtcccgcacaagcaagaaaagatcttggccgctcaacgaagcgatcatggctgttggcatggtgtccattctggccagctctctcctgaagaatgacatccctatgaccgggccccttgtcgccggaggcctgctgaccgtgtgctatgttctcacaggccggtccgctgatctggagcttgaacgcgccgctgacgtgaaatgggaggatcaagccgagatcagcgggtccagccctattctgtctatcaccattagcgaagacggatccatgtctatcaagaacgaggaagaggagcagacactcacgattctgatcagaaccggcctcctggtcattagcgggctttttcccgtgtccatcccgatcacagcggccgcttggtacctgtgggaagtcaagaaacagcgggccggagtgctgtgggatgttccttctccccctcccatgggcaaggctgagctcgaagacggggcctatcgcattaaacagaagggaatcctgggctacagccaaattggcgccggggtgtataaagagggaaccttccacacaatgtggcatgtcaccagaggcgctgtgcttatgcacaaggggaagcggatcgaaccctcctgggcggatgttaaaaaggacctgatttcttacggaggcgggtggaaactcgagggagagtggaaggaaggcgaggaagtgcaggtcctggccctcgagcctggcaaaaatccgcgcgctgtgcagacgaagcccgggctgtttaagaccaacgccggaacaatcggcgccgtgagccttgatttctcccctgggaccagcggatctcccatcattgacaaaaagggcaaagttgtcgggctgtacggaaacggcgtggtgacaagatccggcgcttatgtcagcgccatcgcgcagaccgaaaagtctattgaggataatcctgagatcgaagacgatatttttcggaaaagacgcctgacaatcatggacctccatcccggggctggaaagacgaagcggtacctgcctgccatcgtgagagaggccattaaacgcggccttcggaccctgatcctcgctccgacaagagttgtggccgcggaaatggaggaagctctgcgcgggctccccattcggtatcaaacccctgccatcagagccgagcacaccggacgcgagattgtcgacctgatgtgtcatgctacattcacgatgcggcttctgtcccccgtgagagttcctaactacaatctgatcattatggatgaagcccacttcaccgaccccgctagcatcgccgcgcggggctatatctccacacgcgtggagatgggggaagccgctggcatttttatgaccgccacaccgcctggatctagagatcccttcccccagagcaacgctcctatcattgacgaggagcgggaaatccccgagcgctcctggaatagcggccacgaatgggtcaccgattttaaggggaaaacggtgtggttcgttccttctattaaggccggaaacgacatcgccgcttgcctcagaaaaaatggcaagaaggtgatccagctgtcccggaaaacatttgatagcgagtacgtcaagaccagaaccaacgactgggatttcgtggtgacaaccgacatttctgaaatgggggcgaattttaaagccgagcgcgtcatcgatccgcggagatgtatgaagcccgttattcttacagacggagaggaacgcgtgatcctggctggccctatgcccgtgacccatagctccgccgcccaacggagagggcgcattggccggaaccctaaaaatgagaacgaccagtatatctacatgggagaacccctcgagaatgatgaagactgcgctcactggaaggaggccaaaatgctgctggataacatcaatacgccggagggcattatcccttctatgttcgaacccgagagagaaaaggtcgacgcgattgatggggagtaccgcctcagaggagaagctcggaagacatttgtggaccttatgcgcagaggcgatctgcctgtttggctggcctatcgggtggccgctgaggggatcaactacgccgaccgcagatggtgtttcgatggagtcaaaaacaatcagattctcgaggaaaacgtggaggttgaaatctggaccaaggagggcgagcggaaaaagctgaaacccagatggcttgacgcgcgcatttatagcgatcctctggccctcaaggaatttaaggagttcgctgccgggcggaaatccctgacactgaatctcatcaccgaaatgggcagacttcccacgttcatgacccagaaggctcgcgacgccctggataacctggctgtgctccatacagccgaggcgggaggccgggcctacaatcacgctctgtctgaacttccggagaccctggagacactcctgctgctcacccttctggccacagtcaccgggggaatctttctgttcctcatgagcggcagagggattggaaaaatgacgctgggcatgtgctgcatcattacagcttccatccttctgtggtatgcccaaattcagcctcactggatcgccgctagcatcattctcgaatttttcctgatcgtgctgctcattcccgagcccgaaaagcagcggacccctcaggacaaccaacttacctacgtcgtgatcgcgattctgacagttgtggccgctaccatggccaatgagatgggctttctggaaaaaacaaagaaggacctcgggctgggatctatcgccacgcagcagccggagtccaacatccttgatattgacctgcgccccgctagcgcctggaccctctatgcggtggccacaaccttcgtcacacctatgctgagacattccatcgagaattctagcgttaacgtgtccctgaccgctattgccaatcaggctacggtgctcatgggccttgggaaaggatggcccctgtctaagatggatatcggcgtccctctgctcgccattgggtgttacagccaagtgaaccccatcaccctgacagcggccctttttctgctcgttgctcactacgccattatcggacctggcctgcaggctaaagccacccgggaagctcagaagcgcgccgcggccggcatcatgaaaaatccgacagtggacgggattaccgtcatcgatctggaccccattccttatgatcccaagttcgagaagcagctcggacaagtgatgcttctggtcctgtgcgtgacgcaggttctcatgatgagaacaacctgggctctgtgtgaagcccttacactggctaccggccctatctccaccctctgggaggggaaccccggacggttttggaatacaacgattgccgtgagcatggccaacatcttccgcggctcttacctggcgggggctggactgctcttttccatcatgaaaaataccacaaacaccagacggggcacaggcaacattggggaaacccttggagagaagtggaaaagccgcctgaatgccctgggcaagtctgagttccagatctataaaaagtccgggattcaagaagtcgacagaacgctcgctaaagagggaatcaagcggggcgaaacagatcatcacgccgtgagcagagggtctgccaagctgcgctggtttgttgagcggaacatggtgaccccggagggaaaagtcgtggaccttggctgcggcagagggggatggagctactattgtggcgggctgaagaatgtgcgcgaagttaaaggactcaccaagggcgggcctggacatgaggaacccattcccatgtccacatacggctggaacctggtccggctgcagtctggcgtggatgtgttcttcatccctcccgagaaatgcgacaccctcctttgtgatatcggggaaagctcccctaatccgacagtcgaggctggaagaacgctgcgcgttctgaacctcgtggagaattggctgaacaataacacccagttttgcattaaggtgcttaatccctatatgcctagcgtcatcgaaaagatggaggccctgcagcggaaatacggcggggcgctcgtgagaaaccccctgtcccgcaattctacacacgaaatgtactgggttagcaacgcctccggaaatattgtgtctagcgtcaacatgatctcccggatgctgattaacagattcaccatgcgctataagaaagctacatacgagcctgacgtggacctcggctctgggacccggaatatcggaatcgaaagcgagattcccaaccttgatatcattggcaagagaatcgagaaaattaagcaagaacacgagacgtcctggcattatgaccaggatcacccgtacaagacctgggcctatcatggcagctacgaaacaaaacagaccgggtctgcttccagcatggttaatggagtggtccgcctgctgacaaagccttgggacgtggtgcccatggtcacccagatggccatgacagataccacgccttttggccaacagagagttttcaaagagaaggtggacacacggacccaggaacccaaagaggggaccaagaagctcatgaaaatcacagcggagtggctgtggaaggaacttggaaaaaagaaaacgcctcgcatgtgtaccagagaggaatttacacggaaggtgagatctaacgccgctctgggcgccattttcgctgatgagaataaatggaagtccgcccgggaggctgtcgaagacagccgcttttgggagctcgtggataaggaaagaaacctgcacctggaggggaaatgcgaaacctgtgtttataatatgatgggaaagcgggagaaaaagctcggcgagttcggcaaagccaaggggtctcgcgcgatctggtacatgtggctgggagccagatttcttgaattcgaggctctgggctttctcaacgaagaccactggttctcccgggagaatagcctgtccggggtggaaggagagggccttcataagctggggtacatcctccgcgatgtcagcaaaaaggagggcggagccatgtatgctgacgacacagccggctgggataccagaattacactggaagacctgaaaaacgaggaaatggtgaccaatcacatggagggggaacataagaaactcgccgaggcgatctttaagctgacgtaccagaacaaggttgtgcgggtccaacgccccaccccgagaggaacagtgatggatattatctctcggcgcgaccagagaggcagcgggcaggttggaacctatggccttaatacattcaccaacatggaggctcaactgattcggcagatggaaggggagggcgtgttcaaatccatccagcacctcacgatcacagaagagattgccgtccagaattggctggcccgcgtgggaagagagcggctttctagaatggctatcagcggcgatgactgcgtcgtgaagcctctggatgaccgctttgcctccgctctcaccgccctgaacgatatggggaaaattcggaaggacatccaacagtgggaaccctctagaggatggaacgattggacacaggttcccttctgcagccatcactttcacgagctgattatgaaagacggccgcgtgctcgtcgtgccttgtcggaatcaggatgaactgatcgggagagcgcgcatctcccaaggagccggctggtctcttcgggagaccgcttgcctggggaagagctacgcccagatgtggtccctcatgtatttccatagacgcgacctgcggcttgctgccaacgcgatttgtagcgccgtgccgtctcactgggttcccacgtccagaaccacatggagcatccatgctaagcacgaatggatgaccacagaggacatgctgaccgtgtggaatcgcgtctggattcaggagaacccttggatggaagataaaacacccgtggagtcttgggaagagatcccttacctcggcaagcgggaagaccagtggtgcggatccctgattggcctgaccagcagagccacgtgggctaaaaatatccaagccgctattaaccaggttcggtccctcatcgggaatgaggagtatacagattacatgccctctatgaagagatttcgccgggaagaggaagaggccggagtgctgtggtga

SEQ ID NO: 19886 - RNA, 9876 nt, synthetic construct
  misc_feature 1..9876: note = derived and/or modified CDS sequence (opt5) from DENV-2__GQ868542__SS-prME
  source 1..9876: mol_type = other RNA
tccgccggaatgatcattatgctgatccccaccgtgatggctttccacctgaccacgcggaatggggaacctcatatgattgtctccatccaggaaaagggaaaatctctgctttttaagaccgaggacggcgttaatatgtgcacactgatggccatggatctcggggaactgtgtgaggacaccattacatacaaatgcccgcttctgcggcaaaatgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctatggtggatcgcggatggggcaatggctgtgggctgttcggaaaaggcgggattgtgacctgcgccatgtttacatgcaagaaaaacatggaaggaaagatcgtccagcctgagaatctcgaatacacgattgttgtgacaccccactccggcgaggagcatgcggtggggaacgacacaggaaaacacggcaaggaaatcaaagtcacccctcagagctctatcacagaggccgaactgaccggctatgggacggtgaccatggagtgttcccccagaacaggacttgatttcaatgaaatggttctgctccaaatggagaacaaggcttggctggtgcaccggcagtggtttcttgacctgccgctcccttggctgcccggcgccgatacccaggggagcaattggattcagaaggagacactggtcaccttcaaaaaccctcatgctaagaaacaagacgtggttgtgctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtcgtgaaggaaattgcggagacccagcacggaacaatcgtcattcgggtgcagtatgagggcgatgggtctccctgcaaaatccccttcgaaatcatggacctcgagaagagatacgttctgggacgcctgattacggtgaaccctatcgtcaccgaaaaagattccccggtgaacattgaggccgaacccccttttggcgacagctacatcattatcggggttgagcccggccagctcaagctgaattggttcaagaaaggatctagcattggccaaatgtttgagacaaccatgagaggggctaagagaatggccatccttggagatacagcctgggacttcggctccctcgggggagtgtttacctctatcggcaaagctctccatcaggtcttcggggccatttatggcgcggcttttagcggagtgtcctggacgatgaagatcctgattggcgtgatcattacatggatcgggatgaacagccgctctacctccctgagcgtttctcttgtcctcgtgggaatcgtgaccctgtacctgggcgtcatggtgcaggccgattccgggtgtgttgtgagctggaaaaataaggaactcaagtgcggatccggcattttcatcacagacaacgtccacacctggacagagcagtataaatttcaacctgaatctcccagcaagctggcctccgctattcagaaagcccaggaggaagggatctgtggcattcggtctgtgacgagacttgagaatctgatgtggaagcagatcaccccggagctcaaccacatcctggctgaaaatgaggttaaactgacaattatgaccggagatatcaagggcattatgcaagccgggaaacgcagccttcggcctcagcccacagaactcaagtactcctggaagacctggggaaaagcgaagatgctgagcacggagtctcataaccagaccttcctgatcgacggccctgaaacagccgagtgccccaataccaacagagcttggaactccctcgaggtggaagattatgggtttggagtcttcacaaccaacatttggctgaaacttaaggagaaacaggacgccttttgtgacagcaagctgatgtctgctgccatcaaggataatcgcgcggtgcacgccgacatgggctactggatcgaatccgctctcaacgatacatggaaaattgagaaggccagcttcatcgaggttaaaaattgccattggcctaagtctcacaccctgtggagcaacggcgtgctggaatccgagatgattatccccaaaaaccttgctgggccggtcagccaacacaattatcggcctggataccatacgcagattgccggcccctggcacctcgggaagctggaaatggacttcgatttttgtgacggaacaaccgtggtggtcaccgaggattgcggcaacagagggccctctctgcgcacaaccacggcctccggaaagctcatcacagaatggtgctgtcggagctgcaccctgcctccgcttagataccggggcgaggacggctgttggtatgggatggagattcgccccctgaaagaaaaggaggaaaatctcgttaactccctggtgacagctggacatggccaggtggataatttctctctgggggtccttggaatggcgctctttctggaggaaatgctgagaacccgggtgggcacaaaacacgccatcctcctggttgctgtgagcttcgtcacccttatcacggggaacatgtcctttaaggacctgggaagagtggttgtgatggtcggcgccaccatgacagatgacattggcatgggggtgacctacctcgccctgctggctgccttcaaagttcgccctacatttgcggctggacttctgctccggaagctgacctctaaggagctcatgatgacgacaatcggcattgtgctgcttagccaatccaccatccccgagacaattctggaactcaccgatgccctggccctggggatgatggtccttaaaatcgtgagaaatatggagaagtatcagctggctgtgaccatcatggccattctctgcgtccctaacgcggttatcctgcagaatgcttggaaagtgtcttgtacaattctcgccgtggtcagcgtgagccccctgcttctgacgagctctcagcaaaagaccgactggatccctctcgccctgacaattaaaggactgaaccccaccgctatcttccttacaaccctgtcccgcacgaataagaaaagaagctggccgctcaacgaagccatcatggctgttggcatggtgtctattctggcctccagcctcctgaagaatgacatccctatgacagggccccttgtcgcgggaggcctgctgaccgtgtgctacgttctcaccggccggtctgccgatctggagcttgaacgcgctacagacgtgaagtgggaggatcaggccgagatttccgggagctcccctatcctgagcattaccatctctgaagacggaagcatgtccattaaaaacgaggaagaggagcagacactcacgatcctgatcagaaccggcctcctggtcatttctgggctttttcccgtgagcatcccgattacagctgccgcctggtatctgtgggaagtcaagaaacagcgggctggagtgctgtgggatgttccttctccccctcccatgggcaaggcggagctcgaagacggggcctaccgcatcaaacaaaagggcattctgggctatagccagatcggcgctggggtgtacaaggagggaaccttccatacaatgtggcacgtcaccagaggcgccgtgcttatgcacaaagggaagcggatcgaacccagctgggccgatgttaaaaaggacctgatttcctacggaggcgggtggaaactcgagggagagtggaaggaaggcgaggaagtgcaggtcctggctctcgagcctggcaagaatccgcgcgccgtgcagacgaaacccgggctgtttaagaccaacacaggaaccatcggcgcggtgtctcttgatttcagccctgggacatccggaagccccattatcgacaaaaagggcaaagttgtcgggctgtatggaaacggcgtggtgaccagatctggcgcttacgtctccgccattgcccaaacagaaaagagcatcgaggataatcctgagatcgaagacgatatttttcggaagcgcagactgacgatcatggacctccatcccggggctggaaaaaccaagcggtatctgcctgccattgtgagagaggcgatcaaacgcggccttcggacactgattctcgctccgaccagagttgtggccgccgaaatggaggaagctctgcgcgggctccccatccggtaccagacccctgccattagagctgagcacacaggacgcgagatcgtcgacctgatgtgtcatgccacgttcaccatgcggcttctgtctcccgtgagagttcctaactataatctgatcattatggatgaagcgcacttcacagaccccgcctccatcgctgcccgcggctacattagcacccgggtggagatgggggaagctgccggcatctttatgacagccaccccgcctggatccagagatcccttcccccagtctaacgctcctattatcgacgaggagcgggaaatccccgagcgcagctggaactccggccatgaatgggtcacggattttaaggggaaaacagtgtggttcgttcctagcattaaggcgggaaacgacatcgccgcttgcctcagaaagaatggcaaaaaggtgattcaactgtctcggaaaacctttgattccgagtatgtcaagacccgcacaaacgactgggatttcgtggtgaccacagacatcagcgaaatgggggccaattttaaagccgagagagtcattgatccgcggagatgtatgaagcccgttatccttaccgacggagaggaacgcgtgatcctggctggccctatgcccgtgacgcactctagcgccgcgcagcggagagggcgcattggccggaaccctaaaaatgagaacgaccagtacatctacatgggagaacccctcgagaatgatgaagactgcgctcactggaaggaggccaagatgctgctggataacattaatacaccggagggcatcattccttccatgttcgaacccgagagagaaaaagtcgacgccatcgatggggagtatcgcctccggggagaagctagaaagacctttgtggaccttatgcgcagaggcgatctgcctgtttggctggcctacaaagtggcggccgaggggattaactatgctgaccggcgctggtgtttcgatggaatcaagaacaatcagatcctcgaggaaaacgtcgaggtggaaatttggacaaaagagggcgagagaaagaagctgaaaccccggtggcttgacgcccgcatctactctgatcctctggctctcaaggaatttaaagagttcgccgctgggagaaagagcctgaccctgaatctcattacggaaatgggccggcttcccaccttcatgacacagaagaccagagacgccctggataacctggcggttctccatacagccgaggctggaggccgcgcctataatcacgctctgtccgaacttccggagaccctggagacactcctgctgctcacccttctggccacggtgacagggggaatctttctgttcctcatgtctggccgggggattggaaagatgaccctgggcatgtgctgcatcatcaccgccagcattcttctgtggtacgctcagatccagcctcattggattgcggcctccatcattctcgaatttttcctgatcgtcctgctcatccccgagcccgaaaagcagagaacacctcaagacaaccagcttacctatgtggtcattgctatcctgacagtggttgccgccacgatggctaatgagatgggctttctggagaagaccaagaaagacctcgggctgggaggcattgccacacagcagccggagagcaacatccttgatattgacctgcgccccgcgtctgcctggaccctctacgctgtggccacaaccttcgtgacgcctatgctgcggcactccatcgagaatagctccgtcaacgtttctctgaccgctattgccaatcaagcgacagtgctcatggggcttggaaagggctggcccctgagcaaaatggatatcggggtgcctctgctcgccatcggatgttactcccaggtcaaccccattaccctgacagctgcccttctgctcctggtggctcactatgccatcattggccctggcctgcaggctaaggccaccagagaagcgcagaagcgggccgctgccgggatcatgaaaaatccgacggttgacggaattacagtgatcgatctcgaccccatcccttacgatcccaagtttgagaaacaacttggccaggtcatgctgctggtgctctgcgtcacccaggtgctgatgatgcgcacaacctgggctctttgtgaagccctgaccctcgccacagggcctatttctacgctgtgggagggaaaccccggcagattctggaataccacaatcgcggttagcatggctaacatttttcgggggtcctatctggccggagctggcctccttttcagcatcatgaagaataccacaaacacccgcagaggcacggggaacattggagaaacactgggcgagaaatggaagtctcggctgaatgccctcgggaaatccgagtttcaaatctacaagaagtccggaatccaggaagtggaccgcaccctggccaaagagggcattaagagaggggaaaccgatcatcacgctgtctctcggggatccgccaaacttcgctggttcgtggagagaaacatggttacaccggagggcaaggtggtcgacctgggctgcgggcggggaggctggagctattactgtgggggactcaaaaatgtgagagaagtgaagggcctgaccaaagggggacctggccatgaggaacccatccccatgtctacatatggctggaacctggttcgcctccagagcggggtcgatgtgtttttcattcctcccgagaaatgcgacacgcttctgtgtgatatcggagaatcctctcctaatccgaccgtggaggcgggccggacactgagagtcctcaacctggttgagaattggcttaacaataacacccagttctgcattaaggtgctgaatccctacatgcctagcgtgatcgagaaaatggaggccctccaacgcaagtacgggggagctctggtccggaaccccctgtccagaaatagcacacacgaaatgtattgggtgtccaacgcctctggcaatatcgttagctccgtgaacatgatttctcgcatgctcatcaaccggtttaccatgagacataaaaaggctacgtacgagcctgacgtcgaccttgggagcggaacccgcaatattggcatcgaatccgaggtgcccaacctggatattatcggcaagcggattgagaaaatcaagcaggaacacgagacatcttggcactatgaccaggatcatccgtacaaaacctgggcctatcacgggagctacgaaacaaagcagaccggatccgcgagctctatggttaatggcgtggtcagactgctcacaaaaccttgggacgtgctgcccaccgtgacgcaaatggccatgacagataccacccctttcgggcagcagcgcgtctttaaggagaaggttgacacacggacgcaggaacccaaagagggaaccaagaaacttatgaagatcacagctgagtggctgtggaaagaactcggcaagaaaaagacccctagaatgtgtacacgcgaggagttcaccagaaaggtgcggtccaacgccgctctgggggccatttttacagatgagaataaatggaaaagcgctcgcgaggccgtggaagactctagattctgggagctggtcgataaggaacggaacctccatctggagggaaagtgcgaaacctgtgtgtataatatgatgggcaaaagagagaagaaacttggcgagtttgggaaagcgaagggatcccgggccatctggtacatgtggctgggcgctcgcttcctcgaatttgaggccctggggttccttaacgaagaccactggtttagcagagaaaattctctgtccggagttgaaggcgaggggctccacaaactgggctacattctgcgggatgtgagcaagaaagagggaggcacgatgtatgctgacgacaccgccgggtgggatacacgcatcaccctcgaagacctgaagaacgaggaaatggtcacaaatcatatggagggagaacacaagaaacttgccgaggcgattttcaagctgacctaccaaaacaaagtggttagagtgcagcggcccacgccgcgcggcacagtcatggatatcatctccagacgggaccagcgcgggagcggacaagtgggcacctatgggctcaatacatttaccaacatggaggctcagctgattagacagatggaaggcgagggagttttcaagaatatccagcatcttacggtgaccgaagagattgccgtccaaaactggctggcccgggtgggccgcgagagactctctcggatggctatcagcggggatgactgcgtcgtgaaacctctggatgaccgcttcgcctccgctctgacagccctcaacgatatgggaaagattagaaaggacatccagcagtgggaaccctctcggggctggaatgattggacccaggttcccttttgcagccaccatttccacgagctgatcatgaaagacgggagagtgcttgtcgtgccttgtcgcaaccaagatgaactgattggacgggcgagaatctcccagggcgccgggtggtctctccgcgagacagcttgcctgggcaagagctacgcccagatgtggtcccttatgtattttcaccggagagacctgcgcctcgctgccaatgcgatttgttctgccgtgccgagccattgggttcccacctcccggacaacctggagcatccacgctaaacatgaatggatgacgacagaggacatgctgaccgtgtggaacagagtctggattcaggagaatccttggatggaagataagacccccgtggactcttgggaggaaatcccttacctgggaaaacgcgaggatcaatggtgcggctccctcattgggctgacaagccgggccacctgggctaagaacatccaggccgctatcaatcaggttagatctcttattggaaacgaagagtatacagactacatgccctccatgaagcgcttccggagagaggaagaggaagccggcgtgctgtggtga

SEQ ID NO: 19887 - RNA, 9876 nt, synthetic construct
  misc_feature 1..9876: note = derived and/or modified CDS sequence (opt5) from DENV-2__GQ868544__SS-prME
  source 1..9876: mol_type = other RNA
tccgtcggaatgatcattatgctgatccccaccgtcatggccttccacctgaccacgcggaatggggagcctcatatgattgtttccatccaggaaaagggaaagtctctgctttttaagaccgaggacggcgtgaatatgtgcacactgatggctatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtcgccctcgtgcctcatgttgggatgggactggagacacgcaccgaaacgtggatgtcctccgagggcgcgtggaaacacgctcagagaatcgagacatggattctgcggcatcccggcttcaccatcatggccgccattctcgcttacacaatcgggaccacccactttcagcgcgccctgattttcatccttctgacagctgtggccccttctatgacgatgagatgcattggaatcagcaaccgggattttgtcgaaggcgtgtccgggggaagctgggttgacatcgtgctcgagcacggctcttgtgtcaccacaatggcgaagaataagcccaccctggatttcgaacttattaaaacagaggccaagcagcctgctaccctgcgcaaatattgcatcgaagccaagctcacgaacacaaccaccgagtccagatgtccgacacaaggggagcccagcctgaaagaagaacaggacaagcggtttgtgtgcaagcattctatggtggatcgcggatggggcaatggctgtgggctgttcggaaaaggcgggattgtgacctgcgctatgtttacatgcaagaaaaacatggaaggaaagatcgttcagcctgagaatctcgaatacacgattgtggtgacaccccactccggcgaggagcatgccgtcgggaacgacacaggaaaacacggcaaggaaatcaaagtgacccctcagagctctatcacagaggcggaactgaccggctatgggacggttaccatggagtgttcccccagaacaggacttgatttcaatgaaatggtgctgctccaaatggagaacaaggcctggctggtccaccggcagtggtttcttgacctgccgctcccttggctgcccggcgctgatacccaggggagcaattggattcagaaggagacactggtgaccttcaaaaaccctcatgccaagaaacaagacgttgtggtcctcggatcccaggaaggcgctatgcacacggccctgacaggggccaccgagatccagatgtctagcggcaatcttctgtttacaggacatctcaagtgccgcctgagaatggacaaacttcaactgaagggcatgtcctacagcatgtgtaccgggaagttcaaagtggtcaaggaaattgctgagacccagcacggaacaatcgtgattcgggttcagtatgagggcgatgggtctccctgcaaagtgcccttcgaaatcatggacctcgagaagagatacgtcctgggacgcctgatcacggtgaaccctattgttaccgaaaaagattccccggtgaacatcgaggcggaacccccttttggcgacagctacattatcattggggtcgagcccggccagctcaagctgaattggttcaagaaaggatctagcatcggccaaatgtttgagacaaccatgagaggggctaagagaatggctattcttggagatacagcctgggacttcggctccctcgggggagtgtttacctctatcggcaaagccctccatcaggtgttcggggctatctatggcgccgcgtttagcggagtttcctggacgatgaagattctgatcggcgtcattatcacatggattgggatgaacagccgctctacctccctgagcgtgtctcttgtgctcgtcggaatcgtgaccctgtacctgggcgttatggtgcaggctgattccgggtgtgtcgtgagctggaaaaataaggaactcaagtgcggatccggcatcttcattacagacaacgttcacacctggacagagcagtataaatttcaacctgaatctcccagcaagctggcctccgccatccagaaagctcaggaggaagggatttgtggcatccggtctgtgacgagacttgagaatctgatgtggaagcagattaccccggagctcaaccacatcctggccgaaaatgaggtcaaactgacaatcatgaccggagatattaagggcatcatgcaagctgggaaacgcagccttcggcctcagcccacagaactcaagtactcctggaagacctggggaaaagccaagatgctgagcacggagtctcataaccagaccttcctgattgacggccctgaaacagcggagtgccccaataccaacagagcctggaactccctcgaggtggaagattatgggtttggagttttcacaaccaacatctggctgaaacttaaggagaaacaggacgctttttgtgacagcaagctgatgtctgccgctattaaggataatcgcgccgtgcacgcggacatgggctactggatcgaatccgccctcaacgatacatggaaaatcgagaaggctagcttcattgaggtcaaaaattgccattggcctaagtctcacaccctgtggagcaacggcgtgctggaatccgagatgatcattcccaaaaaccttgccgggccggtgagccaacacaattatcggcctggataccatacgcagatcgctggcccctggcacctcgggaagctggaaatggacttcgatttttgtgacggaacaaccgtcgttgtgaccgaggattgcggcaacagagggccctctctgcgcacaaccacggcctccggaaagctcattacagaatggtgctgtcggagctgcaccctgcctccgcttagataccggggcgaggacggctgttggtatgggatggagatccgccccctgaaagaaaaggaggaaaatctcgtgaactccctggtcacagccggacagggccaaattgataatttctctctgggggtgcttggaatggctctctttctggaggaaatgctgagaacccgggttggcacaaaacatgcgatcctcctggtggccgtcagcttcgtgacccttatcacggggaacatgtcctttaaggacctgggaagagttgtggtcatggtgggcgctaccatgacagatgacattggcatgggggttacctacctcgccctgctggccgctttcaaagtgcgccctacatttgccgcgggacttctgctccggaagctgacctctaaggagctcatgatgacgacaatcggcattgtcctgcttagccagtccaccatccccgagacaattctggaactcaccgatgctctggccctggggatgatggtgcttaaaatcgtgagagacatggagaagtatcagctggccgtcaccatcatggctattctctgcgttcctaatgccgtgatcctgcagaacgcgtggaaagtgtcttgtacaattctcgctgtcgtgagcgttagccccctgcttctgacgagctctcaacagaagaccgactggatccctctcgccctgacaattaaaggactgaatcccaccgccatcttccttacaaccctgtcccgcacgaacaagaaaagaagctggccgctcaatgaagctatcatggccgtgggcatggtctctattctggcttccagcctcctgaagaacgatatccctatgacagggccccttgtggccggaggcctgctgaccgtttgctacgtgctcaccggccggtctgcggacctggagcttgaacgcgccacagatgtcaagtgggaggaccaggctgagatttccgggagctcccctatcctgagcattaccatctctgaagatggaagcatgtccattaaaaatgaggaagaggagcagacactcacgatcctgatcagaaccggcctcctggtgatttctgggctttttcccgtcagcatcccgattacagccgctgcctggtatctgtgggaagtgaagaaacaacgggccggagttctgtgggacgtgccttctccccctcccatgggcaaggctgagctcgaagatggggcgtaccgcatcaaacagaagggcattctgggctatagccagatcggcgccggggtctacaaggagggaaccttccacacaatgtggcatgtgaccagaggcgctgttcttatgcacaaagggaagcggatcgaacccagctgggccgacgtgaaaaaggatctgatttcctacggaggcgggtggaaactcgagggagagtggaaggaaggcgaggaagtccaggtgctggccctcgagcctggcaagaacccgcgcgctgtgcaaacgaaacccgggctgtttaagaccaatacaggaaccatcggcgccgtttctcttgacttcagccctgggacatccggaagccccattatcgataaaaagggcaaagtcgtggggctgtatggaaacggcgtggtcaccagatctggcgcgtacgtgtccgctattgcccagacagaaaagagcatcgaggacaaccctgatatcgaggacgacatttttcggaagcgcagactgacgatcatggatctccaccccggggccggaaaaaccaagcggtatctgcctgctattgttagagaagccatcaaacgcggccttcggacactgattctcgcgccgaccagagtggtcgctgccgagatggaagaggccctgcgcgggctccccatccggtaccagacccctgctattagagccgaacatacaggacgcgagatcgtggacctgatgtgtcacgctacgttcaccatgcggcttctgtctcccgttagagtgcctaattataacctgatcattatggatgaggcccatttcacagaccccgcgtccatcgccgctcgcggctacattagcacccgggtcgaaatgggggaggccgctggcatctttatgacagccaccccgcctggatccagagatcccttcccccaatctaatgcccctattatcgacgaggaacgggagatccccgaacgcagctggaactccggccacgagtgggtgacggattttaaggggaaaacagtttggttcgtgcctagcattaaggctggaaatgacatcgcggcctgcctcagaaagaacggcaaaaaggtcattcagctgtctcggaaaacctttgattccgaatatgtgaagacccgcacaaatgactgggatttcgtggtcaccacagacatcagcgagatgggggctaactttaaagccgaaagagttattgacccgcggagatgtatgaagcccgtgatccttaccgatggagaggagcgcgtgatcctggccggccctatgcccgtcacgcattctagcgctgcccagcggagagggcgcattggccggaatcctaaaaacgaaaatgaccagtacatctacatgggagagcccctcgaaaacgatgaggactgcgcgcactggaaggaagctaagatgctgctggataatattaacacaccggagggcatcattccttccatgttcgagcccgaaagagagaaagtggacgccatcgatggggaatatcgcctccggggagaggccagaaagacctttgttgaccttatgcgcagaggcgatctgcctgtgtggctggcttacaaagtcgccgcggaagggattaattatgccgaccggcgctggtgtttcgatggaatcaagaacaaccaaatcctcgaggagaatgtggaagttgagatttggacaaaagaaggcgagagaaagaagctgaaaccccggtggcttgacgctcgcatctactctgatcctctggccctcaaggagtttaaagagttcgctgccgggagaaagagcctgaccctgaacctcattacggagatgggccggcttcccaccttcatgacacagaaaaccagagacgctctggacaatctggccgtgctccacacagcggaagccggaggccgcgcttataaccatgccctgtccgagcttccggaaaccctggagacactcctgctgctcacccttctggctacggtcacagggggaatctttctgttcctcatgtctggccgggggattggaaagatgaccctgggcatgtgctgcatcgtgaccgccagcatccttctgtggtacgcccagattcagcctcactggatcgctgcgtccattatcctcgagtttttcctgattgtcctgctcatccccgaacccgagaagcaaagaacacctcaggataatcagcttacctatgtggttatcgccattctgacagtggtggctgccacgatggccaacgaaatgggctttctggagaaaaccaagaaagacctcgggctgggaagcatcgctacacagcaaccggaatctaatattcttgatatcgacctgcgccccgcctccgcgtggaccctctacgccgtcgctacaaccttcgttacgcctatgctgcggcatagcattgagaactcctctgtgaatgtgagcctgaccgccatcgctaaccaggccacagtcctcatgggccttgggaagggatggcccctgtccaaaatggatattggcgtgcctctgctcgcgatcgggtgttactctcaggttaatcccatcaccctgacagccgcccttctgctcctggtggcccactatgctattatcggacctggcctgcaggccaaggctaccagagaggcccaaaagcgggcggccgctggcattatgaaaaacccgacggtcgacgggatcacagtgattgatctcgaccccatcccttacgatcccaagtttgaaaaacagcttggacaggtcatgctgctggtgctctgcgttacccaagtgctgatgatgcgcacaacctgggccctttgtgaggctctgaccctcgccacaggccctatcagcacgctgtgggaagggaatcccggaagattctggaacaccacaattgccgtctccatggcgaatatctttcggggcagctatctggctggggccggactccttttctctattatgaagaacaccacaaatacccgcagaggcacgggcaacatcggggagacactgggagaaaaatggaagtcccggctgaacgctctcggcaaaagcgagtttcagatttacaagaagtctgggatccaggaggtggaccgcaccctggccaaagaaggaatcaagagaggcgagaccgatcaccatgccgtttcccgggggagcgctaaacttcgctggttcgtggaaagaaatatggtcacaccggagggaaaggtggtggacctgggctgcggcagagggggatggtcttattactgtggcgggctcaaaaacgttcgggaggtcaagggactgaccaagggcgggcctggacacgaggaacccattcccatgagcacatatggctggaatctggtgcgcctccagtccggcgtggatgtctttttcatccctcccgaaaaatgcgacacgcttctgtgtgacattggggagtctagccctaacccgaccgttgaagccggacggacactgagagtgctcaatctggtggagaactggcttaataacaatacccaattctgcatcaaggtcctgaacccctacatgccttccgtgattgagaaaatggaaacactccagcgcaagtacggcggggcgctggttcggaatcccctgagcagaaactccacccatgagatgtattgggtgtctaatgccagcggaaacatcgtctcctctgtgaatatgatcagccgcatgctcattaaccggtttacgatgagacacaaaaaggctacctacgaacctgatgttgaccttggctccgggacacgcaacatcggaattgagtctgaaatccccaatctggatattatcggcaagcggattgagaaaatcaagcaggagcatgaaaccagctggcactatgaccaggatcacccgtacaaaacatgggcctatcatggctcctacgagaccaagcaaacagggagcgcttcttccatggtgaacggagtcgtgagactgctcaccaaaccttgggacgtgctgcccacggtcacacagatggccatgaccgataccacacctttcggccagcagcgcgtttttaaggaaaaggtggacacgcggacccaagagcccaaagaagggacaaagaaacttatgaagatcaccgcggagtggctgtggaaagagctcggaaagaaaaagacacctagaatgtgtacccgcgaagagttcacaagaaaggtgcggagcaatgccgctctgggcgccatttttaccgatgaaaacaaatggaagtctgctcgcgaggccgtcgaggactccagattctgggaactggtggataaagagcggaatctccacctggaagggaagtgcgagacgtgtgtttataacatgatgggaaaaagagaaaagaaacttggcgagtttggcaaagctaaggggagccgggccatctggtacatgtggctgggagcgcgcttcctcgagtttgaagccctgggcttccttaatgaggaccattggttttctagagaaaactccctgagcggggtggagggagaaggcctctacaaactggggtatattctgcgggacgtctccaagaaagagggcggagctatgtacgccgatgacaccgctggctgggatacacgcatcaccctcgaggacctgaagaatgaagagatggtgacaaaccacatggaaggggagcacaagaaacttgccgaagccattttcaagctgacctatcagaataaagttgtgagagtccagcggcccacgccgcgcggaacagtgatggatatcatcagcagacgggaccaacgcggctctgggcaggttggaacctacggcctcaacacatttaccaatatggaggcgcagctgattagacagatggagggggaaggcgtgttcaagaacatccaacatcttacggtcaccgaggaaattgctgtgcagaattggctggcccgggtcggacgcgagagactcagccggatggccatctccggcgatgactgcgtggttaaacctctggatgaccgcttcgcttctgccctgacagctctcaacgatatggggaagattagaaaggacatccagcagtgggagcccagccggggatggaacgattggacccaagtgcccttttgctcccaccatttccacgaactgatcatgaaagacggcagagtccttgtggtgccttgtcgcaatcaggacgagctgattgggcgggccagaatctctcagggagcgggctggagcctccgcgaaacagcctgcctggggaagtcctatgctcagatgtggtctcttatgtactttcatcggagagatctgcgcctcgccgctaacgccatttgtagcgcggttccgtcccactgggtgcccaccagccggacaacctggtctatccacgccaaacatgagtggatgacgacagaagacatgctgaccgtctggaatagagtgtggattcaagagaacccttggatggaggataagacccccgttgaatcctgggaggaaatcccttatctgggcaaacgcgaggaccagtggtgcggaagcctcattggcctgacatctcgggctacctgggccaagaatatccaggctgccatcaaccaggtgagatcccttattgggaatgaagagtacacagattacatgcccagcatgaagcgcttccggagagaggaagaggaagctggagtcctgtggtga

SEQ ID NO: 19888 - RNA, 9876 nt, synthetic construct
  misc_feature 1..9876: note = derived and/or modified CDS sequence (opt5) from DENV-2__GQ868545__SS-prME
  source 1..9876: mol_type = other RNA
tccgccggaatgatcattatgctgatccccaccgtgatggctttccacctgacaacgcggaatggggagcctcatatgattgtctccatccaggaaaagggaaaatctctgctttttaagaccgaggacggcgttaatatgtgcacactgatggccatggatctcggggaactgtgtgaggacaccattacatacaaatgcccgcttctgcggcaaaacgaacccgaggatatcgactgttggtgcaatagcacctccacatgggtgacctatggaacgtgtaccacaaccggcgagcaccgcagagaaaagcggtctgtggcgctcgtccctcatgtggggatgggactggagacacgcaccgaaacgtggatgtcctccgagggcgcttggaaacacgcccagagaatcgagacatggattctgcggcatcccggcttcaccatcatggccgctattctcgcctacacaatcgggaccacccactttcagcgcgctctgattttcatccttctgacagccgttgcgccttctatgacgatgagatgcattggaatcagcaaccgggattttgtggaaggcgtctccgggggaagctgggtggacatcgttctcgagcacggctcttgtgtgaccacaatggccaagaataagcccaccctggatttcgaacttattaaaacagaggctaagcagcctgccaccctgcgcaaatattgcatcgaagctaagctcacgaacacaaccaccgagtccagatgtccgacacaaggggagcccagcctgaaagaagaacaagacaagcggtttgtctgcaagcattctattgtggatcgcggatggggcaatggctgtgggctgttcggaaaaggcgggatcgtgacctgcgccatgtttacatgcaagaaaaacatggaaggaaagattgtccagcctgagaatctcgaatacacgatcgttgtgacaccccactccggcgaggagcatgcggtggggaacgacacaggaaaacacggcaaggaaatcaaagtcacccctcagagctctgtgacagaggccgaactgaccggctatgggacggttaccatggagtgttcccccagaacaggacttgatttcaatgaaatggtgctgctccaaatggagaacaaggcttggctggtccaccggcagtggtttcttgacctgccgctcccttggctgcccggcgccgatacccaggggagcaattggattcagaaggagacactggtgaccttcaaaaaccctcatgctaagaaacaagacgttgtggtcctcggatcccaggaaggcgccatgcacacggccctgacaggggctaccgagatccagatgtctagcggcaatcttctgtttacaggacatctcaagtgccgcctgagaatggacaaacttcaactgaagggcatgtcctacagcatgtgtaccgggaagttcaaagtggtcaaggaaattgcggagacccagcacggaacaatcgtgattcgggttcagtatgagggcgatgggtctccctgcaaaatccccttcgaaatcatggacctcgagaagagatacgtgctgggacgcctgattacggtcaaccctatcgtgaccgaaaaagattccccggttaacattgaggccgaacccccttttggcgacagctacatcattatcggggtggagcccggccagctcaagctgaattggttcaagaaaggatctagcattggccaaatgtttgagacaaccatgagaggggctaagagaatggccatccttggagatacagcctgggacttcggctccctcgggggagtctttacctctatcggcaaagctctccatcaggtgttcggggccatttatggcgcggcttttagcggagtgtcctggacgatgaagatcctgattggcgttatcattacatggatcgggatgaacagccgctctacctccctgagcgtctctcttgtgctcgtgggaatcgtcaccctgtacctgggcgtgatggttcaggccgattccgggtgtgtggtcagctggaaaaataaggaactcaagtgcggatccggcattttcatcacagacaacgtgcacacctggacagagcagtataaatttcaacctgaatctcccagcaagctggcctccgctattcagaaagcccaggaggaagggatctgtggcattcggtctgttacgagacttgagaatctgatgtggaagcagatcaccccggagctcaaccacatcctggctgaaaatgaggtgaaactgacaattatgaccggagatatcaagggcattatgcaagccgggaaacgcagccttcggcctcagcccacagaactcaagtactcctggaagacctggggaaaagcgaagatgctgagcacggagtctcataaccagaccttcctgatcgacggccctgaaacagccgagtgccccaataccaacagagcttggaactccctcgaggtcgaagattatgggtttggagtgttcacaaccaacatttggctgaaacttaaggagaaacaggacgccttttgtgacagcaagctgatgtctgctgccatcaaggataatcgcgcggttcacgccgacatgggctactggatcgaatccgctctcaacgatacatggaaaattgagaaggccagcttcatcgaggtgaaaaattgccattggcctaagtctcacaccctgtggagcaacggcgtcctggaatccgagatgattatccccaaaaaccttgctgggccggtgagccaacacaattatcggcctggataccatacgcagattgccggcccctggcacctcgggaagctggaaatggacttcgatttttgtgacggaacaaccgtggtcgttaccgaggattgcggcaacagagggccctctctgcgcacaaccacggcctccggaaagctcatcacagaatggtgctgtcggagctgcaccctgcctccgcttagataccggggcgaggacggctgttggtatgggatggagattcgccccctgaaagaaaaggaggaaaatctcgtgaactccctggtgacagctggacatggccagatcgataatttctctctgggggtccttggaatggcgctctttctggaggaaatgctgagaacccgggtgggcacaaaacacgccatcctcctggttgctgtgagcttcgtcacccttattacggggaacatgtcctttaaggacctgggaagagtggttgtgatggtcggcgccaccatgacagatgacatcggcatgggggtgacctacctcgccctgctggctgccttcaaagttcgccctacacttgcggctggactgctcctgcggaagctcacctctaaggagctgatgatgacgacaattggcatcgtgcttctgagccaatccaccattcccgagacaatcctcgaactgaccgatgccctggcccttgggatgatggtcctgaaaatcgtgagagacatggagaagtatcagctcgctgtgaccattatggccacactgtgcgtccctaatgcggttatcctccagaacgcttggaaagtgtcttgtacgattctggccgtggtcagcgtgagcccccttctgctcaccagctctcagcaaaagacagactggatccctctggccctgaccattaaaggacttaatcccacagctatctttctgaccacgctctcccgcacaaacaagaaaagaagctggccgctgaatgaagccatcatggctgttggcatggtgtctattctcgcctccagcctgcttaagaacgatatccctatgaccgggcccctggtcgcgggaggcctgctcaccgtgtgctacgttctgacaggccggtctgccgaccttgagctggaacgcgctaccgatgtgaagtgggaggaccaggccgagatttccgggagctcccctatcctcagcattacaatctctgaagatggaagcatgtccattaaaaatgaggaagaggagcagacgctgaccatcctcatcagaacaggcctgcttgtcatttctgggctgttccccgtgagcatcccgattaccgctgccgcctggtatctgtgggaagtcaagaaacagcgggctggagtgctctgggacgttccttctccccctcccatgggcaaggcggagctggaagatggggcctaccgcatcaaacaaaagggcattcttggctatagccagatcggcgctggggtgtacaaggagggaacatttcataccatgtggcacgtcacgagaggcgccgtgctgatgcacaaagggaagcggatcgaacccagctgggccgacgttaaaaaggatctcatttcctacggaggcgggtggaaactggagggagagtggaaggaaggcgaggaagtgcaggtcctcgctctggagcctggcaagaacccgcgcgccgtgcagaccaaacccgggcttttcaagacaaataccggaacaatcggcgcggtgtctctggactttagccctgggacctccggaagccccattatcgataaaaagggcaaagttgtcgggctgtatggaaacggcgtggtgacaagatctggcgcttacgtctccgccattgcccaaacggaaaagagcatcgaggacaaccctgatatcgaggacgacattttccggaagcgcagactcaccatcatggatctgcatcccggggctggaaaaacaaagcggtatcttcctgccattgtgagagaagcgatcaaacgcggcctgcggaccctcattctggctccgaccagagttgtggccgccgagatggaagaggctctccgcgggctgcccatccggtaccagacccctgccattagagctgaacacacgggacgcgagatcgtcgaccttatgtgtcatgccacctttacaatgcggctgctgtctcccgtgagagttcctaattataacctcatcattatggatgaggcgcacttcaccgaccccgcctccatcgctgcccgcggctacattagcacacgggtggaaatgggggaggctgccggcatcttcatgaccgccacgccgcctggatccagagatccctttccccagtctaatgctcctattatcgacgaggaacgggagatccccgaacgcagctggaactccggccatgagtgggtcacagatttcaaggggaaaaccgtgtggtttgttcctagcattaaggcgggaaatgacatcgccgcttgcctgagaaagaacggcaaaaaggtgattcaactttctcggaaaaccttcgattccgaatatgtcaagacacgcaccaatgactgggattttgtggtgacaaccgacatcagcgagatgggggccaacttcaaagccgaaagagtcattgacccgcggagatgtatgaagcccgttatcctgacggatggagaggagcgcgtgatcctcgctggccctatgcccgtgacacactctagcgccgcgcagcggagagggcgcattggccggaatcctaaaaacgaaaatgaccagtacatctacatgggagagcccctggaaaacgatgaggactgcgctcactggaaggaagccaagatgctgctcgataatattaacaccccggagggcatcattccttccatgtttgagcccgaaagagagaaagtcgacgccatcgatggggaatatcgccttcggggagaggctagaaagacattcgtggacctgatgcgcagaggcgatctgcctgtttggctcgcctacaaagtggcggccgaagggattaattatgctgaccggcgctggtgttttgatggaatcaagaacaaccagatcctggaggagaatgtcgaagtggagatttggaccaaagaaggcgagagaaagaaacttaaaccccggtggctggacgcccgcatctactctgatcctctcgctctgaaggagttcaaagaatttgccgctgggagaaagagcctgacgctcaaccttattaccgagatgggccggctgcccacattcatgacccagaagacaagagacgccctggacaatctcgcggttctgcataccgccgaagctggaggccgcgcctataaccacgctctttccgagctgccggaaacactcgagaccctgctgctccttacgctgctggccacagtgaccgggggaatcttcctctttctgatgtctggccgggggattggaaagatgacccttggcatgtgctgcatcatcacagccagcattctgctctggtacgctcagatccagcctcattggattgcggcctccatcattctggagttctttctgatcgtcctccttatccccgaacccgagaagcagagaacccctcaagataatcagctgacatatgtggtcattgctatcctgacggtggttgccgccaccatggctaacgaaatgggcttcctcgagaaaacaaagaaagacctggggcttggaagcattgccacccagcagccggaatctaatatcctggatattgacctccgccccgcgtccgcctggacactgtacgctgtggccaccacgtttgtgacccctatgctgcggcacagcatcgagaactcctctgtcaatgttagcctcacagctattgccaaccaagcgaccgtgcttatgggcctggggaagggatggcccctgtccaaaatggatatcggcgtgcctctcctggccatcgggtgttactctcaggtcaatcccattacacttaccgctgccctgctcctgctggtggctcactatgccatcattggacctggcctccaggctaaggccacgagagaggcgcagaagcgggccgctgccggcatcatgaaaaacccgacagttgacgggattaccgtgatcgatcttgaccccatcccttacgatcccaagttcgaaaaacaactgggacaggtcatgctgctcgtgctgtgcgtcacacaggtgcttatgatgcgcaccacctgggctctgtgtgaggccctcacactggccacgggccctattagcaccctgtgggaagggaatcccggaagattttggaacacaaccatcgcggtttccatggctaatattttccggggcagctatctcgccggggctggacttctgttttctatcatgaagaacacaaccaatacgcgcagaggcacaggcaacattggggagaccctgggagaaaaatggaagtcccggctcaacgccctgggcaaaagcgagttccaaatctacaagaagtctgggatccaggaggtggaccgcacccttgccaaagaaggaattaagagaggcgagacagatcatcacgctgtctcccgggggagcgccaaactgcgctggtttgtggaaagaaatatggttaccccggagggaaaggtggtcgacctcggctgcggcagagggggatggtcttattactgtggcgggctgaaaaacgtgcgggaggtgaagggactgacaaagggcgggcctggacatgaggagcccatccccatgagcacgtatggctggaatctcgttcgccttcagtccggcgtcgatgtgttctttattcctcccgaaaaatgcgacaccctgctgtgtgacatcggggagtctagccctaacccgacagtggaagcgggacggaccctcagagtcctgaatcttgttgagaactggctgaataacaatacacagttctgcattaaggtgctcaacccctacatgccttccgtgatcgagaaaatggaaaccctgcaacgcaagtacggcggggccctggtccggaatcccctcagcagaaactccacgcacgagatgtattgggtgtctaatgctagcggaaacatcgtttcctctgtgaatatgattagccgcatgcttatcaaccggttcaccatgagacataaaaaggccacatacgaacctgatgtcgacctgggctccgggacccgcaacattggaatcgagtctgaaattcccaatctggatatcattggcaagcggatcgagaaaatcaagcaggagcacgaaacaagctggcactatgaccaggatcatccgtacaaaacctgggcttatcacggctcctacgagacaaagcagaccgggagcgcctcttccatggtgaacggagttgtgagactcctgacgaaaccttgggacgtccttcccacagtgacccaaatggcgatgaccgatacaacgccttttggccagcagcgcgtgttcaaggaaaaggtcgacacccggacacaggagcccaaagaagggaccaagaaactgatgaagattacagccgagtggctctggaaagagctgggaaagaaaaagacccctagaatgtgtacacgcgaagagtttaccagaaaggttcggagcaatgctgccctgggcgctatcttcacggatgaaaacaaatggaagtctgcccgcgaggctgtggaggactccagattttgggaactcgtggataaagagcggaagctgcatcttgaagggaaatgcgagacctgtgtctataatatgatgggaaagagagaaaagaaactgggcgagttcggcaaggccaaagggagccgggcgatttggtacatgtggctcggagcccgctttctggagttcgaagctcttggctttctgaacgaggaccactggttctctagagaaaattccctcagcggggtggagggagaaggcctgcacaagctggggtacatcctccgggacgtttccaaaaaggagggcggagccatgtatgctgatgacacagccggctgggatacccgcattacactggaggaccttaagaacgaagagatggtgaccaatcatatggaaggggagcacaaaaagctggccgaagcgatctttaaactcacgtaccaaaacaaggtcgtgagagttcagcggcccacaccgcgcggaaccgtgatggatatcattagcagacgggaccagcgcggctctgggcaagtcggaacatatggcctgaataccttcacgaacatggaggctcagcttatcagacagatggagggggaaggcgtgtttaaaaatattcagcatctgaccgttacagaggaaatcgccgtgcaaaactggctcgcccgggtcggacgcgagagactgagccggatggctatttccggcgatgactgcgtggtcaagcctctggatgaccgcttcgcctctgctctcaccgccctgaatgatatggggaagatcagaaaagacatccagcagtgggagcccagccggggatggaacgattggacacaggtgcccttctgctcccaccattttcacgaacttattatgaaggacggcagagttctggtggtcccttgtcgcaaccaagacgagctcatcgggcgggcgagaatttctcagggagccggctggagcctgcgcgaaaccgcttgccttgggaaatcctacgcccagatgtggtctctgatgtatttccaccggagagatctccgcctggctgccaatgcgatctgtagcgccgtgccgtcccattgggtgcccacaagccggaccacgtggtctattcacgctaagcatgagtggatgacaaccgaagacatgctgaccgtttggaacagagtgtggatccaggagaatccttggatggaggataaaacacccgtcgaatcctgggaggaaattccttacctcggcaagcgcgaggaccaatggtgcggaagcctgatcggccttacctctcgggccacatgggctaagaacatccaggccgctattaatcaggtgagatccctgatcgggaacgaagagtatacggattacatgcccagcatgaaacgctttcggagagaggaagaggaagccggagttctctggtga

SEQ ID NO: 19889 - RNA, 9876 nt, synthetic construct
  misc_feature 1..9876: note = derived and/or modified CDS sequence (opt5) from DENV-2__GQ868543__SS-prME
  source 1..9876: mol_type = other RNA
agcgccggaatgatcattatgctgatccccaccgtgatggctttccacctcaccacgagaaatggggagcctcatatgattgtcgggatccaggaaaagggaaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcagggatccaattggattcagaaagagaccctggtcacattcaagaaccctcatgctaaaaagcaagacgtggttgtgctcggcagccaggaaggggccatgcacaccgccctgacgggcgctacagagatccagatgtcctctggaaatcttctgtttaccggccatctcaaatgccgcctgagaatggacaaacttcaactgaaggggatgagctactccatgtgtacaggaaaattcaaggtcgtgaaagaaattgcggagacccagcacggcaccatcgtcattcgggtgcagtatgagggggatggaagcccctgcaagatccccttcgaaatcatggacctcgagaaaagatacgttctgggccgcctgattacagtgaaccctatcgtcacggaaaaggattctccggtgaacattgaggccgaacccccttttggggactcctacatcattatcggcgttgagcccggacagctcaagctgaattggttcaaaaagggcagctctattgggcaaatgtttgagaccacaatgcggggagctaaaagaatggccatccttggcgataccgcctgggacttcgggagcctgggaggcatgtttacatccatcgggaaggctctccatcaggtgttcggcgccatttatggagcggctttttctggcgtcagctggaccatgaaaatcctgattggggtgatcattacgtggatcggaatgaactcccgcagcacatctctgtccgtgagccttgttctcgtcggcatcgtgaccctgtacctgggggtgatggtccaggccgattctggatgtgtggtttcctggaagaataaggaactcaaatgcggcagcgggattttcatcaccgacaacgtgcacacatggaccgagcagtataagtttcaacctgaatccccctctaaactggccagcgctattcagaaggcccaggaggaaggcatctgtggcattcggtccgtcacaagacttgagaatctgatgtggaaacagatcacgccggagctcaaccacatcctggctgaaaatgaggtgaagctgaccattatgacaggcgatatcaaagggattatgcaagccggaaagcgctctcttcggcctcagcccaccgaactcaagtacagctggaaaacatggggcaaggcgaaaatgctgtccaccgagagccataaccagacgttcctgatcgacgggcctgaaaccgccgagtgccccaatacaaacagagcttggaactctctcgaggttgaagattatggatttggcgtgttcaccacaaacatttggctgaaacttaaagagaagcaggacgccttttgtgactccaagctgatgagcgctgccatcaaagataatcgcgcggtccacgccgacatgggctactggatcgaatctgctctcaacgatacctggaagattgagaaagcctccttcatcgaggtgaagaattgccattggcctaaaagccacacactgtggtctaacggggttctggaaagcgagatgattatccccaagaaccttgctggaccggtgtcccaacacaattatcggcctggctaccatacccagattgccgggccctggcacctcggaaagctggaaatggacttcgatttttgtgacggcacgacagtcgtggtgaccgaggattgcgggaacagaggacccagcctgcgcaccacaaccgcctctggcaaactcatcacggaatggtgctgtcggtcctgcacactgcctccgcttagataccggggcgaggacgggtgttggtatggaatggagattcgccccctgaaggaaaaagaggaaaatctcgtcaacagcctggttaccgctggccatggacaggtggataatttctccctgggagtgcttggcatggcgctctttctggaggaaatgctgagaacacgggtcgggaccaagcacgccatcctcctggtggctgtttctttcgtgacacttatcaccggaaacatgagctttaaagacctgggcagagtcgtggttatggtgggcgccacgatgaccgatgacattgggatgggagtcacatacctcgccctgctggctgccttcaaggtgcgccctacctttgcggctggccttctgctccggaagctgacatccaaagagctcatgatgaccacgatcgggattgttctgctttctcaaagcacaatccccgagaccattctggaactcacagatgccctggccctgggaatgatggtgcttaagatcgtcagaaatatggagaaatatcagctggctgtgaccatcatggccattctctgcgtgcctaacgcggtcatcctgcagaatgcttggaaggtttcctgtaccattctcgccgtggtgtctgtcagccccctgcttctgacatccagccagcagaagacggactggatccctctcgccctgaccattaagggcctgaaccccacagctatcttccttaccacactgtctcgcaccaataaaaagagatcctggccgctcaacgaagccatcatggctgtggggatggttagcattctggcctcttccctcctgaagaatgacatccctatgacgggaccccttgtggcgggcggcctgctgacagtctgctacgtgctcaccgggcggagcgccgatctggagcttgaacgcgctaccgacgttaaatgggaggatcaggccgagatttctggatccagccctatcctgtccattacaatcagcgaagacggctctatgagcattaagaacgaggaagaggagcagaccctcacaatcctgatcagaacggggctcctggtgatttccggactttttcccgtctctatcccgattaccgctgccgcctggtatctgtgggaagtgaaaaagcagcgggctggcgtcctgtgggatgtgccttctccccctcccatggggaaagcggagctcgaagacggagcctaccgcatcaagcaaaagggcattctgggctattcccagatcggggctggagtttacaaagagggcacattccataccatgtggcacgtgacaagaggggccgtccttatgcacaagggaaaacggatcgaaccctcctgggccgatgtgaagaaagacctgattagctacggcgggggatggaagctcgagggcgagtggaaggaaggcgaggaagttcaggtgctggctctcgagcctgggaaaaatccgcgcgccgtccagaccaagcccggactgtttaaaacgaacaccggcacaatcggggcggtgtcccttgatttctctcctggaaccagcggctcccccattatcgacaagaaagggaaggtggttggactgtatggcaacggcgtcgtgacaagaagcggggcttacgtgtctgccattgcccaaaccgaaaagtccatcgaggataatcctgagatcgaagacgatatttttcggaaacgcagactgacaatcatggacctccatcccggagctggcaagacgaaacggtatctgcctgccattgtcagagaggcgatcaagcgcgggcttcggaccctgattctcgctccgacaagagtggttgccgccgaaatggaggaagctctgcgcggactccccatccggtaccagacccctgccattagagctgagcacaccggccgcgagatcgtggacctgatgtgtcatgccacattcacgatgcggcttctgagccccgtcagagtgcctaactataatctgatcattatggatgaagcgcacttcaccgaccccgcctctatcgctgcccgcgggtacatttccacacgggttgagatgggcgaagctgccggaatctttatgaccgccacaccgcctggcagcagagatcccttcccccagtccaacgctcctattatcgacgaggagcgggaaatccccgagcgctcttggaatagcgggcatgaatgggtgaccgattttaaaggaaagacggtctggttcgtgccttccattaaggcgggcaacgacatcgccgcttgcctccgcaagaatgggaagaaagttattcaactgagccggaagacatttgattctgagtatgtgaaaacccgcaccaacgactgggatttcgtcgtgacaaccgacatctccgaaatgggagccaattttaaggccgagagagtgattgatccgcggagatgtatgaaacccgtcatccttacagacggcgaggaacgcgttatcctggctgggcctatgcccgtgacccacagctctgccgcgcagcggagaggccgcattggacggaaccctaagaatgagaacgaccagtacatctacatgggcgaacccctcgagaatgatgaagactgcgctcactggaaggaggccaaaatgctgctggataacattaatacgccggaggggatcattcctagcatgttcgaacccgagagagaaaaggtggacgccatcgatggagagtatcgcctccggggcgaagctagaaaaacatttgtcgaccttatgcgcagaggggatctgcctgtgtggctggcctacaaggttgcggccgagggaattaactatgctgaccggcgctggtgtttcgatggcatcaaaaacaatcagatcctcgaggaaaacgtggaggtcgaaatttggaccaaggagggggagagaaagaaactgaagccccggtggcttgacgcccgcatctactccgatcctctggctctcaaagaatttaaggagttcgccgctggcagaaaatctctgacactgaatctcattaccgaaatgggacggcttcccacgttcatgacccaaaagacaagagacgccctggataacctggcggtgctccataccgccgaggctggcgggcgcgcctataatcacgctctgagcgaacttccggagacactggagaccctcctgctgctcacacttctggccaccgttacgggaggcatctttctgttcctcatgtccgggcggggaattggcaagatgacactgggcatgtgctgcatcatcaccgcctctattcttctgtggtacgctcagatccagcctcattggattgcggccagcatcattctcgaatttttcctgatcgtgctgctcatccccgagcccgaaaaacagagaacccctcaagacaaccagcttacatatgtcgtgattgctatcctgaccgtcgtggccgccacaatggctaatgagatggggtttctggaaaagacgaaaaaggacctcggactgggctccattgccacccagcagccggagagcaacatccttgatattgacctgcgccccgcgtctgcctggacactctacgctgttgccaccacattcgtgacccctatgctgcggcactccatcgagaatagctccgtgaacgtctctctgacggctattgccaatcaagcgaccgttctcatggggcttggaaaaggctggcccctgagcaagatggatatcggggtgcctctgctcgccatcggatgttactcccaggtgaaccccattacactgaccgctgcccttctgctcctggtcgctcactatgccatcattggccctggcctgcaggctaaggccacaagagaagcgcagaaacgggccgctgccgggatcatgaagaatccgaccgtggacggaattacggttatcgatctcgaccccatcccttacgatcccaaatttgagaagcaacttggccaggtgatgctgctgattctctgcgtcacacaggtgctgatgatgcgcaccacatgggctctttgtgaagccctgaccctcgtcaccgggcctatctctacactgtgggagggaaaccccggcagattctggaatacgaccattgccgtgagcatggcgaacatctttcgggggtcctatctggctggagccggcctccttttcagcattatgaaaaatacaaccaacacacgcagaggcaccgggaacatcggagaaacgctgggcgagaagtggaaatctcggctgaatgctctcgggaagtccgagtttcaaatctacaagaaaagcggcattcaggaagttgaccgcacactggccaaggagggcatcaaaagaggggaaaccgatcatcacgccgtgtctcggggatccgctaaacttcgctggttcgtcgagagaaacatggtgaccccggagggcaaagttgtggacctgggctgcgggcggggaggctggagctattactgtgggggactcaagaatgtcagagaagtgaagggcctgacaaaagggggacctggccatgaggaacccattcccatgtctacctatggctggaacctggtgcgcctccagagcggggttgatgtctttttcatccctcccgagaagtgcgacacacttctgtgtgatattggagaatcctctcctaatccgacggtggaggccggccggaccctgagagtgctcaacctggtcgagaattggcttaacaataacacacagttctgcatcaaagttctgaatccctacatgcctagcgtgatcgaaaagatggaggcgctccaacgcaaatacgggggagccctggtgcggaaccccctgtccagaaatagcacccacgaaatgtattgggtctccaacgcttctggcaatattgtgagctccgttaacatgatctctcgcatgctcattaaccggtttacaatgagacataagaaggccacctacgagcctgacgtggaccttgggagcggaacgcgcaatatcggcattgaatccgagatccccaacctggatattatcggcaaacggatcgagaagattaaacaggaacacgagacctcttggcactatgaccaggatcatccgtacaagacatgggcttatcacgggagctacgaaaccaaacagacaggatccgccagctctatggtcaatggcgtggttagactgctcaccaagccttgggacgtgctgcccacagtcacccaaatggcgatgacggatacaacccctttcgggcagcagcgcgtgtttaaggagaaagtggacacccggacacaggaacccaaggagggaacgaagaaacttatgaaaatcaccgccgagtggctgtggaaagaactcggcaaaaagaagacacctagaatgtgtacccgcgaggagttcacaagaaaagtccggtccaacgctgccctgggggctatttttaccgatgagaataagtggaaaagcgcccgcgaggctgttgaagactctagattctgggagctggtggataaggaacggaacctccatctggagggaaaatgcgaaacatgtgtgtataatatgatgggcaagagagagaagaaacttggcgagtttgggaaggccaaaggatcccgggcgatctggtacatgtggctgggcgcccgcttcctcgaatttgaggctctggggttccttaacgaagaccactggtttagcagagaaaattctctgtccggagtcgaaggcgaggggctccacaagctgggctacattctgcgggatgtgagcaaaaaggagggaggcgccatgtatgctgacgacaccgccgggtgggatacgcgcatcaccctcgaagacctgaagaacgaggaaatggttacaaatcatatggagggagaacacaagaaacttgccgaggcgatcttcaaactgacctaccaaaacaaagtggtcagagtgcagcggcccacaccgcgcggcaccgttatggatattatctccagacgggaccagcgcgggagcggacaagtgggcacgtatgggctcaatacatttaccaacatggaggctcagctgattagacagatggaaggcgagggagtcttcaaaaatatccagcatcttacagtgaccgaagaggttgccgtgcaaaactggctggcccgggtcggccgcgagagactctctcggatggctattagcggggatgactgcgtggtcaagcctctggatgaccgcttcgccaacgctctgacggccctcaatgatatgggaaagatcagaaaagacatccagcagtgggaaccctccaagggctggaacgattggacccaggtgcccttttgctctcaccatttccacgagctgattatgaaagacgggcgggttcttgtggtcccttgtagaaatcaagatgaactgatcggacgcgcgcggattagccagggcgccgggtggtccctcagagagacagcttgcctgggcaagtcttacgcccagatgtggagccttatgtattttcaccgccgggacctgagactcgctgccaacgcgatctgttccgccgtgccgtctcattgggtgcccaccagccgcacaacctggtccattcacgctaaacatgaatggatgacaaccgaggacatgctgacggtttggaatcgggtgtggatccaggagaacccttggatggaagataagacacccgtcgagagctgggaagagattccttacctgggaaagagagaagaccaatggtgcggctctctcatcgggctgacctcccgcgccacctgggctaaaaatatccaggccgctattaaccaggtgcggagccttatcggaaatgaggagtatacagattacatgccctctatgaagagattccgccgggaagaggaagaggccggcgttctgtggtga

SEQ ID NO: 19890 - RNA, 9876 nt, synthetic construct
  misc_feature 1..9876: note = derived and/or modified CDS sequence (opt5) from DENV-2__EU482544__SS-prME
  source 1..9876: mol_type = other RNA
accgccggcgtgatcattatgctgatccccacagtcatggctttccacctcacgacccggaatggggagcctcatatgattgttggacggcaggaaaagggcaagagcctgctttttaagacagaggacggggtgaatatgtgcaccctgatggccatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtcgcgctcgtgcctcatgttggaatgggcctggagaccagaacggaaacatggatgtcctctgagggcgcttggaagcacgtgcagcggatcgagacctggattctgcgccatcccgggttcacaatcatggccgccattctcgcttacaccatcggaaccacacactttcagagagccctgattttcatccttctgacggctgtcgcccctagcatgaccatgcggtgcattggcatctccaaccgcgattttgtggaaggggtttctggaggcagctgggtggacatcgtcctcgagcacgggtcctgtgtgacaaccatggcgaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtcacatgcgctatgtttacgtgcaaaaagaatatggaagggaaagttgtgctccctgagaacctggaatacaccattgtgatcacaccccacagcggggaggagcatgccgtcggaaatgacaccggcaagcacggcaaagaaatcaagattacacctcagtcttccatcaccgaggcggaacttacggggtatggaaccgtgacaatggagtgtagcccccggaccggcctggatttcaacgaaatggttctcctgcagatggaggacaaagcctggcttgtgcaccgccaatggtttctggatctcccgctgccttggctgcccggggctgacacacagggatctaattggattcagaaggagaccctcgtcacgttcaagaaccctcatgccaaaaagcaggacgtggttgtgctgggctcccaagaaggggctatgcacacagcccttaccggcgccacagagatccagatgagctccggaaatctgctctttaccggccatctgaaatgcagacttcggatggataagctgcagctcaaagggatgtcttacagcatgtgtaccggaaagttcaagattgtcaaagaaatcgctgagacacaacacggcacgatcgtgattagagtccagtatgagggggacggatccccctgcaagatccccttcgaaattatggatctggagaaacgccatgtgctgggccggctcatcaccgttaaccctattgtgacagaaaaggacagcccggtcaacatcgaggcggaacccccttttggggattcttacattatcatcggcgtggagcccggacagctgaaacttaattggttcaagaagggctccagcattgggcagatgtttgagaccacaatgagaggagccaaacgcatggctatcctgggcgacaccgcctgggatttcgggtctctcggaggcgtttttacgagcattgggaaggccctgcaccaagtgttcggcgctatctacggagccgcgttttccggcgtctcttggacaatgaaaattctgatcggggtgatcattacctggatcggaatgaacagccggtccaccagcctttctgtgtccctcgttctggtcggcgtggtgacactgtatctcggggtcatggtgcaggctgacaccggatgtgttgtgagctggaagaataaagaactgaagtgcggctctgggattttcatcacagataacgtccacacgtggaccgagcagtacaagtttcagcctgaatcccccagcaaacttgcctccgccattcaaaaggctcatgaggaaggcatctgtggaatcagatctgtgacacgcctggagaatctcatgtggaaacagattaccccggagctgaaccacatcctgagcgaaaatgaggttaaacttacaattatgaccggcgacatcaaagggattatgcaggccggaaagcggtccctcagacctcagcccacggaactgaaatattcttggaagacctggggcaaggctaaaatgctgagcacagagtcccataaccaaaccttcctcatcgatgggcctgaaacagccgagtgccccaataccaaccgcgcgtggaatagcctggaggtggaagactacggatttggcgtcttctctacaaacatctggcttaagctgcgggagaaacaggacgtgttttgtgattccaagctcatgagcgccgctattaaagacaatagagccgttcacgctgatatgggctattggatcgaatctgccctgaacgacacctggaagatggagaaggcgtccttcattgagatcaaaagctgccactggcctaagtctcatacgctgtggagcaatggggtgcttgaatccgagatgattatccccaaaaacttcgccggaccggtcagccagcacaactaccgccctggctatcatacacagaccgctgggccctggcacctcggaaagctggaaatggattttgacttctgtgagggcaccacagtggtggtcaccgaagattgcgggaatcggggaccctctctgagaacgacaaccgcctccggcaaactcattacagagtggtgctgtcggagctgcaccctgcctccgcttcgctacagaggcgaggacgggtgttggtacggaatggaaatccggcccctgaaggagaaggaagagaacctcgttaattccctggtgacagctggccatgggcaaatcgataacttttctctgggagtgcttggcatggccctcttcctggaagagatgctgagaacccgcgtcgggacgaaacacgccattctcctggtggctgttagctttgtgacccttatcacaggaaatatgtccttccgggacctgggcagagtcatggtgatggttggcgcgaccatgacagatgacattgggatgggagtgacctatctcgccctgctggctgcctttaaggtccgccctacgttcgccgctggccttctgctcagaaaactgacatctaaggagctcatgatggccaccatcgggattgcgctgcttagccagtccacaatccccgaaaccatcctggagctcaccgatgctctggccctgggaatgatggtgcttaaaattgttcggaacatggaaaagtaccagctggccgtgacaatcatggctatttcttgcgtccctaatgccgtgatcctccaaaacgcgtggaaggtgagctgtacgattctggctgccgtctccgttagccccctcctgcttacctcttcccagcagaaagccgactggatccctctggctctcacaatcaagggcctgaatcccaccgccatttttctgacaacccttagccgcacgtctaaaaagagatcctggccgctgaacgaggctgtgatggccgtggggatggtcagcatcctcgcgtcttccctgctcaaaaatgacattcctatgacaggacccctggtggccggcggccttctgaccgtttgctatgtgctgaccgggcggagcgctgatctcgaactggagcgcgccgctgacgtcaagtgggaggatcaggccgaaatctccggaagctctcctattcttagcatcacaatttccgaggacggctctatgagcatcaaaaacgaagaggaggaacacaccctgacaatcctcattagaacggggctgctcgtgatctccggagttttccccgtgtctattccgatcaccgccgctgcgtggtacctgtgggaggtcaagaagcaacgggccggcgtgctttgggatgtcccttctccccctcccgtggggaaagctgaactggaggacggagcctatcgcattaagcagagaggcatctttggctactcccagatcggggccggagtttataaagaaggcacattccataccatgtggcacgtgacaagaggggctgtcctgatgcatcgcggaaagagaattgagccctcctgggccgatgtgaaaaaggacctcatcagctacggcgggggatggaagctggagggcgaatggaaagagggcgaagaggttcaggtgcttgcgctggaacctgggaagaatccgcgggctgtccaaaccaaacccggactctttaagacgaacaccggcacaattggggccgtgtccctggatttcagccctggaacctctggctcccccatcgtggacagaaaagggaaggttgtcggactctacggcaatggcgtggtgacacgcagcggggcctatgtctctgctattgcccagaccgagaagtccatcgaggataaccctgaaatcgaggacgatattttccggaaaaagagactgacaatcatggaccttcaccccggagcgggcaaaacgaagcgctacctgcctgctattgtgcgggaagccatcaaaagagggctgcgcaccctcattctggccccgacacgggttgtggctgccgagatggaagaggctcttagaggactgcccatccgctatcagacccctgccattcgggcggagcataccggcagagaaatcgtcgacctcatgtgtcacgccacatttacgatgcggctgctcagccccgtgcgcgttcctaactacaatctgatcattatggatgaggctcacttcaccgaccccgcctccatcgctgccagagggtatatttctacacgggtggaaatgggcgaggccgctggaatctttatgaccgcgacaccgcctggcagccgcgatcccttcccccagtccaacgcccctattatggacgaggaaagagagatccccgaacggagctggaactctgggcatgagtgggtcaccgattttaagggaaagacggtgtggttcgttccttccatcaaagctggcaacgacattgccgcctgccttagaaagaatgggaaaaaggtgatccaactgagccgcaaaacatttgattctgaatacgtcaagacccgggctaacgactgggatttcgtggtgaccacagacattagcgagatgggagccaattttagagcggagcgcgtcatcgatccgcggagatgtatgaagcccgttattctgaccgacggcgaggaacgcgtgatcctcgctgggcctatgcccgtgacacactcctctgccgcccagcggagaggccgcatcggaagaaaccctaaaaatgaaaacgaccagtatatttacatgggcgagcccctggaaaatgatgaggactgcgctcattggaaggaggccaaaatgcttctggataacatcaataccccggaagggattatccctagcatgttcgagcccgaacgggagaaggtcgacgcgattgatggagaataccgcctcagaggcgaggcccggaaaacgtttgtggacctgatgcgcagaggggatctgcctgtttggctcgcttatcgggtggccgctgagggaatcaactacgccgacagacgctggtgtttcgatggcattaagaataaccaaatccttgaagagaacgtcgaagtggagatctggacaaaagagggggaacggaagaagctgaaacccagatggctggacgctcgcatttattccgatcctctcgccctgaaggagttcaaagaatttgcggccggccggaagtctcttaccctgaatctcatcacagagatgggaagactgcccaccttcatgacgcagaaagctcgggacgccctggataacctcgctgttcttcacaccgccgaagtgggcgggcgcgcctacaatcacgctctgagcgagctgccggagacactcgaaaccctgcttctgctcacactgctggcgaccgtcacaggaggcatttttctcttccttatgtccgggaagggaatcggcaagatgaccctgggcatgtgctgcattatcacggccagcatcctgctctggtatgctcagattcagcctcattggatcgccgcctctattatcctggagtttttccttattgtgctgctcatccccgaacccgagaaacaaagaacacctcaggacaaccagctgacctacgtcgtgatcgctattctgaccgttgtggccgcgacaatggccaatgaaatggggtttctcgagaagaccaaaaaggaccttggactgggctccatcacaacgcaggagagcgaatccaacattctggatatcgacctccggccggcttctgcctggaccctgtatgctgtggccacaaccttcgtcacacccatgcttcgccacagcattgaaaatagctctgttaacgtgagcctgaccgcgatcgccaatcaagctacggtgctcatggggctgggaagaggctggcctctgtccaaaatggatattggggtccccctccttgccatcggatgttacagccaggtgaaccctatcaccctgacagctgccctgctcctgcttgttgctcattacgccattatcggccccggcctgcaggcgaaggccacccgggaagctcagaagcgcacagccgctgggattatgaaaaatcctaccgtggacggaatcacggtcattgatctcgagccgatcccctatgaccctaagtttgaaaaacaactgggccaggtgatgctgctcgtcctttgcgtgacacaggttctgatgatgagaaccacatgggccctgtgtgaggccctcaccctggcgaccgggcccatctctacactttgggagggaaaccctggccggttctggaatacgaccattgctgtgtccatggccaacatctttcgcgggagctacctggctggagccggcctcctgttctctattatgaagaatacaaccaacacaagacggggcaccgggaatatcggagaaacgctgggcgagaaatggaagtccagactcaacgcccttggaaagagcgaatttcagatttataaaaagtctggaatccaagaggtcgatcgcacactggctaaagagggcatcaagagaggggaaaccgaccaccatgccgtgagcagaggatccgcgaaactgcgctggttcgttgagcggaacatggtgacccccgaaggcaaggtcgtggatctcggctgcgggagaggaggctggtcttactattgtgggggactgaaaaatgtgcgcgaggttaagggccttacaaaagggggaccgggccacgaggagcctattcccatgagcacctacggctggaacctggtccggctccagtccggggtggacgtgttctttacaccccctgagaaatgcgatacgctgctgtgtgacatcggagaaagctcccccaatcctaccattgaggccggcagaacactccgcgtccttaacctggttgaaaattggctgaacaataacacccagttctgcgtgaaggtgctcaatccgtatatgccctctgtcatcgagaaaatggaaacactgcaacggaagtacgggggagctcttgtgagaaaccctctgagccgcaattccacccacgagatgtactgggtttctaacgccacgggcaatattgtgagctccgtcaacatgatctctcggatgctcatcaatagatttaccatgaaacataagaaggctacatatgagcccgatgtggacctggggagcggaacccgcaacattggcatcgaaaacgagattcctaatctggacatcattggcaaaagaatcgaaaagattaaacaggagcacgaaacatcctggcattacgatcaggaccacccctataagacctgggcctaccacgggagctatgagacaaaacagaccggatctgcgtccagcatggttaacggcgtggtcaagctccttacgaagccgtgggatgtggtgcctatggtcacacaaatggccatgaccgacaccacacccttcgggcagcagcgggtttttaaagagaaggtggatacgcgcacccaggaacctaaagagggaacaaagaaactgatgagaatcaccgctgaatggctgtggaaggagctcggcaagaaaaagacaccccggatgtgtaccagagaggagttcacacggaaagtgcgctctaatgccgctctgggggccatctttaccgacgagaacaagtggaaatccgctagagaagccgtcgaggatagccggttctgggaacttgtggaccgcgagagaaatctgcatctcgagggaaagtgcgaaacgtgtgtttacaacatgatgggcaaacgggagaagaagctgggcgaatttgggaaagcgaagggatctcgcgccatttggtatatgtggctgggcgctagattcctcgagtttgaagccctggggttccttaatgaggatcactggttttcccggggaaacagcctgtccggcgtggagggggaaggcctccataaactgggatacatccttcgcgacgtcagcaagaaagagggcggggctatgtacgccgatgacaccgccggatgggacacaagaattaccctggaagatctcaagaatgaggaaatggtgacaaaccacatgaagggcgagcataaaaagctggcggaggctatcttcaaactgacctatcaaaataaggttgtgcgggtccagcgccctacgcccagagggacagtgatggacattatctctcggaaagatcagcgcggaagcggccaggttgggacctacggcctcaacacattcaccaatatggaagcccaactgatcagacagatggagggagaaggcatttttaagtccatccagcggcttacggtgaccgaggagattgccgtccaaaactggctggctagagtggggcgcgaacggctctctagaatggccatcagcggagacgattgcgtcgtgaagccgctggacgatcgcttcgcttccgcccttacagcgctgaatgacatgggcaaagttcggaaggatattcagcagtgggagccttctagagggtggaacgactggacccaggtgcccttttgcagccaccacttccatgaactcgtcatgaaagatggacgcgtgctggtggttccctgtcggaaccaagacgagctgatcggcagagcccgcatctcccagggggctggctggtctctcaaggaaacagcctgcctgggaaaaagctatgctcagatgtggacccttatgtactttcaccggagagatctgcgcctcgccgcgaatgccatttgttccgctgtgcctagccattgggtcccgacatctcggaccacgtggtccatccacgccaagcacgagtggatgacaaccgaggacatgctggctgtgtggaacagagtttggattcaggaaaatccctggatggaggacaagacccctgtggaaagctgggaggaagtcccctatcttggcaaacgggaggatcaatggtgcgggtctctgatcggactcacatccagagccacctgggctaagaacattcagacagccatcaatcaggtgcgcagcctgattggcaacgaggaatacacggactatatgccttccatgaaacggttcagaaaggaggaagaggaagcgggggtcctgtggtga

SEQ ID NO: 19891 - RNA, 9876 nt, synthetic construct
  misc_feature 1..9876: note = derived and/or modified CDS sequence (opt5) from DENV-2__EU482545__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattatgatcacaccccacagcggggaggagcatgcggtgggaaatgacaccggcaagcacggcaaagaaatcaagattacacctcagtcttccatcaccgaggccgaactgacggggtatggaaccgtgacaatggagtgtagcccccggaccggccttgatttcaacgaaatggtcctgctccaaatggaggacaaggcttggctggtgcaccgccagtggtttcttgatctgccgctcccttggctgcccggggccgacacacagggatctaattggattcagaaggagaccctggttacgttcaagaaccctcatgctaaaaagcaagacgtggtcgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgttaaagaaatcgcggagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcgtggggaaggctctccaccaggttttcggcgccatttacggagcggctttttccggcgtgtcttggacaatgaaaatcctgattggggtcatcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacaggcgacattaaagggatcatgcaggccggaaagcggtctcttagacctcaacccaccgaactcaaatatagctggaagacgtggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacaaacatctggctgaaacttcgggagaaacaggacgtgttttgtgattccaagctgatgagcgccgctatcaaagacaatagagccgtccacgcggatatgggctattggattgaatctgccctcaacgacacctggaagatggagaaggcttccttcatcgaggtgaaaagctgccactggcctaagtctcatacgctgtggagcaatggggttctggaatccgagatgattatccccaaaaacttcgccggaccggtgagccagcacaactaccgccctggctatcatacacaaaccgctgggccctggcaccttggaaagctcgaaatggattttgacttctgtgagggcaccacagtcgtggtgaccgaagattgcgggaatcggggaccctctctgagaacgacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacagccggccatgggcagattgataacttttctctgggagtgctgggcatggctcttttcctcgaagagatgctgagaacccgcgtggggacgaaacacgcgatcctgctcgtcgccgtgagctttgttaccctgatcacaggaaatatgtccttccgggaccttggcagagtgatggtcatggtgggcgctaccatgacagatgacattgggatgggagttacctatctggccctcctggccgcttttaaggtgcgccctacgttcgccgcgggcctgcttctgagaaaactcacatctaaggagctgatgatggctaccatcgggattgccctcctgagccagtccacaatccccgaaaccattcttgagctgaccgatgccctcgctctgggaatgatggccctgaaaatcgtcaagaacatggaaaagtaccaacttgcggtgacaatcatggctatttcttgcgttcctaatgccgtgatcctgcagaacgcctggaaagtcagctgtacgattctcgctgccgtgtccgtgagccccctgctcctgacctcttcccagcagaaggctgactggatccctcttgccctgacaattaaaggcctcaatcccaccgcgatctttctgacaaccctgagccggacgtctaagaaacgctcctggccgcttaacgaggccatcatggctgtcgggatggttagcattctggcctcttccctcctgaagaatgacatccctatgacaggacccctcgtggctggcggcctgcttaccgtgtgctatgtcctgaccgggagaagcgccgatctggaactcgagcgggccgctgacgtgaaatgggaggatcaagcggaaatttccggaagctctcctatcctgagcattacaatctccgaggacggctctatgagcattcgcaacgaagaggaggaacagacccttacaatcctgatcagaacggggctcctggttatttccggagtgttccccgtctctatcccggtgaccgccgctgcctggtacctctgggaggttaagaagcagcgggccggcgtgctgtgggatgtcccttctccccctcccgtggggaaagctgaacttgaggacggagcctatcgcattaagcagagaggcatcctgggctactcccaaattggggcgggagtctataaagaaggcacatttcacaccatgtggcatgtgacaagaggggctgttctgatgcaccgcggaaagagaatcgagccctcctgggccgatgtgaaaaaggacctcgtcagctacggcgggggatggaagctggagggcgaatggaaagagggcgaagaggtgcaggttcttgccctggaacctgggaagaatccgcgggctgtgcagaccaaacccggaatcttcaagacgaacaccggcacaattggggccgtctccctcgattttagccctggaacctctggctcccccatcgtggacagaaaagggaaggtggttggactgtacggcaatggcgtcgtgacacgcagcggggcgtatgtgtctgctattgcccagaccgagaagtccatcgaggataaccctgaaattgaggacgatatcttccggaaaaagagactcacaatcatggacctgcatcccggagccggcaaaacgaagcgctaccttcctgctattgtccgggaagccatcaaaagagggctgcgcaccctgattctcgctccgacacgggtggttgccgcggagatggaagaggccctgagaggacttcccatccgctatcaaacccctgctattcgggccgagcacaccggcagagaaatcgtggacctgatgtgtcatgctacattcacgatgcggctcctgagccccgtccgcgtgcctaactacaatctcattatcatggatgaggcccactttaccgaccccgcctccatcgctgcgagagggtatatttctacacgggttgaaatgggcgaggccgctggaatcttcatgaccgccacaccgcctggcagccgcgatccctttccccagtccaacgcccctattatggacgaggaaagagagatccccgaacggagctggaactctgggcacgagtgggtgaccgatttcaagggaaagacggtctggtttgtgccttccattaaagctggcaacgacatcgccgcgtgcctgagaaagaatgggaaaaaggttatccagcttagccgcaaaacattcgattctgaatacgtgaagacccgggctaacgactgggattttgtcgtgaccacagacattagcgagatgggagccaatttcaaggccgagagagtgatcgatccgcgccggtgtatgaaacccgtcattctgaccgacggcgaagagagagttatcctggctgggcctatgcccgtgacacattcctctgccgcgcaacgccggggcagaattggacgcaaccctaagaatgaaaacgaccagtatatctacatgggcgagcccctcgaaaatgatgaggactgcgcccactggaaagaggctaagatgctgcttgataacatcaataccccggaagggattatccctagcatgtttgagcccgaaagagagaaagtggacgccattgatggagaataccggctgcgcggcgaggctagaaagacgttcgtcgacctcatgcggcgcggggatctgcctgtgtggctggcctataaagttgctgccgagggaatcaactacgcggacagacggtggtgttttgatggcattaagaataaccagatcctcgaagagaacgtggaagtcgagatttggacaaaggagggggaacgcaagaaacttaaaccccgctggctggacgcccggatctattccgatcctctggctctcaaggagttcaaagagttcgccgctggcagaaagtctctgacccttaatctgatcacagagatgggacgcctccccacctttatgacgcagaaggcccggaacgccctggacaatctggctgtgctccataccgcggaagccggcgggaaggcttacaaccacgcccttagcgagctgccggagacactggaaaccctcctgcttctgacactcctggccaccgttacaggaggcattttcctgtttctcatgtccgggaagggaatcggcaaaatgacccttggcatgtgctgcattatcacggctagcattctgctgtggtatgcccaaatccagcctcactggatcgcggcctctattatcctcgagttctttctgattgtgcttctgatccccgaacccgagaagcagagaacacctcaggataatcaactcacctacgtcgtgattgctatcctgaccgtcgtggccgctacaatggccaacgaaatggggttcctggagaaaaccaagaaggacctcggacttggctccatcacaacgcaggagagcgaatccaatattctggacatcgatctgcggccggcgtctgcctggaccctctatgctgttgccacaacctttgtgacacccatgctgcgccatagcattgagaactcctctgtgaatgtcagccttaccgctatcgccaaccaggctacggttctgatggggctcggaaaaggctggcctctgtccaagatggacattggggtgcccctgctcgccatcggatgttacagccaggtgaatcctattacccttacagcggccctgctgctcctggtcgctcactacgccatcatcggccccggccttcaagctaaagccaccagagaagcccagaagcgggcggctgccgggattatgaaaaaccctacagtggatggaatcaccgttattgacctggagccgatcccctatgatcctaagttcgaaaagcagctcggccaggtgatgctgctgattctctgcgtcacgcaagtgcttatgatgcgcacaacctgggctctgtgtgaggccctgacactcgccaccgggcccatctctaccctgtgggagggaaatcctggcagattttggaacacaacgatcgctgtctccatggccaatattttccgggggagctaccttgcgggagccggcctgctcttttctatcatgaaaaacaccacaaatacccgcagaggcacagggaacattggagaaaccctgggcgagaagtggaaatcccggctgaacgctctcggaaagagcgagttccagatctataaaaagtctggcattcaggaggtggaccgcacgcttgccaaagagggcatcaagagaggggaaacagatcatcacgctgttagccggggatccgccaagctgagatggtttgtggagcgcaatatggtcacccccgaaggcaaagtggttgacctgggctgcgggcggggaggctggtcttactattgtgggggactcaagaacgtgagagaggtcaaaggcctgaccaaagggggaccgggccatgaagaacctatccccatgagcacatacggctggaatcttgtgcgcctgcaatccggggtggatgttttcttcacaccccctgagaaatgcgacaccctcctgtgtgatattggagaaagctcccccaaccctacgatcgaggcgggccggaccctgagagtcctcaatcttgtggaaaactggctgaataacaatacacagttttgcattaaggtgctgaacccgtatatgccctctgtcatcgagaagatggaaaccctccagcgcaaatacgggggagccctggttcggaatcctcttagcagaaactccacacacgagatgtactgggtgtctaatgctaccggcaacattgtgagctccgtcaatatgatctctcgcatgctgatcaaccggttcacgatgaagcacaaaaaggccacctatgagcccgacgtggatctcgggagcggaacaagaaacattggcatcgaatccgagattcctaatctggacatcattggcaaacgcatcgaaaagattaagcaggagcatgaaaccagctggcactacgaccaagatcatccctataaaacatgggcttaccacgggtcttatgagaccaagcagacaggatccgccagctctatggttaacggcgtggtccggctgctcaccaaaccgtgggacgtggttcctatggtgacgcagatggctatgacagataccaccccctttgggcagcaaagagtcttcaaggagaaagtggacacacgcacgcaggaacctaaggagggaaccaagaaacttatgaagatcacagccgaatggctgtggaaagagctgggcaagaaaaagacccccagaatgtgtacacgggaggaatttacccgcaaagtgagatccaatgcggccctcggggctatcttcacagatgagaacaagtggaaaagcgcccgggaagctgtcgaggacggaagattttgggaactggttgatcgggagcgcaatcttcacctggagggcaaatgcgaaacctgtgtgtacaacatgatgggcaagagagagaaaaagctcggggagttcggaaaagccaagggctctcgggccatttggtatatgtggctgggggcgcgctttctggagttcgaagctctcggatttctgaatgaggaccattggttctccagaggcaacagcctttccggggtggagggcgaaggactgcaccggctcggctacatcctgcgcgatgtcagcaagaaagaagggggagccatgtacgccgacgatacggctggctgggacaccagaattacacttgaagacctgaagaatgaggaaatggtgaccaaccatatgaaaggggagcacaagaaactcgccgaggctatctttaagctgacatatcagaataaggttgtgcgggtccagcgccctacccccagaggaacggtgatggatattatctctcggcgcgaccaaagaggcagcgggcaggttggcacatacggactgaacaccttcacaaatatggaagcccagctcatccggcaaatggagggcgaagggattttcaaatccatccagcatctgaccgtgacggaggagattgcggtccagaactggcttgcccgcgtgggaagagaacggctgtctagaatggctatcagcggcgatgactgcgttgtgaagccgattgatgaccgctttgcctccgctctcaccgccctgaatgatatggggaaagtccggaaggacatccagcaatgggagccttctagaggatggaacgattggacacaggtgcccttctgcagccaccactttcatgaacttgtcatgaaagacggccgcgtgctggttgtgccctgtcggaaccaggatgagctcatcgggagagcgcgcatttcccagggcgccggatggtctctgaaggaaaccgcttgcctgggcaagagctatgcccaaatgtggacactcatgtacttccaccggagagacctgcgccttgctgccaatgctatctgttccgccgtccctagccattgggtgccgacctctcggacaacctggtccattcacgcgaaacacgagtggatgacgacagaggatatgctggccgtgtggaacagagtttggatccaggaaaatccctggatggaggacaagacccctgtggaaagctgggaggaagtcccctatctcgggaaacgcgaggaccagtggtgcggatctctgattggccttacctcccgggctacatgggccaagaacatccagaccgccattaatcaagtgagaagcctgatcgggaacgaggaatacacagattatatgccttccatgaaacggtttagacgcgaggaagaggaagctggagttctctggtga

SEQ ID NO: 19892 - RNA, 9876 nt, synthetic construct
  misc_feature 1..9876: note = derived and/or modified CDS sequence (opt5) from DENV-2__EU482546__SS-prME
  source 1..9876: mol_type = other RNA
acagccggcgtgatcgtgatgctgattcccacagttatggctttccacctcacgacccggaatggggagcctcatatgatcgtgggacggcaggaaaagggcaaaagcctgctttttaagacagaggacgggattaatatgtgcaccctgatggccatcgatctcggagaactgtgtgaggacacaattacctacaaatgcccgcttctgaagcaaaatgaacccgaggatatcgactgttggtgcaattccacatctacctgggtgacgtatggcacctgtacaaccacaggggagcacagaagagaaaaacggagcgtcgcgctcgtgcctcatgttggaatgggcctggagacccgcacggaaacatggatgtcctctgagggcgcttggaagcacgtgcagagaatcgagacctggattctgcggcatcccgggttcacaatcatggccgccattctcgcttacaccatcggaaccacacactttcagcgcgccctgattttcatccttctgacggctgtcgcccctagcatgaccatgagatgcattggcatctccaaccgggattttgtggaaggggtttctggaggcagctgggtggacatcgtcctcgagcacgggtcctgtgtgacaaccatggcgaagaataaacccacactggatttcgaacttattaagaccgaggccaaacagcctgctacgctgcgcaagtattgcatcgaagccaaactcacaaacaccaccacagagagcagatgtccgacccaaggagagccctctctgaatgaagaacaggacaagcggtttatttgcaagcattccatggtggatcgcggctggggcaacgggtgtggactgttcggcaaagggggaatcgtcacatgcgctatgtttacgtgcaagaaaaatatggaaggcaaggttgtgcagcctgagaacctcgaatacaccattgtgatcacaccccacagcggggaggagcatgccgtcggaaatgacaccggcaaacacggcaaggaaatcaaaattacacctcagtcttccatcaccgaggcggaactgacggggtatggaaccgtgacaatggagtgtagccccagaaccggccttgatttcaacgaaatggttctgctccaaatggaggacaaggcctggctggtgcaccggcagtggtttcttgatctgccgctcccttggctgcccggggctgacacacagggatctaattggattcagaaggagaccctggtcacgttcaaaaaccctcatgccaagaaacaagacgtggttgtgctcggctcccaggaaggggctatgcacacagccctgaccggcgccacagagatccagatgagctccggaaatcttctgtttaccggccatctcaagtgccgcctgagaatggataaacttcaactgaaggggatgtcttacagcatgtgtaccggaaagttcaaaattgtcaaggaaatcgctgagacacagcacggcacgatcgtgattcgggtccagtatgagggggacggatccccctgcaaaatccccttcgaaattaccgatctcgagaagagacatgtgctgggccgcctgatcacagttaaccctattgtgaccgaaaaagacagcccggtcaacatcgaggcggaacccccttttggggattcttacattatcatcggcgtggagcccggacagctcaagctgaattggttcaagaaaggctccagcattgggcaaatgtttgagacaaccatgcggggagccaagagaatggctatccttggcgacacggcctgggatttcgggtctctgggaggcgtttttacaagcattgggaaagccctccaccaggtgttcggcgctatctacggagccgcgttttccggcgtctcttggaccatgaagattctgatcggggtgatcattacctggatcggaatgaacagccgctccacaagcctgtctgtgtcccttgttctcgtcggcgtggtgaccctgtatctgggggctatggtccaggccgacagcggatgtgtggtttcttggaaaaataaggaactcaagtgcggctccgggattttcatcacagataacgtgcacacgtggaccgagcagtacaaatttcaacctgaaagcccctccaagctggcctctgctattcagaaagcccatgaggaaggcatctgtggaatccggagcgtcacaagacttgagaatctgatgtggaagcagattaccccggagctcaaccacatcctgtccgaaaatgaggtgaaactgacaattatgaccggcgacatcaaggggattatgcaggctggaaaacgctctcttcggcctcaacccacggaactcaagtatagctggaagacctggggcaaagccaagatgctgtccacagagagccataaccagaccttcctgatcgatgggcctgaaacagcggagtgccccaataccaacagagcctggaactctctcgaggttgaagactacggatttggcgtgttcacaaccaacatctggctgaaacttcgcgagaagcaggacgctttttgtgattccaaactgatgagcgccgctattaaggacaatcgggccgtccacgcggatatgggctattggatcgaatctgccctcaacgacacgtggaagatggagaaggctagcttcattgaggtcaagagctgccactggcctaaatctcatacactgtggagcaatggggttctggaatccgagatgatcattcccaagaacttcgccggaccggtgagccagcacaaccatagacctggctaccacacccaaaccgctgggccctggcatcttggaaaactcgaaatggattttgacttctgtgagggcacaaccgtcgtggtgacggaagattgcgggaatcgcggaccctctctgcggacaaccacagcctccggcaagctgatcaccgagtggtgctgtagaagctgcacactccctccgctgcggtatcgcggcgaggacgggtgttggtacggaatggaaattagaccccttaaggagaaagaagagaacctggtcaattccctcgttaccgccggccacgggcagatcgataacttttctctgggagtgctgggcatggctcttttcctcgaagagatgctgcggacgagagtggggaccaagcacgcgatcctgctcgtcgccgtgagctttgttacactgattaccggaaatatgtccttccgcgaccttggccgggtgatggtcatggtgggcgctacaatgaccgatgacatcgggatgggagttacgtacctggccctcctggccgcttttaaagtgagacctacattcgccgcgggcctgcttctgcgcaagctcacctctaaagagctgatgatggctacaattgggatcgccctcctgagccagtccaccattcccgaaaccatccttgagctgacagatgccctcgctctgggaatgatggtcctgaagatcgtgagaaacatggaaaagtatcaacttgccgttacgattatggcgatctcttgcgtgcctaatgctgtcattctgcagaacgcctggaaagtgagctgtaccatcctcgccgctgtgtccgtcagccccctgctcctgacatcttcccagcagaaggccgactggattcctcttgctctgaccatcaaaggcctcaatcccacagccatctttctgaccacgctgagccggacatctaagaaacgctcctggccgcttaacgaggcgattatggccgttgggatggtgagcatcctggcttcttccctcctgaagaatgacattcctatgaccggacccctcgtggccggcggcctgcttaccgtctgctacgtgctgacagggagaagcgctgatctggaactcgagcgggccgccgacgttaaatgggaggatcaagctgaaatctccggaagctctcctattctgagcatcaccatttccgaggacggctctatgagcatcaagaacgaagaggaggaacagacacttacgatcctgattcgcaccgggctcctggtgatctccggagtcttccccgtgtctattccgatcacagcggccgcttggtatctctgggaggttaagaaacagagagccggcgtgctgtgggatgtcccttctccccctcccgtggggaaggccgaacttgaggacggagcttaccggattaaacagcgcggctttctgggctattcccaaatcggggccggagtctacaaggaaggcaccttccatacaatgtggcacgtgaccagaggggcggttctgatgcatcggggaaaacgcatcgagccctcctgggctgatgtgaagaaggacctcattagctatggcgggggatggaaactggagggcgaatggaaggagggcgaagaggtccaggtgcttgccctggaacctgggaaaaatccgagagccgttcagacgaagcccggaatctttaaaaccaacacaggcaccattggggctgtgtccctcgatttcagccctggaacatctggctcccccatcgtcgaccggaaggggaaggtggtgggactgtacggcaatggcgttgtcaccagaagcggggcctacgtgtctgcgattgctcagacagagaaatccatcgaggataaccctgaaatcgaggacgatattttccgcaagaaacggctcacgatcatggacctgcaccccggagccggcaagaccaaaagatatcttcctgccattgtgcgcgaagctatcaagcgggggctgagaacactgattctcgccccgacccgcgtcgtggctgccgagatggaagaggcgctgcggggacttcccatcagataccaaacccctgccattcgcgctgagcatacaggccgggaaatcgttgacctgatgtgtcacgccacgtttaccatgagactcctgagccccgtgcgggtccctaactataatctcatcattatggatgaggctcacttcacagaccccgcctccatcgccgctcgcgggtacatttctaccagagtggaaatgggcgaggcggccggaatctttatgacagctaccccgcctggcagccgggatcccttcccccagtccaacgcccctattatggacgaggaacgcgagatccccgaaagaagctggaactctgggcatgagtgggttacggattttaagggaaaaacagtgtggttcgtcccttccatcaaggccggcaacgacattgctgcctgcctgcggaaaaatgggaagaaagtgatccagcttagcagaaagacctttgattctgaatatgttaagacccgcgcgaacgactgggatttcgtggtcacaaccgacattagcgagatgggagctaattttaaagccgagcgggtgatcgatccgagacgctgtatgaagcccgtgattctgacagacggcgaggaacgggtcatcctggccgggcctatgcccgttacccactcctctgctgcccaaagacgcggccggatcggaagaaaccctaaaaatgaaaacgaccagtacatttatatgggcgagcccctcgaaaatgatgaggactgcgcgcattggaaggaggccaaaatgctgcttgataacatcaatacgccggaagggattatccctagcatgttcgagcccgaacgcgagaaggtggacgctattgatggagaatacagactgcggggcgaggcccgcaaaacatttgtggacctcatgagaagaggggatctgcctgtctggctggcttacaaggtggccgctgagggaatcaactatgccgaccgcaagtggtgtttcgatggcattaaaaataaccagatcctcgaagagaacgttgaagtggagatctggaccaaggagggggaacgcaagaaacttaaaccccggtggctggacgcgagaatttactccgatcctctggccctcaaggagttcaaggaatttgctgccggccgcaaatctctgacacttaatctgatcaccgagatgggacggctccccacgttcatgacccagaaggctagaaacgccctggacaatctggccgtcctccacacagctgaagcgggcgggcgcgcctataaccacgctcttagcgagctgccggagaccctggaaacactcctgcttctgaccctcctggccacagtgaccggaggcatttttctgttcctcatgtccgggaaaggaatcggcaagatgacgcttggcatgtgctgcattatcacagccagcatcctgctgtggtacgctcaaattcagcctcattggatcgccgcgtctattatcctcgagtttttcctgattgttcttctgatccccgaacccgagaaacagcggacccctcaggataatcaactcacctatgtggtcatcgccattctgacagtggtcgctgccaccatggctaacgaaatggggtttctggagaagacaaagaaagacctcggacttggctccatcacgacccaggagagcgaatccaatattctggacatcgatctgagaccggcctctgcgtggacactctacgccgtggctaccacattcgttacccccatgctgcggcacagcattgagaactcctctgtgaatgtgagccttacggccatcgctaaccaggccaccgtcctgatggggctcggaaagggctggcctctgtccaaaatggacattggggttcccctgctcgctatcggatgttatagccaggtgaatcctatcacacttaccgccgcgctgctgctcctggtggcccattacgctattatcggccccggccttcaagccaaggctacacgcgaagcccagaaaagagccgcggctgggattatgaagaaccctaccgtcgatggaatcacggtgattgacctggagccgatcccctacgatcctaagtttgaaaaacagctcggccaggttatgctgctgatcctctgcgtgacacaagtccttatgatgcggaccacatgggccctgtgtgaggctctgaccctcgccaccgggcccatttctacactgtgggagggaaatcctggccgcttctggaacacgaccatcgccgtgtccatggctaatatttttagagggagctatcttgccggagcgggcctcctgttctctatcatgaagaacacaaccaatacacggcgcggcaccgggaacattggagaaacgctgggcgagaaatggaagtccagactgaacgccctcgggaaaagcgaatttcagatctacaagaaatctggaatccaggaggtcgaccggacacttgctaaggagggcattaagcgcggggaaaccgatcaccatgccgtgagcagaggatccgctaaactgcggtggttcgttgagagaaatatggtgacccccgaaggcaaggtcgtggacctgggctgcgggcgcggaggctggtcttattactgtgggggactcaaaaacgttcgggaggtgaagggcctgacaaaagggggaccgggccacgaggaacctatccccatgagcacctatggctggaatcttgtcagactgcaatccggggtggatgtgttctttacaccccctgagaagtgcgacacgctcctgtgtgatattggagaaagctcccccaaccctaccatcgaggccggccgcacactgcgggttctcaatcttgtcgaaaactggctgaataacaatacccagttctgcattaaggtgctgaacccgtacatgccctctgtgatcgagaaaatggaaacactccagagaaagtatgggggagcgctggtccgcaatcctcttagccggaactccacccacgagatgtactgggtttctaatgccacgggcaacatcgtgagctccgtgaatatgatttctagaatgctgatcaaccgctttaccatgaaacataagaaagctacatacgagcccgacgtcgatctcgggagcggaacccggaacattggcatcgaatccgagattcctaatctggacatcattggcaagagaatcgaaaagatcaaacaggagcacgaaacaagctggcattatgaccaagatcacccctacaagacctgggcctatcacgggtcttacgagacaaaacagaccggatccgctagctctatggtgaacggcgttgtgcgcctgctcacgaagccgtgggacgtcgtgcctatggttacacagatggccatgaccgataccacacccttcgggcagcaacgggtgtttaaagagaaggtcgacacgagaacccaggaacctaaggagggaaccaagaaacttatgaaaattaccgctgaatggctgtggaaagagctgggcaaaaagaaaacaccccgcgtgtgtaccagagaggagttcacacggaaggtgcgctccaatgccgcgctcggggccatctttaccgatgagaacaagtggaaaagcgctagagaagccgtcgaggacggacggttctgggaactggttgatagagagcggaatcttcatctggagggcaagtgcgaaacgtgtgtgtataacatgatgggcaaacgcgagaagaaactcggggaatttggaaaggctaagggctctagagccatttggtacatgtggctgggggcccggttcctggagtttgaagcgctcggattcctgaatgaggaccactggttttcccgcggcaacagcctttccggggtggagggcgaaggactgcatagactcggctatatcctgcgggatgtcgggaaaaaggagggaggcgctatgtacgccgacgataccgccgggtgggacacacgcattacccttgaagacctgaaaaatgaggaaatggtgacaaaccacatgaagggagagcataaaaagctcgctgaggccatcttcaagctgacctaccagaataaagttgtgagagtccagcggcctacgccccgcggcacagtgatggatatcattagcagacgggaccaacgcgggtctggccaggttggaacctatggcctgaacacattcaccaatatggaagctcagctcatcagacaaatggagggggaaggaatttttaagagcatccagcacctgacggccaccgaggagattgcggtgcagaactggcttgcccgggtcggccgcgaaagactgtcccggatggctatctctggggatgactgcgtggttaaaccgatcgatgacagattcgccagcgctctcacagccctgaatgatatgggaaaggtgcgcaaagacattcagcaatgggagccttcccggggctggaacgattggacccaggtccccttttgctctcaccatttccacgaacttgtgatgaaggacgggagagtcctggtggttccctgtcgcaaccaggatgagctcatcggccgggcgagaattagccagggagccggctggtccctgaaggaaacagcttgcctggggaaatcttacgcccaaatgtggaccctcatgtattttcatcgccgggacctgagacttgctgccaatgctatctgtagcgccgtgccttcccactgggtcccgacaagccgcaccacgtggtctattcacgcgaagcatgagtggatgacaaccgaggatatgctggccgtgtggaaccgggtgtggatccaggaaaatccctggatggaggacaaaacccctgttgaatcctgggaggaagtgccctacctcggaaagagagaggaccagtggtgcggcagcctgattgggcttacatctcgcgctacctgggccaaaaacatccagacagccatctcccaagtccggagcctgattggaaatgaggaatatacggattacatgccttccatgaagagattccggagagaggaagaggaagctggcgtgctctggtga

SEQ ID NO: 19893 - RNA, 9876 nt, synthetic construct
  misc_feature 1..9876: note = derived and/or modified CDS sequence (opt5) from DENV-2__EU482550__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgctacgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcatcaagttttcggcgccatctatggagcggctttttccggcgtgtcttggacaatgaaaattctgatcggggtcatcattacctggatcggaatgaacagccggtccaccagcctttctgtgtccctcgtgctggttggcgtcgtgacactgtacctcggggtgatggtccaggccgacagcggatgtgtggtttcttggaagaataaagaactgaagtgcggctccgggattttcatcaccgataacgtgcacacatggacggagcagtataagtttcagcctgaaagcccctccaaacttgcctctgctattcaaaaggcccacgaggaaggcatctgtggaatcagaagcgtcacccgcctggagaatctcatgtggaaacagattacaccggagctgaaccatatcctgtccgaaaatgaggtgaaacttaccattatgacaggcgacatcaaagggattatgcaggctggaaagcggtctctcagacctcagcccaccgaactgaaatacagctggaagacgtggggcaaggccaaaatgctgtccaccgagagccacaaccaaacattcctcatcgatgggcctgaaaccgcggagtgccccaatacaaaccgcgcctggaactctctggaggttgaagactatggatttggcgtgttctccaccaacatctggcttaagctgcgggagaaacaggacgtcttttgtgatagcaagctcatgtctgctgccattaaagacaatagagctgtgcatgccgatatgggctactggatcgaatccgcgctgaacgacacatggaagatggagaaggccagcttcattgaggttaaatcttgccactggcctaagagccacaccctgtggtccaatggggtgcttgaaagcgagatgatcattcccaaaaacttcgctggaccggtctctcagcataactatcgccctggctaccacacgcagacagccgggccctggcatctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtatggaatggaaattcggcccctgaaggagaaggaagagaacctcgttaattctctggtgaccgccggccacgggcaaatcgataactttagcctgggagtgcttggcatggccctcttcctggaagagatgctgagaacacgcgtcgggaccaaacatgctatcctcctggtggcggtttcctttgtgacgcttattaccggaaatatgtctttccgggacctgggcagagtcatggtgatggttggcgccacaatgaccgatgacatcgggatgggagtgacatacctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtatcagctggctgtgaccattatggccatcctctgcgtccctaatgcggtgattctgcaaaacgcttggaaggtgagctgtacaatcctcgccgccgtctccgttagccccctgcttctgacgtcttcccagcagaaagctgactggattcctctcgccctgaccatcaagggcctgaatcccacagctatctttcttaccacactgagccgcacctctaaaaagagatcctggccgctcaacgaggccgtgatggcggtggggatggtcagcattctggcctcttccctcctgaaaaatgacatccctatgacgggaccccttgtggctggcggcctgctgacagtttgctacgtgctcaccgggcggagcgccgatctggaacttgagcgcgctgccgacgtcaagtgggaggatcaggccgaaatttccggaagctctcctatcctgagcattaccatctccgaggacggctctatgagcattaaaaacgaagaggaggaacaaacactcaccatcctgatcagaacagggctcctggtgatttccggagttttccccgtgtctatcccgattacggctgcggcctggtatctttgggaggtcaagaagcagcgggctggcgtgctgtgggatgtcccttctccccctcccgtggggaaagccgaactggaggacggagcctaccgcatcaagcagagaggcatttttggctattcccagatcggggctggagtttacaaagaaggcaccttccacacaatgtggcacgtgaccagaggggccgtcctcatgcatcgcggaaagagaatcgagccctcctgggcggatgtgaaaaaggacctgattagctacggcgggggatggaaacttgagggcgaatggaaagagggcgaagaggttcaagtgctggctctcgaacctgggaagaatccgcgggccgtccagacaaaacccggactgtttaagaccaacacgggcaccatcggggccgtgtccctcgatttcagccctggaacatctggctcccccattgtggacagaaaagggaaggttgtcggactgtatggcaatggcgtggtgacccgcagcggggcttacgtctctgccatcgcgcagacagagaagtccattgaggataaccctgaaatcgaggacgatatcttccggaaaaagagacttaccattatggacctgcaccccggagctggcaaaacaaagcgctatctgcctgccatcgtgcgggaagccattaaaagagggctccgcacgctgatccttgctccgacccgggttgtggccgctgagatggaagaggccctgagaggactccccattcgctaccagacccctgcgatccgggccgagcataccggcagagaaattgtcgacctgatgtgtcacgctacctttacaatgcggctcctgagccccgtgcgcgttcctaactataatcttatcatcatggatgaggcccatttcacggaccccgcttccattgccgccagagggtacatctctacccgggtggaaatgggcgaggctgcgggaatttttatgacagccaccccgcctggcagccgcgatcccttcccccaatccaacgctcctatcatggacgaggaaagagagattcccgaacggagctggaactctgggcacgagtgggtcacagattttaagggaaagaccgtgtggttcgttccttccatcaaagccggcaacgacatcgccgcttgcctgagaaagaatgggaaaaaggtgattcagctgagccgcaaaacgtttgattctgaatatgtcaagacacgggccaacgactgggatttcgtggtgaccaccgacatcagcgagatgggagcgaattttagagctgagcgcgtcattgatccgcggagatgtatgaagcccgttatcctcacagacggcgaggaacgcgtgattctggccgggcctatgcccgtgacccactcctctgccgctcagcggagaggccgcatcggaagaaaccctaaaaatgaaaacgaccaatacatctacatgggcgagccccttgaaaatgatgaggactgcgcccattggaaggaggcgaaaatgctgctcgataacattaatacaccggaagggatcattcctagcatgttcgagcccgaacgggagaaggtcgacgccatcgatggagaatatcgcctgagaggcgaggctcggaaaacctttgtggacctgatgcgcagaggggatctccctgtttggcttgcctaccgggtggctgccgagggaattaactatgctgacagacgctggtgtttcgatggcatcaagaataaccagattctggaagagaacgtcgaagtggagatctggacgaaagagggggaacggaagaagctgaaacccagatggctcgacgcccgcatctactccgatcctctggcgcttaaggagttcaaagaatttgccgctggccggaagtctctgacactcaatctgattaccgagatgggaagactgcccacattcatgacccagaaagcccgggacgctctcgataaccttgccgttctgcacacggccgaagtgggcgggcgcgcttataatcatgcgctgagcgagctcccggagaccctggaaacacttctgctcctgaccctgctcgccacagtcaccggaggcatctttcttttcctgatgtccgggaagggaattggcaagatgacactgggcatgtgctgcatcattaccgctagcatcctcctgtggtacgcccagatccaacctcactggattgccgcttctatcattcttgagtttttcctgatcgtgctcctgattcccgaacccgagaaacagagaacgcctcaggacaaccagctgacatatgtcgtgatcgccatcctcaccgttgtggcggccaccatggctaatgaaatggggtttcttgagaagaccaagaaggacctgggactgggctccattatcacccaagagagcgaatccaacattctcgatatcgacctgcggccggcctctgcttggacactttacgccgtggcgacgaccttcgtcacacccatgctgcgccacagcattgaaaatagctctgttaacgtgagcctcaccgccatcgctaatcaggccacagtgctgatggggctgggaagaggctggcctctctccaaaatggatattggggtcccccttctggctatcggatgttacagccaggtgaaccctatcaccctgacggccgctctcctgcttctggttgcccattatgcgattatcggccccggcctccaggccaaggctacccgggaagcccaaaagcgcgctgccgccgggattatgaaaaatcctacagtggacggaatcaccgtcattgatctggagccgatcccctacgaccctaagtttgaaaaacagctgggccaggtgatgctccttgtcctgtgcgtgacacaggttctgatgatgagaaccacgtgggcgctctgtgaggctctgacacttgccaccgggcccatctctacactgtgggagggaaaccctggccggttctggaataccaccattgctgtgtccatggccaacatctttcgcgggagctatctcgccggagctggcctgctgttctctattatgaagaatacaacgaacaccagacggggcacagggaatatcggagaaaccctcggcgagaaatggaagtccagacttaacgccctgggaaagagcgaatttcaaatttacaaaaagtctggaatccaggaggtcgatcgcacactggcgaaagagggcatcaagagaggggaaaccgaccaccatgccgtgagcagaggatccgctaaactccgctggttcgttgagcggaacatggtgacgcccgaaggcaaggtcgtggatctgggctgcgggagaggaggctggtcttattactgtgggggacttaaaaatgtgcgcgaggttaagggcctgacaaaagggggaccgggccacgaggagcctattcccatgagcacctatggctggaacctcgtccggctgcagtccggggtggacgtgttctttacaccccctgagaaatgcgatacactgctctgtgacatcggagaaagctcccccaatcctaccattgaggccggcagaacacttcgcgtcctgaacctggttgaaaattggctcaacaataacacgcaattctgcatcaaggtgctgaatccgtacatgccctctgtgattgagaaaatggaaacccttcagcggaagtacgggggagctctggtcagaaaccctctcagccgcaattccacacatgagatgtattgggtgtctaacgccaccggcaatatcgttagctccgtgaacatgatctctcggatgctgattaatagatttacaatgaaacacaagaaggcgacctacgagcccgatgtcgacctggggagcggaacgcgcaacatcggcattgaaaacgagatccctaatctcgacattatcggcaaaagaattgaaaagatcaaacaggagcacgaaacctcctggcattatgatcaggaccacccctacaagacatgggcctatcatgggagctacgagaccaaacaaacaggatctgcttccagcatggtgaacggcgttgtgaaacttctgaccaagccgtgggatgtcgtgcctatggtgacacagatggccatgaccgacacgacacccttcgggcagcagcgggtctttaaagagaaggttgatacccgcacccaagaacctaaagagggaacaaagaaactgatgagaatcacggctgaatggctctggaaggagctgggcaagaaaaagacaccccggatgtgtacaagagaggagttcacccggaaagtgcgctctaatgccgctcttggggccatttttacagacgagaacaagtggaaatccgcgagagaagccgtggaggatagccggttctgggaactggtcgaccgcgagagaaatctccacctggagggaaagtgcgaaacctgtgtgtataacatgatgggcaaacgggagaagaagctgggcgaatttgggaaagctaagggatctcgcgccatctggtacatgtggctcggcgctagattcctggagtttgaagcccttgggttcctgaatgaggatcactggttttcccggggaaacagcctctccggcgttgagggggaaggcctgcataaacttggatacattctgcgcgacgtgagcaagaaagagggcggggccatgtatgcggatgacacagctggatgggacaccagaatcacgctcgaagatctgaagaatgaggaaatggtcaccaaccacatgaagggcgagcataaaaagctggccgaggccattttcaaactcacataccagaataaggtggttcgggtgcagcgccctacccccagagggacagtcatggacatcatctctcggaaagatcagcgcggaagcggccaagtggggacctatggcctgaacacgttcacaaatatggaagctcagcttattagacagatggagggagaaggcatctttaagtccattcaacacctgaccgttacagaggagatcgccgtgcagaactggctcgctcgggtcgggagagaacgcctgtctcggatggccattagcggagacgattgcgtggtcaagccgcttgacgatagattcgcgtccgccctgaccgctctcaatgacatgggcaaagtgcgcaaggatatccagcagtgggagccttctcgggggtggaacgactggacgcaagttcccttttgcagccatcacttccacgaactggtgatgaaagatggaagagtcctggtggtgccctgtcgctcccaggacgagctcatcggccgggccagaatttctcagggggctggctggagcctgaaggaaaccgcctgccttggaaaatcctacgcgcagatgtggacactgatgtattttcatcgccgggatctcagactggccgctaacgccatctgtagcgctgttccttctcactgggtgccgacctcccgcacaacctggagcattcatgccaagcacgagtggatgacaaccgaggacatgcttgctgtctggaatcgggtgtggatccaagaaaacccctggatggaggacaagacgctggttgaatcttgggaggaagtgccttacctcggcaaaagagaggatcagtggtgcgggtccctgattggactgacaagccgggccacctgggcgaagaatatccagaccgccattaaccaggtcagatccctcatcggcaatgaggaatatacagactacatgccctctatgaaacgcttccggaaggaggaagaggaagctggggtgctgtggtga

SEQ ID NO: 19894 - RNA, 9876 nt, synthetic construct
  misc_feature 1..9876: note = derived and/or modified CDS sequence (opt5) from DENV-2__EU482551__SS-prME
  source 1..9876: mol_type = other RNA
accgctggcgtgatcattatgctgatccccaccgctatggccttccacctcacgaccagaaatggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaaccatggccgctatcctcgcctacaccattggaacaacgcactttcagagagtgctgatcttcattcttctgaccgctgtcgcccctagcatgacaatgcggtgcatcggcatttccaaccgcgattttgtggaaggggtttctggaggcagctgggtggacatcgtcctcgagcacgggtcctgtgtgaccacaatggcgaagaataagcccaccctggatttcgaacttatcaaaacggaggccaagcagcctgctacactgagaaaatattgcattgaagccaagctcaccaacaccacaaccgagagccggtgtccgacacaaggagagccctctctgaatgaagaacaggacaaacgctttatctgcaagcattccatggtggatagaggctggggcaacgggtgtggactgttcggcaaagggggaattgtcacgtgcgctatgtttacctgcaaaaagaatatggaaggcaaagttgtgctccctgagaacctggaatacacaatcgtgattacaccccacagcggggaggagcatgccgtcggaaatgacacaggcaagcacggcaaagaaatcaagatcacccctcagtcttccattacggaggcggaacttaccgggtatggaacagtgaccatggagtgtagcccccggacaggcctggatttcaacgaaatggttctcctgcagatggaggacaaagcctggcttgtgcaccgccaatggtttctggatctcccgctgccttggctgcccggggctgacacccagggatctaattggatccagaaggagacgctcgtcacattcaagaaccctcatgccaaaaagcaggacgtggttgtgctgggctcccaagaaggggctatgcacaccgcccttacaggcgccaccgagattcagatgagctccggaaatctgctctttaccggccatctgaaatgcagacttcggatggataagctgcagctcaaagggatgtcttacagcatgtgtacaggaaagttcaagatcgtcaaagaaattgctgagacgcaacacggcaccatcgtgatcagagtccagtatgagggggacggatccccctgcaagattcccttcgaaatcatggatctggagaaacgccatgtgctgggccggctcattacagttaaccctatcgtgaccgaaaaggacagcccggtcaacattgaggcggaacccccttttggggattcttacatcattatcggcgtggagcccggacagctgaaacttaattggttcaagaagggctccagcatcgggcagatgtttgagacaaccatgagaggagccaaacgcatggctattctgggcgacacggcctgggatttcgggtctctcggaggcgtttttacaagcatcgggaaggccctgcaccaagtgttcggcgctatttacggagccgcgttttccggcgtctcttggaccatgaaaatcctgattggggtgatcatcacctggattggaatgaacagccggtccacaagcctttctgtgtccctcgttctggtcggcatcgtgaccctgtatctcggggtgatggtccaggctgacacaggatgtgtggttagctggaagaataaagaactgaagtgcggctctgggattttcatcacggataacgtgcacacctggacagagcagtacaagtttcagcctgaatcccccagcaaacttgcctccgccattcaaaaggctcatgaggaaggcatctgtggaatcagatctgtcacccgcctggagaatctcatgtggaaacagattacaccggagctgaaccacatcctgagcgaaaatgaggtgaaacttaccattatgacgggcgacatcaaagggattatgcaggccggaaagcggtccctcagacctcagcccaccgaactgaaatattcttggaagacatggggcaaggctaaaatgctgagcaccgagtcccataaccaaacattcctcatcgatgggcctgaaaccgccgagtgccccaatacaaaccgcgcgtggaatagcctggaggttgaagactacggatttggcgtgttctctaccaacatctggcttaagctgcgggagaaacaggacgtcttttgtgattccaagctcatgagcgccgctattaaagacaatagagccgtgcacgctgatatgggctattggatcgaatctgccctgaacgacacgtggaagatggagaaggcgtccttcattgagatcaaaagctgccactggcctaagtctcatacactgtggagcaatggggttcttgaatccgagatgattatccccaaaaacttcgccggaccggtgagccagcacaactaccgccctggctatcatacccagaccgctgggccctggcacctcggaaagctggaaatggattttgacttctgtgagggcacaaccgtcgtggtgacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgtcaattccctggttaccgctggccatgggcaaatcgataacttttctctgggagtgcttggcatggccctcttcctggaagagatgctgagaacgcgcgtggggaccaaacacgccattctcctggtcgctgtgagctttgttacacttatcaccggaaatatgtccttccgggacctgggcagagtgatggtcatggtgggcgcgacaatgaccgatgacattgggatgggagttacgtatctcgccctgctggctgcctttaaggtgcgccctacattcgccgctggccttctgctcagaaaactgacctctaaggagctcatgatggccacaatcgggattgcgctgcttagccagtccaccatccccgaaaccatcctggagctcacagatgctctggccctgggaatgatggtccttaaaattgtgcggaacatggaaaagtaccagctggccgttacgatcatggctatttcttgcgtgcctaatgccgtcatcctccaaaacgcgtggaaggtgagctgtaccattctggctgccgtgtccgtcagccccctcctgcttacatcttcccagcagaaagccgactggatccctctggctctcaccatcaagggcctgaatcccacagccatttttctgaccacgcttagccgcacatctaaaaagagatcctggccgctgaacgaggctgttatggccgtggggatggtgagcatcctcgcgtcttccctgctcaaaaatgacattcctatgaccggacccctggtcgccggcggccttctgaccgtgtgctatgttctgacagggcggagcgctgatctcgaactggagaaggccgctgacgtgaaatgggaggatcaggccgaaatctccggaagctctcctattcttagcatcaccatttccgaggacggctctatgagcatcaagaacgaagaggaggaacacacactgacgatcctcattcgcaccgggctgctcgtcatctccggagtgttccccgtttctattccgatcacagccgctgcgtggtacctgtgggaggtgaagaaacaaagagccggcgtcctttgggatgtgccttctccccctcccgtcgggaaggctgaactggaggacggagcctatcggattaaacagcgcggcatctttggctactcccagatcggggccggagtgtataaggaaggcaccttccatacaatgtggcacgttaccagaggggctgtgctgatgcatcggggaaaacgcattgagccctcctgggccgatgtcaagaaggacctcatcagctacggcgggggatggaaactggagggcgaatggaaggagggcgaagaggtgcaggttcttgcgctggaacctgggaaaaatccgagagctgtgcaaacgaagcccggactctttaaaaccaacacaggcaccattggggccgtctccctggatttcagccctggaacatctggctcccccatcgtggaccggaaggggaaggtggttggactctacggcaatggcgtcgtgaccagaagcggggcctatgtgtctgctattgcccagacagagaaatccatcgaggataaccctgaaatcgaggacgatattttccgcaagaaacggctgacgatcatggaccttcaccccggagcgggcaagaccaaaagatacctgcctgctattgtccgcgaagccatcaagcgggggctgagaacactcattctggccccgacccgcgtggttgctgccgagatggaagaggcccttcggggactgcccatcagatatcagacccctgccattcgcgcggagcatacaggccgggaaatcgtggacctcatgtgtcacgccacgtttaccatgagactgctcagccccgtccgggtgcctaactacaatctgatcattatggatgaggctcacttcacagaccccgcctccatcgctgcccgcgggtatatttctaccagagttgaaatgggcgaggccgctggaatctttatgacagcgaccccgcctggcagccgggatcccttcccccagtccaacgcccctattatggacgaggaacgcgagatccccgaaagaagctggaactctgggcatgagtgggtgacggattttaagggaaaaacagtctggttcgtgccttccatcaaggctggcaacgacattgccgcctgccttcggaaaaatgggaagaaagttatccaactgagcagaaagacctttgattctgaatacgtgaagacccgcgctaacgactgggatttcgtcgtgacaaccgacattagcgagatgggagccaattttcgggcggagagagtgatcgatccgcgccggtgtatgaaacccgtcattctgacagacggcgaagagagagttatcctcgctgggcctatgcccgtgacccactcctctgccgcccagcgccggggcagaatcggacgcaaccctaagaatgaaaacgaccagtatatttacatgggcgagcccctggaaaatgatgaggactgcgctcattggaaagaggccaagatgcttctggataacatcaatacgccggaagggattatccctagcatgttcgagcccgaaagagagaaagtggacgcgattgatggagaataccggctccgcggcgaggccagaaagacatttgtcgacctgatgcggcgcggggatctgcctgtgtggctcgcttatagagttgccgctgagggaatcaactacgccgaccggagatggtgtttcgatggcattaaaaataaccaaatccttgaagagaacgtggaagtcgagatctggaccaaggagggggaacgcaagaaactgaagccccggtggctggacgctagaatttattccgatcctctcgccctgaaagagttcaaggaatttgcggccggccgcaaatctcttacactgaatctcatcaccgagatgggacggctgcccacgttcatgacccagaaggctagagacgccctggataacctcgctgtgcttcacacagccgaagttggcgggcgggcctacaatcacgctctgagcgagctgccggagaccctcgaaacactgcttctgctcaccctgctggcgacagtgaccggaggcatttttctcttccttatgtccgggaagggaatcggcaaaatgacgctgggcatgtgctgcattatcacagccagcatcctgctctggtatgctcagattcagcctcattggatcgccgcctctattatcctggagtttttccttattgtcctgctcatccccgaacccgagaagcaacgcacccctcaggacaaccagctgacctacgtggtcatcgctattctgacagtggttgccgcgaccatggccaatgaaatggggtttctcgagaaaacaaagaaagaccttggactgggctccatcacgacccaggagagcgaatccaacattctggatatcgacctcagaccggcttctgcctggacactgtatgctgtggccaccacattcgtgacccccatgcttcggcacagcattgaaaatagctctgtcaacgttagcctgacggcgatcgccaatcaagctaccgtgctcatggggctgggacgcggctggcctctgtccaagatggatattggggtgcccctccttgccatcggatgttacagccaggtcaaccctatcacactgaccgctgccctgctcctgcttgtggctcattacgccattatcggccccggcctgcaggcgaaggccacaagagaagctcagaaacggaccgccgctgggattatgaagaatcctacggttgacggaatcacagtgattgatctcgagccgatcccctatgaccctaaatttgaaaagcaactgggccaggtcatgctgctcgtgctttgcgtcacccaggtgctgatgatgcgcacaacctgggccctgtgtgaggccctcaccctggcgacagggcccatctctacgctttgggagggaaaccctggcagattctggaataccacaattgctgtttccatggccaacatctttcgggggagctacctggctggagccggcctcctgttctctattatgaaaaataccacaaacacccgcagaggcacggggaatatcggagaaacactgggcgagaagtggaagtcccggctcaacgcccttgggaaaagcgaatttcagatttataagaaatctggaatccaagaggtggatagaaccctggctaaggagggcatcaaacgcggggaaaccgaccaccatgccgtcagccggggatccgcgaagctgagatggttcgtggagcgcaacatggttacacccgaaggcaaagtggtcgatctcggctgcgggcggggaggctggtcttactattgtgggggactgaagaatgtgagagaggtgaagggccttaccaaagggggaccgggccacgaggaacctattcccatgagcacatacggctggaacctggttcgcctccagtccggggtcgacgtgttctttacgccccctgagaagtgcgataccctgctgtgtgacatcggagaaagctcccccaatcctacaattgaggccggccggaccctcagagtgcttaacctggtcgaaaattggctgaacaataacacacagttctgcgttaaagtgctcaatccgtatatgccctctgtgatcgagaagatggaaaccctgcaacgcaaatacgggggagctcttgtccggaaccctctgagcagaaattccacgcacgagatgtactgggtgtctaacgccaccggcaatattgttagctccgtgaacatgatctctcgcatgctcatcaatcggtttacaatgaagcataagaaagctacctatgagcccgatgtcgacctggggagcggaacaagaaacattggcatcgaaaacgagattcctaatctggacatcattggcaagcgcatcgagaagattaagcaggagcacgaaacctcctggcattacgatcaggaccacccctataaaacatgggcctaccacgggagctatgagaccaagcagacgggatctgcgtccagcatggtgaacggcgttgtgaagctccttacaaaaccgtgggatgtcgtgcctatggtgacccaaatggccatgaccgacacaacgcccttcgggcagcagagagtctttaaggagaaagttgatacccggacacaggaacctaaggagggaaccaaaaagctgatgcgcatcacagctgaatggctgtggaaggagctcggcaaaaagaaaacccccagaatgtgtacacgggaggagttcaccagaaaggtgcggtctaatgccgctctgggggccatctttacggacgagaacaaatggaagtccgctcgcgaagccgtggaggatagcagattctgggaacttgtcgaccgggagcgcaatctgcatctcgagggaaaatgcgaaacctgtgtgtacaacatgatgggcaagagagagaagaaactgggcgaatttgggaaggcgaaaggatctcgggccatttggtatatgtggctgggcgctcgcttcctcgagtttgaagccctggggttccttaatgaggatcactggttttccagaggaaacagcctgtccggcgttgagggggaaggcctccataagctgggatacatccttcgggacgtgagcaaaaaggagggcggggctatgtacgccgatgacacagccggatgggacacccgcattacactggaagatctcaagaatgaggaaatggtcaccaaccacatgaaaggcgagcataagaaactggcggaggctatcttcaagctgacgtatcaaaataaagtggttagagtgcagcggcctacaccccgcgggaccgtcatggacattatctctagaaaggatcagcggggaagcggccaggtggggacatacggcctcaacaccttcacgaatatggaagcccaactgatccgccagatggagggagaaggcatttttaagtccatccagagacttaccgttacagaggagattgccgtgcaaaactggctggctcgggtcgggagagaacgcctctctcggatggccatcagcggagacgattgcgtggtcaaaccgctggacgatagattcgcttccgcccttaccgcgctgaatgacatgggcaaggtgcgcaaagatattcagcagtgggagccttctcgggggtggaacgactggacacaggttcccttttgcagccaccacttccatgaactcgtgatgaaggatggaagaatgctggtcgtgccctgtcgcaaccaagacgagctgatcggccgggccagaatctcccagggggctggctggtctctcaaagaaaccgcctgcctgggaaagagctatgctcagatgtggacacttatgtactttcaccgccgggatctgagactcgccgcgaatgccatttgttccgctgtgcctagccattgggttccgacctctcgcacgacatggtccatccacgccaagcacgagtggatgaccaccgaggacatgctggctgtgtggaaccgggtctggattcaggaaaatccctggatggaggacaaaacacctgtggaaagctgggaggaagttccctatcttggcaagagagaggatcaatggtgcgggtctctgatcggactcacctcccgggccacatgggctaaaaacattcagacggccatcaatcaggtgagaagcctgattggcaacgaggaatacaccgactatatgccttccatgaagcgcttccggaaagaggaagaggaagcgggggtcctgtggtga

SEQ ID NO: 19895 - RNA, 9876 nt, synthetic construct
  misc_feature 1..9876: note = derived and/or modified CDS sequence (opt5) from DENV-2__EU482552__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcacagggaaggctctgcaccaagttttcggcgccatttacggagcggctttttccggcgtgtcttggaccatgaaaatcctgattggggtcatcatcacctggattggaatgaacagccggtccacaagcctttctgtgtccctcgtgctggttggcgtcgtgaccctgtatctcggggtgatggtccaggccgacacaggatgtgtggttagctggaagaataaagaactgaagtgcggctctgggatcttcattacggataacgtgcacacctggacagagcagtacaagtttcagcctgaatcccccagcaaacttgcctccgctatccaaaaggcccatgaggaaggcatttgtggaatcagatctgtcacccgcctggagaatctcatgtggaaacagatcacaccggagctgaaccacattctgagcgaaaatgaggtgaaacttaccatcatgacgggcgacattaaagggatcatgcaggctggaaagcggtccctcagacctcagcccaccgaactgaaatattcttggaagacatggggcaaggccaaaatgctgagcaccgagtcccataaccaaacattcctcattgatgggcctgaaaccgcggagtgccccaatacaaaccgcgcctggaatagcctggaggttgaagactacggatttggcgtgttctctaccaacatctggcttaagctgcgggagaaacaggacgtcttttgtgattccaagctcatgagcgctgccatcaaagacaatagagctgtgcacgccgatatgggctattggattgaatctgcgctgaacgacacgtggaagatggagaaggcctccttcatcgagattaaaagctgccactggcctaagtctcatacactgtggagcaatggggttcttgaatccgagatgatcattcccaaaaacttcgctggaccggtgagccagcacaactaccgccctggctatcatacccagaccgccgggccctggcacctcggaaagctggaaatggattttgacttctgtgagggcacaaccgtcgtggtgacggaagattgcgggaatcggggaccctctctgagaacaaccacagcttccggcaaactcatcaccgagtggtgctgtcggagctgcacactgcctccgcttcgctacagaggcgaggacgggtgttggtacggaatggaaattcggcccctgaaggagaaggaagagaacctcgtcaattccctggttaccgccggctatgggcaaatcgataacttttctctgggagtgcttggcatggccctcttcctggaagagatgctgagaacgcgcgtggggaccaaacatgctatcctcctggtcgcggtgagctttgttacacttattaccggaaatatgtccttccgggacctgggcagagtgatggtcatggtgggcgccacaatgaccgatgacatcgggatgggagttacgtacctcgctctgctggccgcctttaaggtgcgccctacattcgctgccggccttctgctcagaaaactgacctctaaggagctcatgatggcgacaattgggatcgctctgcttagccagtccaccattcccgaaaccatcctggagctcacagatgccctggccctgggaatgatggtccttaaaatcgtgcggaacatggaaaagtatcagctggctgttacgattatggccatctcttgcgtgcctaatgcggtcattctccaaaacgcttggaaggtgagctgtaccatcctggccgccgtgtccgtcagccccctcctgcttacatcttcccagcagaaagctgactggattcctctggccctcaccatcaagggcctgaatcccacagctatctttctgaccacgcttagccgcacatctaaaaagagatcctggccgctgaacgaggccattatggcggttgggatggtgagcatcctcgcctcttccctgctcaaaaatgacattcctatgaccggacccctggtggctggcggccttctgaccgtctgctacgtgctgacagggcggagcgccgatctcgaactggagcgcgctgccgacgttaagtgggaggatcaggccgaaatctccggaagctctcctattcttagcatcaccatttccgaggacggctctatgagcatcaaaaacgaagaggaggaacacacactgacgatcctcattagaaccgggctgctcgtgatctccggagtcttccccgtgtctattccgatcacagctgcggcctggtatctgtgggaggttaagaagcaacgggctggcgtgctttgggatgtcccttctccccctcccgtggggaaagccgaactggaggacggagcctaccgcattaagcagagaggcatctttggctattcccagatcggggctggagtctacaaagaaggcaccttccacacaatgtggcatgtgaccagaggggccgttctgatgcaccgcggaaagagaattgagccctcctgggcggatgtgaaaaaggacctcatcagctacggcgggggatggaagctggagggcgaatggaaagagggcgaagaggtccaggtgcttgctctggaacctgggaagaatccgcgggccgttcaaacgaaacccggactctttaagaccaacacaggcaccattggggccgtgtccctggatttcagccctggaacatctggctcccccatcgtcgacagaaaagggaaggtggtgggactctatggcaatggcgttgtcacccgcagcggggcttacgtgtctgccattgcgcagacagagaagtccatcgaggataaccctgaaatcgaggacgatattttccggaaaaagagactgacgatcatggaccttcatcccggagctggcaaaaccaagcgctatctgcctgccattgtgcgggaagccatcaaaagagggctgcgcacactcattctggctccgacccgggtcgtggccgctgagatggaagaggcccttagaggactgcccatccgctaccagacccctgcgattcgggccgagcacacaggcagagaaatcgttgacctcatgtgtcatgctacgtttaccatgcggctgctcagccccgtgcgcgtccctaactataatctgatcattatggatgaggcccacttcacagaccccgcttccatcgccgccagagggtacatttctacccgggtggaaatgggcgaggctgcgggaatctttatgacagccaccccgcctggcagccgcgatcccttcccccagtccaacgctcctattatggacgaggaaagagagatccccgaacggagctggaactctgggcacgagtgggttacggattttaagggaaagacagtgtggttcgtcccttccatcaaagccggcaacgacattgccgcttgccttagaaagaatgggaaaaaggtgatccaactgagccgcaaaacctttgattctgaatatgttaagacccgggccaacgactgggatttcgtggtcacaaccgacattagcgagatgggagcgaattttagagctgagcgcgtgatcgatccgcggagatgtatgaagcccgtgattctgacagacggcgaggaacgcgtcatcctcgccgggcctatgcccgttacccattcctctgccgctcagcggagaggccgcatcggaagaaaccctaaaaatgaaaacgaccagtacatttacatgggcgagcccctggaaaatgatgaggactgcgcccactggaaggaggcgaaaatgcttctggataacatcaatacgccggaagggattatccctagcatgttcgagcccgaacgggagaaggtggacgccattgatggagaatatcgcctcagaggcgaggctcggaaaacatttgtggacctgatgcgcagaggggatctgcctgtctggctcgcctaccgggtggctgccgagggaatcaactatgctgacagacgctggtgtttcgatggcattaagaataaccaaatccttgaagagaacgttgaagtggagatctggaccaaagagggggaacggaagaagctgaaacccagatggctggacgcccgcatttactccgatcctctcgcgctgaaggagttcaaagaatttgccgctggccggaagtctcttacactgaatctcatcaccgagatgggaagactgcccacgttcatgacccagaaagcccgggacgctctggataacctcgccgtccttcatacagccgaagtgggcgggcgcgcttataatcacgcgctgagcgagctgccggagaccctcgaaacactgcttctgctcaccctgctggccacagttaccggaggcatttttctcttccttatgtccgggaagggaatcggcaagatgacgctgggcatgtgctgcattatcacagctagcatcctgctctggtacgcccagattcagcctcactggatcgccgcttctattatcctggagtttttccttattgtgctgctcatccccgaacccgagaaacaaagaacccctcaggacaaccagctgacctatgtcgtgatcgccattctgacagtcgtggcggccaccatggctaatgaaatggggtttctcgagaagaccaagaaggaccttggactgggctccatcacgacccaggagagcgaatccaacattctggatatcgacctccggccggcctctgcttggacactgtacgccgttgcgaccacattcgtgacccccatgcttcgccatagcattgaaaatagctctgtgaacgtcagcctgacggccatcgctaatcaagccaccgttctcatggggctgggaagaggctggcctctgtccaaaatggatattggggtgcccctccttgctatcggatgttacagccaggtgaaccctatcacactgaccgccgctctgctcctgcttgtcgcccactatgcgattatcggccccggcctgcaggccaaggctacacgggaagcccagaagcgcaccgctgccgggattatgaaaaatcctacggtggacggaatcacagttattgatctcgagccgatcccctacgaccctaagtttgaaaaacaactgggccaggtgatgctgctcgtcctttgcgtgacccaggtcctgatgatgagaacaacctgggccctgtgtgaggcgctcaccctggctacagggcccatctctacgctttgggagggaaaccctggccggttctggaataccacaattgccgtgtccatggctaacatctttcgcgggagctatctggccggagccggcctcctgttctctattatgaagaataccacaaacaccagacggggcacggggaatatcggagaaacactgggcgagaaatggaagtccagactcaacgctcttggaaagagcgaatttcagatttacaaaaagtctggaatccaagaggttgatcgcaccctggccaaagagggcatcaagagaggggaaaccgaccatcacgcggtgagcagaggatccgccaaactgcgctggttcgtcgagcggaacatggtgacacccgaaggcaaggttgtggatctcggctgcgggagaggaggctggtcttattactgtgggggactgaaaaatgtccgcgaggtgaagggccttaccaaagggggaccgggccatgaggagcctattcccatgagcacatatggctggaacctggtgcggctccagtccggggttgacgtcttctttacgccccctgagaaatgcgataccctgctgtgtgacatcggagaaagctcccccaatcctacaattgaggctggcagaaccctccgcgtgcttaacctggtggaaaattggctgaacaataacacacagttctgcgtcaaggttctcaatccgtacatgccctctgtgatcgagaaaatggaaaccctgcaacggaagtacgggggagcccttgtgagaaaccctctgagccgcaattccacgcacgagatgtattgggtctctaacgctaccggcaatattgtgagctccgttaacatgatctctcggatgctcatcaatagatttacaatgaaacacaagaaggccacctacgagcccgatgtggacctggggagcggaacacgcaacattggcatcgaaaacgagattcctaatctggacatcattggcaaaagaatcgaaaagattaaacaggagcatgaaacctcctggcactatgatcaggaccatccctacaagacatgggcgtatcacgggagctacgagaccaaacagacgggatctgcctccagcatggtcaacggcgtggttaagctccttacaaagccgtgggatgtggtccctatggtgacccaaatggctatgaccgacacaacgcccttcgggcagcagcgggtgtttaaagagaaggtcgatacccgcacacaggaacctaaagagggaaccaagaaactgatgagaatcacagccgaatggctgtggaaggagctcggcaagaaaaagacaccccggatgtgtacaagagaggagttcacccggaaagttcgctctaatgctgccctgggggctatctttacggacgagaacaagtggaaatccgccagagaagcggtggaggatagccggttctgggaacttgtggaccgcgagagaaatctgcacctcgagggaaagtgcgaaacctgtgtctataacatgatgggcaaacgggagaagaagctgggcgaatttgggaaagccaagggatctcgcgctatttggtacatgtggctgggcgccagattcctcgagtttgaagctctggggttccttaatgaggatcattggttttcccggggaaacagcctgtccggcgtggagggggaaggcctccacaaactgggatacatccttcgcgacgttagcaagaaagagggcggggccatgtatgccgatgacacagcgggatgggacaccagaattacactggaagatctcaagaatgaggaaatggtgaccaaccatatgaagggcgagcacaaaaagctggctgaggccatcttcaaactgacgtaccaaaataaggtcgtgcgggttcagcgccctacacccagagggaccgtgatggacattatctctcggaaagatcagcgcggaagcggccaggtcgggacatatggcctcaacaccttcacgaatatggaagcccaactgatcagacagatggagggagaaggcatttttaagtccatccagcggcttaccgtgacagaggagattgctgttcaaaactggctggccagagtggggcgcgaacggctctctagaatggctatcagcggagacgattgcgtcgtgaagccgctggacgatcgcttcgcctccgcgcttaccgccctgaatgacatgggcaaagtccggaaggatattcagcagtgggagccttctagagggtggaacgactggacacaggtgcccttttgcagccatcacttccacgaactcgttatgaaagatggacgcgtgctggtcgtgccctgtcggaaccaagacgagctgatcggcagagctcgcatctcccagggggccggctggtctctcaaggaaaccgcttgcctgggaaaaagctacgcccagatgtggacacttatgtattttcatcggagagatctgcgcctcgcggccaatgctatttgttccgccgtgcctagccactgggttccgacctctcggacgacatggtccatccatgctaagcacgagtggatgaccaccgaggacatgctggccgtgtggaacagagtctggattcaggaaaatccctggatggaggacaagacacctgtggaaagctgggaggaagttccctaccttggcaaacgggaggatcaatggtgcgggtctctgatcggactcacctccagagctacatgggccaagaacattcagacggcgatcaatcaggtgcgcagcctgattggcaacgaggaatataccgactacatgccttccatgaaacggttcagaaaggaggaagaggaagccggggtcctgtggtga

SEQ ID NO: 19896 - RNA, 9876 nt, synthetic construct
  misc_feature 1..9876: note = derived and/or modified CDS sequence (opt5) from DENV-2__EU482554__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaccgtcgttctccctgagaacctggaatacacaattgtgatcacaccccacagcggggaggagcatgcggtgggaaatgacacaggcaaacacggcaaggaaatcaaaattacccctcagtcttccatcacggaggccgaacttaccgggtatggaacagtcaccatggagtgtagcccccggacaggcctggatttcaacgaaatggtgctcctgcagatggaggacaaggcttggcttgttcaccgccaatggtttctggatctcccgctgccttggctgcccggggccgacacccagggatctaattggattcagaaagagacgctcgtgacattcaagaaccctcatgctaagaaacaggacgtcgtggttctgggctcccaagaaggggccatgcacaccgcccttacaggcgctaccgagatccagatgagctccggaaatctgctctttaccggccatctgaagtgcagacttcggatggataaactgcagctcaaggggatgtcttacagcatgtgtacaggaaaattcaagattgtgaaggaaatcgcggagacgcaacacggcaccatcgtcattagagtgcagtatgagggggacggatccccctgcaaaatccccttcgaaattatggatctggagaagcgctacgtcctgggccggctcatcacagtgaaccctattgttaccgaaaaagacagcccggtgaacatcgaggccgaacccccttttggggattcttacattatcatcggcgtcgagcccggacagctgaaacttaattggttcaaaaagggctccagcattgggcagatgtttgagacaaccatgagaggagctaagcgcatggccatcctgggcgacacggcctgggatttcgggtctctcggaggcgtgtttacaagcattgggaaagctctgcatcaagttttcggcgccatctatggagcggctttttccggcgtgtcttggaccatgaagattctgatcggggtcatcattacctggatcggaatgaacagccggtccacaagcctttctgtgtccctcgtgctggttggcgtcgtgaccctgtacctcggggtgatggtccaggccgacagcggatgtgtggtttcttggaaaaataaggaactgaaatgcggctccgggattttcatcacagataacgtgcacacgtggaccgagcagtataagtttcagcctgaaagcccctccaaacttgcctctgctattcaaaaagcccacgaggaaggcatctgtggaatcagaagcgtcacacgcctggagaatctcatgtggaagcagattaccccggagctgaaccatatcctgtccgaaaatgaggtgaaacttacaattatgaccggcgacatcaaggggattatgcaggctggaaaacggtctctcagacctcagcccacggaactgaagtacagctggaaaacctggggcaaggccaagatgctgtccacagagagccacaaccaaaccttcctcatcgatgggcctgaaacagcggagtgccccaataccaaccgcgcctggaactctctggaggttgaagactatggatttggcgtgttctccacaaacatctggcttaaactgcgggagaagcaggacgtcttttgtgatagcaaactcatgtctgctgccattaaggacaatagagctgtgcatgccgatatgggctactggatcgaatccgcgctgaacgacacctggaaaatggagaaggccagcttcattgaggttaagtcttgccactggcctaaaagccacacgctgtggtccaatggggtgcttgaaagcgagatgatcattcccaagaacttcgctggaccggtctctcagcataactatcgccctggctaccacacacagaccgccgggccctggcatctcggaaaactggaaatggattttgacttctgtgagggcaccacagtggtggtcaccgaagattgcgggaatcggggaccctccctgagaacgacaaccgctagcggcaagctcatcacagagtggtgctgtcggtcctgcaccctgcctccgcttcgctacagaggcgaggacgggtgttggtatggaatggaaattcggcccctgaaagagaaggaagagaacctcgttaattctctggtgacagccggccacgggcaaatcgataactttagcctgggagtgcttggcatggccctcttcctggaagagatgctgagaacccgcgtcgggacgaagcatgctatcctcctggtggcggtttcctttgtgacccttattacaggaaatatgtctttccgggacctgggcagagtcatggtgatggttggcgccaccatgacagatgacatcgggatgggagtgacctacctcgctctgctggccgcctttaaagtccgccctacgttcgctgccggccttctgctcagaaagctgacaagcaaagagctcatgatggcgaccattgggatcgctctgctttcccagtctacaattcccgaaaccatcctggagctcaccgatgccctggccctgggaatgatggtgcttaagatcgttcggaacatggaaaaatatcagctggctgtgacaattatggccatcctctgcgtccctaatgcggtgattctgcaaaacgcttggaaggtgagctgtacgatcctcgccgccgtctccgttagccccctgcttctgacctcttcccagcagaaggctgactggattcctctcgccctgacaatcaaaggcctgaatcccaccgctatctttcttacaaccctgagccgcacgtctaagaaaagatcctggccgctcaacgaggccgtgatggcggtggggatggtcagcattctggcctcttccctcctgaagaatgacatccctatgacaggaccccttgtggctggcggcctgctgaccgtttgctacgtgctcaccgggcggagcgccgatctggaacttgagcgcgctgccgacgtcaaatgggaggatcaggccgaaatttccggaagctctcctatcctgagcattacaatctccgaggacggctctatgagcattaagaacgaagaggaggaacaaaccctcacaatcctgatcagaacggggctcctggtgatttccggagttttccccgtgtctatcccgattaccgctgcggcctggtatctttgggaggtcaaaaagcagcgggctggcgtgctgtgggatgtcccttctccccctcccgtggggaaggccgaactggaggacggagcctaccgcatcaaacagagaggcatttttggctattcccagatcggggctggagtttacaaggaaggcacattccacaccatgtggcacgtgacaagaggggccgtcctcatgcatcgcggaaaaagaatcgagccctcctgggcggatgtgaagaaagacctgattagctacggcgggggatggaaacttgagggcgaatggaaggagggcgaagaggttcaagtgctggctctcgaacctgggaaaaatccgcgggccgtccagaccaagcccggactgtttaaaacgaacaccggcacaatcggggccgtgtccctcgatttcagccctggaacctctggctcccccattgtggacagaaaggggaaagttgtcggactgtatggcaatggcgtggtgacacgcagcggggcttacgtctctgccatcgcgcagaccgagaagtccattgaggataaccctgaaatcgaggacgatatcttccggaagaaaagacttacaattatggacctgcaccccggagctggcaagacgaaacgctatctgcctgccatcgtgcgggaagccattaagagagggctccgcaccctgatccttgctccgacacgggttgtggccgctgagatggaagaggccctgagaggactccccattcgctaccagacccctgcgatccgggccgagcataccggcagagaaattgtcgacctgatgtgtcacgctacatttacgatgcggctcctgagccccgtgcgcgttcctaactataatcttatcatcatggatgaggcccatttcaccgaccccgcttccattgccgccagagggtacatctctacacgggtggaaatgggcgaggctgcgggaatttttatgaccgccacaccgcctggcagccgcgatcccttcccccaatccaacgctcctatcatggacgaggaaagagagattcccgaacggagctggaactctgggcacgagtgggtcaccgattttaaaggaaagacggtgtggttcgttccttccatcaaggccggcaacgacatcgccgcttgcctgcgcaagaatgggaagaaagtgattcagctgagccgcaagacatttgattctgaatatgtcaaaacccgggccaacgactgggatttcgtggtgaccacagacatcagcgagatgggagcgaattttagagctgagcgcgtcattgatccgcggagatgtatgaagcccgttatcctcaccgacggcgaagaaagagtgattctggccgggcctatgcccgtgacacactcctctgccgctcagcggagaggccgcatcggaagaaaccctaagaatgaaaacgaccaatacatctacatgggcgagccccttgaaaatgatgaggactgcgcccattggaaagaggcgaagatgctgctcgataacattaataccccggaagggatcattcctagcatgttcgagcccgaacgggagaaagtcgacgccatcgatggagaatatcgcctgagaggcgaggctcggaagacgtttgtggacctgatgcgcagaggggatctccctgtttggcttgcctaccgggtggctgccgagggaattaactatgctgacagacgctggtgtttcgatggcatcaaaaataaccagattctggaagagaacgtcgaagtggagatctggacaaaggagggggaacggaaaaagctgaagcccagatggctcgacgcccgcatctactccgatcctctggcgcttaaagagttcaaggaatttgccgctggccggaaatctctgaccctcaatctgattacagagatgggaagactgcccaccttcatgacgcagaaggcccgggacgctctcgataaccttgccgttctgcacaccgccgaagtgggcgggcgcgcttataatcatgcgctgagcgagctcccggagacactggaaacccttctgctcctgacactgctcgccaccgtcacaggaggcatctttcttttcctgatgtccgggaaaggaattggcaagatgaccctgggcatgtgctgcatcattacggctagcatcctcctgtggtacgcccagatccaacctcactggattgccgcttctatcattcttgagtttttcctgatcgtgctcctgattcccgaacccgagaagcagagaacacctcaggacaaccagctgacctatgtcgtgatcgccatcctcaccgttgtggcggccacaatggctaatgaaatggggtttcttgagaaaaccaagaaagacctgggactgggctccattatcacacaagagagcgaatccaacattctcgatatcgacctgcggccggcctctgcttggacgctttacgccgtggcgaccacattcgtcacccccatgctgcgccacagcattgaaaatagctctgttaacgtgagcctcacagccatcgctaatcaggccaccgtgctgatggggctgggaagaggctggcctctctccaagatggatattggggtcccccttctggctatcggatgttacagccaggtgaaccctatcacgctgaccgccgctctcctgcttctggttgcccattatgcgattatcggccccggcctccaggccaaagctacacgggaagcccaaaagcgcgctgccgccgggattatgaagaatcctaccgtggacggaatcacagtcattgatctggagccgatcccctacgaccctaaatttgaaaagcagctgggccaggtgatgctccttgtcctgtgcgtgacccaggttctgatgatgagaacgacatgggcgctctgtgaggctctgacccttgccacagggcccatctctaccctgtgggagggaaaccctggccggttctggaataccacaattgctgtgtccatggccaacatctttcgcgggagctatctcgccggagctggcctgctgttctctattatgaaaaatacgaccaacacaagacggggcaccgggaatatcggagaaacactcggcgagaagtggaaatccagacttaacgccctgggaaagagcgaatttcaaatttacaagaaatctggaatccaggaggtcgatcgcaccctggcgaaggagggcatcaaaagaggggaaacggaccaccatgccgtgagcagaggatccgctaagctccgctggttcgttgagcggaacatggtgacacccgaaggcaaagtcgtggatctgggctgcgggagaggaggctggtcttattactgtgggggacttaagaatgtgcgcgaggttaaaggcctgaccaaagggggaccgggccacgaggagcctattcccatgagcacctatggctggaacctcgtccggctgcagtccggggtggacgtgttctttacaccccctgagaagtgcgataccctgctctgtgacatcggagaaagctcccccaatcctacaattgaggccggcagaacgcttcgcgtcctgaacctggttgaaaattggctcaacaataacacccaattctgcatcaaagtgctgaatccgtacatgccctctgtgattgagaagatggaaacacttcagcggaaatacgggggagctctggtcagaaaccctctcagccgcaattccacccatgagatgtattgggtgtctaacgccacaggcaatatcgttagctccgtgaacatgatctctcggatgctgattaatagatttaccatgaagcacaaaaaggcgacgtacgagcccgatgtcgacctggggagcggaacccgcaacatcggcattgaaaacgagatccctaatctcgacattatcggcaagagaattgagaagatcaagcaggagcacgaaacatcctggcattatgatcaggaccacccctacaaaacctgggcctatcatgggagctacgagacaaagcaaaccggatctgcttccagcatggtgaacggcgttgtgcggcttctgacaaaaccgtgggatgtcgtgcctatggtgacccagatggccatgacggacacaacccccttcgggcagcagcgcgtctttaaggagaaggttgataccagaacacaagaacctaaagagggaacgaagaaactgatgcggatcaccgctgaatggctctggaaggagctgggcaaaaagaagacacccagaatgtgtacccgggaggagttcacacgcaaagtgagatctaatgccgctcttggggccatttttaccgacgagaacaagtggaaatccgcgcgggaagccgtggaggatagccgcttctgggaactggtcgacagagagcggaatctccacctggagggaaagtgcgaaacatgtgtgtataacatgatgggcaaacgcgagaagaaactgggcgaatttgggaaggctaagggatctagagccatctggtacatgtggctcggcgctcggttcctggagtttgaagcccttgggttcctgaatgaggatcactggttttcccgcggaaacagcctctccggcgttgagggggaaggcctgcataaacttggatacattctgagagacgtgagcaagaaagagggcggggccatgtatgcggatgacaccgctggatgggacacgcggatcaccctcgaagatctgaagaatgaggaaatggtcacaaaccacatgaaaggcgagcataagaagctggccgaggccattttcaaactcacctaccagaataaggtggttcgcgtgcagagacctacaccccgggggaccgtcatggacatcatctctcgcaaagatcagagaggaagcggccaagtggggacgtatggcctgaacacattcaccaatatggaagctcagcttattcggcagatggagggagaaggcatctttaagtccattcaacacctgacagttaccgaggagatcgccgtgcagaactggctcgctagagtcgggcgcgaacggctgtctagaatggccattagcggagacgattgcgtggtcaaaccgcttgacgatcgcttcgcgtccgccctgacggctctcaatgacatgggcaaggtgcggaaggatatccagcagtgggagccttctagagggtggaacgactggacccaagttcccttttgcagccatcacttccacgaactggtgatgaaagatggacgcgtcctggtggtgccctgtcggtcccaggacgagctcatcggcagagcccgcatttctcagggggctggctggagcctgaaggaaacagcctgccttggaaaatcctacgcgcagatgtggaccctgatgtattttcatcggagagatctccgcctggccgctaacgccatctgtagcgctgttccttctcactgggtgccgacatcccggaccacatggagcattcatgccaagcacgagtggatgaccacggaggacatgcttgctgtctggaatagagtgtggatccaagaaaacccctggatggaggacaaaacactggttgaatcttgggaggaagtgccttacctcggcaagcgggaggatcagtggtgcgggtccctgattggactgaccagcagagccacctgggcgaagaatatccagacagccattaaccaggtccgctccctcatcggcaatgaggaatataccgactacatgccctctatgaaacggttcagaaaggaggaagaggaagctggggtgctgtggtga

SEQ ID NO: 19897 - RNA, 9876 nt, synthetic construct
  misc_feature 1..9876: note = derived and/or modified CDS sequence (opt5) from DENV-2__EU482556__SS-prME
  source 1..9876: mol_type = other RNA
accgccggagtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggtgtctcacgaaatggttctcctgcagatggaggataaggcttggcttgtgcatcgccaatggttcctggacctcccgctgccttggctgcccggggccgatacacagggatccaactggattcagaaggagaccctcgtcacgtttaagaatcctcacgctaaaaagcaggacgtggttgtgctgggcagccaagaaggggccatgcatacagcccttaccggcgctacagagatccagatgtcctctggaaacctcctgttcaccggccacctgaaatgcagacttcggatggacaagctgcagctcaaagggatgagctactccatgtgtaccggaaagtttaagattgtcaaagaaatcgcggagacacaacatggcacgatcgtgattagagtccagtatgagggggatggaagcccctgcaagatccccttcgaaattatggacctggagaaacgccacgtgctgggccggctcatcaccgttaatcctattgtgacagaaaaggattctccggtcaacatcgaggccgaaccccctttcggggactcctacattatcatcggcgtggagcccggacagctgaaacttaactggtttaagaagggcagctctattgggcagatgttcgagaccacaatgagaggagctaaacgcatggccgttctgggcgataccgcctgggactttgggagcctcggaggcgtgttcacgtccatcgggaaggctctgcaccaagtctttggcgccatttacggagcggctttctctggcgtgagctggacaatgaaaatcctgattggggtgatcatcacctggattggaatgaactcccggagcacctctctttccgttagcctcgtcctggtgggcgtggtcacactgtatctcggggtgatggttcaggccgataccggatgtgtggtctcttggaagaacaaagaactgaagtgcggctccgggatctttattacagacaatgtgcatacgtggaccgagcagtacaagttccagcctgaaagcccctccaaacttgcctctgctatccaaaaggcccacgaggaaggcatttgtggaatcagaagcgttacacgcctggagaacctcatgtggaaacagatcaccccggagctgaatcatattctgtccgaaaacgaggtgaaacttacaatcatgaccggcgatattaaagggatcatgcaggctggaaagcggtctctcagacctcagcccacggaactgaaatatagctggaagacctggggcaaggccaaaatgctgtccacagagagccacaatcaaacctttctcattgacgggcctgaaacagcggagtgccccaacaccaatcgcgcctggaactctctggaggtcgaagattacggattcggcgtgttttccacaaatatctggcttaagctgcgggagaaacaggacgttttctgtgacagcaagctcatgtctgctgccatcaaagataacagagctgtgcacgccgacatgggctattggattgaatccgcgctgaatgatacctggaagatggagaaggccagctttatcgagattaaatcttgccattggcctaagagccacacgctgtggtccaacggggtccttgaaagcgagatgatcattcccaaaaatttcgctggaccggtgtctcagcataactaccgccctggctatcacacacagaccgccgggccctggcatctcggaaagctggaaatggacttcgatttttgtgagggcaccacagtggtcgttaccgaagactgcgggaaccggggaccctccctgagaacgacaaccgctagcggcaaactcatcacagagtggtgctgtcggtcctgcaccctgcctccgcttcgctacagaggcgaggatgggtgttggtacggaatggaaattcggcccctgaaggagaaggaagagaatctcgtgaactctctggtgacagccggccacgggcaaatcgacaatttcagcctgggagtccttggcatggccctctttctggaagagatgctgagaacccgcgtggggacgaaacacgctatcctcctggttgcggtgtccttcgtcacccttattacaggaaacatgtcttttcgggatctgggcagagtgatggttatggtgggcgccaccatgacagacgatatcgggatgggagtcacctatctcgctctgctggccgccttcaaggtgcgccctacgtttgctgccggccttctgctcagaaaactgacaagcaaggagctcatgatggcgaccattgggatcgctctgctttcccagtctacaattcccgaaaccatcctggagctcaccgacgccctggccctgggaatgatggttcttaaaatcgtgcggaatatggaaaagtaccagctggctgtcacaattatggccatcagctgcgtgcctaacgcggtgattctccaaaatgcttggaaggtctcctgtacgatcctggccgccgttagcgtgtctcccctcctgcttacctccagccagcagaaagctgattggattcctctggccctcacaatcaagggcctgaaccccaccgctatcttcctgacaaccctttctcgcacgtccaaaaagagaagctggccgctgaatgaggccgtgatggcggtcgggatggtgtctattctcgcctccagcctgctcaaaaacgacatccctatgacaggacccctggttgctggcggccttctgaccgtgtgctatgtcctgaccgggcggtccgccgacctcgaactggagcgcgctgccgatgtgaagtgggaggaccaggccgaaattagcggatctagccctatcctttccattacaatctctgaggatggcagcatgtccattaaaaatgaagaggaggaacataccctgacaatcctcatcagaacggggctgctcgttatttctggagtgtttcccgtcagcatcccgattaccgctgcggcctggtacctgtgggaggtgaagaagcaacgggctggcgtcctttgggacgtgccttctccccctcccgttgggaaagccgaactggaggatggagcctatcgcatcaagcagagaggcattttcggctacagccagatcggggctggagtgtataaagaaggcacatttcacaccatgtggcatgtcacaagaggggccgtgctgatgcaccgcggaaagagaatcgagcccagctgggcggacgttaaaaaggatctcatttcctacggcgggggatggaagctggagggcgaatggaaagagggcgaagaggtgcaggtccttgctctggaacctgggaagaacccgcgggccgtgcaaaccaaacccggactcttcaagacgaataccggcacaatcggggccgtgagcctggacttttctcctggaacctccggcagccccattgttgatagaaaagggaaggtcgtgggactctacggcaacggcgtggtcacacgctctggggcttatgtgtccgccatcgcgcagaccgaaaagagcattgaggacaatcctgaaatcgaggatgacatcttccggaaaaagagactgacaattatggatcttcatcccggagctggcaaaacgaagcgctacctgcctgccatcgttcgggaagccattaaaagagggctgcgcaccctcatcctggctccgacacgggtggtcgccgctgagatggaagaggcccttagaggactgcccattcgctatcagacccctgcgatccgggccgagcacaccggcagagaaattgtggacctcatgtgtcacgctacattcacgatgcggctgctctcccccgttcgcgtgcctaactacaacctgatcatcatggacgaggcccattttaccgatcccgcttctattgccgccagagggtatatcagcacacgggtcgaaatgggcgaggctgcgggaattttcatgaccgccacaccgcctggctcccgcgacccctttccccagagcaatgctcctatcatggatgaggaaagagagattcccgaacggtcttggaactccgggcacgagtgggtgaccgacttcaagggaaagacggtttggtttgtgcctagcatcaaagccggcaatgatatcgccgcttgccttagaaagaacgggaaaaaggtcattcaactgtctcgcaaaacattcgacagcgaatacgtgaagacccgggccaatgattgggactttgtggtcaccacagatatctccgagatgggagcgaacttcagagctgagcgcgttattgacccgcggagatgtatgaagcccgtgatcctgaccgatggcgaggaacgcgtgattctcgccgggcctatgcccgtcacacattctagcgccgctcagcggagaggccgcatcggaagaaatcctaaaaacgaaaatgaccagtatatctacatgggcgagcccctggaaaacgacgaggattgcgcccactggaaggaggcgaaaatgcttctggacaatattaacaccccggaagggatcattccttccatgtttgagcccgaacgggagaaggtggatgccatcgacggagaataccgcctcagaggcgaggctcggaaaacgttcgttgatctgatgcgcagaggggacctgcctgtgtggctcgcctatcgggtcgctgccgagggaattaattacgctgatagacgctggtgttttgacggcatcaagaacaatcaaattcttgaagagaacgtggaagttgagatctggacaaaagagggggaacggaagaagctgaaacccagatggctggatgcccgcatctattctgaccctctcgcgctgaaggagttcaaagagttcgccgctggccggaagtcccttaccctgaacctcattacagagatgggaagactgcccaccctgatgacgcagaaagcccgggatgctctcgacaatcttgccgtgctgcacaccgccgaagtcggcgggcgcgcttacaaccatgcgctgtccgagctcccggagacactggaaacccttctgctcctgacactgctcgccaccgtgacaggaggcatctttcttttcctgatgagcgggaagggaattggcaagatgaccctgggcatgtgctgcatcattacggcttctatcctcctgtggtatgcccagatccagcctcactggattgccgcttccatcattcttgagtttttcctgatcgtcctcctgattcccgaacccgagaaacaaagaacacctcaggataatcagctgacctacgtggttatcgccatcctcaccgtggtggcggccacaatggctaacgaaatggggtttcttgagaagaccaaaaaggacctgggactgggcagcattacaacgcaggagtccgaatctaatatcctcgacattgatctgcggccggccagcgcttggaccctttatgccgtcgcgacaaccttcgttacacccatgctgcgccattccatcgagaactctagcgtgaatgtgtccctcaccgccattgctaaccaagccacggtcctgatggggctgggaagaggctggcctctcagcaaaatggacatcggggtgccccttctggctattggatgttactctcaggttaatcctatcaccctgacagccgctctcctgcttctggtggcccactacgcgatcattggccccggcctccaggccaaggctacccgggaagcccagaagcgcacagctgccgggatcatgaaaaaccctaccgtcgatggaattacggtgatcgacctggagccgattccctatgatcctaagtttgaaaaacaactgggccaggtcatgctccttgtgctgtgcgttacacaggtgctgatgatgagaaccacatgggccctctgtgaggcgctgacccttgctaccgggcccatctccacactgtgggagggaaatcctggccggttctggaacacgaccatcgccgtcagcatggctaatatttttcgcgggtcttacctcgccggagccggcctgctgttctccatcatgaagaacacaaccaatacaagacggggcaccgggaacattggagaaacgctcggcgagaaatggaaaagcagacttaatgctctggggaagtctgaatttcagatctataaaaagagcggcattcaagaggtggaccgcacactggccaaagagggcatcaagagaggggaaaccgatcatcacgcggtttccagaggatctgccaaactccgctggttcgtggagcggaacatggtcacccccgaaggcaaggtggtggacctgggctgcgggagaggaggctggagctactattgtgggggacttaaaaacgttcgcgaggtcaagggcctgacaaaagggggaccgggccacgaggaacctatccccatgtccacctacggctggaatctcgtgcggctgcagagcggggtggatgtctttttcacaccccctgagaaatgcgacacgctgctctgtgatattggagaatcctctcccaaccctaccatcgaggctggcagaacacttcgcgttctgaatctggtggaaaactggctcaataacaatacccagttctgcgtgaaggtcctgaacccgtatatgcccagcgtgattgagaaaatggaaacacttcaacggaagtacgggggagccctggttagaaatcctctctcccgcaactctacccatgagatgtactgggtgagcaatgctacgggcaacatcgtctcctctgtgaatatgattagccggatgctgatcaacagatttaccatgaaacacaagaaggccacatatgagcccgacgttgatctggggtccggaacccgcaatatcggcattgaaaacgagatccctaacctcgacattatcggcaaaagaattgaaaagatcaaacaggagcatgaaacaagctggcactacgaccaggatcacccctataagacctgggcgtaccatgggtcttatgagacaaaacagaccggatccgccagctctatggtgaatggcgtcgtgaaacttctgacgaagccgtgggacgtggtccctatggttacacaaatggctatgaccgataccacacccttcgggcagcagcgggtgtttaaagagaaggtggacacgcgcacccaggaacctaaagagggaacaaagaaactgatgagaattaccgccgaatggctctggaaggagctgggcaagaaaaagacaccccggatgtgtaccagagaggagttcacacggaaagtccgctccaacgctgcccttggggctatctttaccgatgagaataagtggaaaagcgccagagaagcggtggaggactctcggttctgggaactggttgatcgcgagagaaacctccacctggagggaaagtgcgaaacgtgtgtgtacaatatgatgggcaaacgggagaagaagctgggcgaatttgggaaagccaagggatcccgcgctatctggtatatgtggctcggcgccagattcctggagtttgaagctcttgggttcctgaacgaggaccattggtttagccggggaaattccctcagcggcgtcgagggggaaggcctgcacaaacttggatacattctgcgcgatgtgtctaagaaagagggcggggccatgtacgccgacgataccgcgggatgggacacaagaatcaccctcgaagacctgaagaacgaggaaatggttacaaatcatatgaagggcgagcacaaaaagctggctgaggccattttcaaactcacctatcaaaacaaggtggtccgggtgcagcgccctacgcccagagggacagttatggatatcattagccggaaagaccagcgcggatccggccaggtggggacctacggcctgaatacatttaccaacatggaagcccaacttatcagacagatggagggagaaggcatcttcaagtctattcagcggctgacggtcaccgaggagatcgctgtgcaaaattggctcgtcagagtggggcgcgaacggctgagcagaatggccgtttccggagatgactgcgtggtcaagccgcttgatgaccgcttcgcttctgccctgacagcgctcaacgatatgggcaaagtgcggaaggacattcagcagtgggagcctagcagagggtggaatgattggacccaggtgcccttttgctcccaccatttccacgaactggttatgaaagacggacgcgtgctggtcgtgccctgtcggaaccaagatgagctcatcggcagagcccgcatttctcagggggctggctggagcctgaaggaaacagcctgccttggaaaatcctatgctcagatgtggaccctgatgtactttcatcggagagacctccgcctggccgcgaacgccatctgtagcgctgttccttctcactgggtgccgacatcccggaccacgtggagcatccacgccaagcatgagtggatgacaaccgaggatatgcttgctgtctggaatagagtgtggattcaggaaaacccctggatggaggacaagacccctgtcgaatcttgggaggaagtgccctatctgggcaaacgggaggaccaatggtgcgggtccctcatcggactgacaagcagagccacctgggctaagaatattcagacagccatcaaccaggttcgctccctgattggcaatgaggaatacacggattatatgccttctatgaaacggttcagaaaggaggaagaggaagcgggggtgctctggtga

SEQ ID NO: 19898 - RNA, 9876 nt, synthetic construct
  misc_feature 1..9876: note = derived and/or modified CDS sequence (opt5) from DENV-2__EU529693__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaaccatggccgctatcctcgcctacaccattggaacaacgcactttcagagagctctgatcttcattcttctgaccgccgtggcgcctagcatgacaatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacggaggctaagcagcctgccacactgagaaaatattgcattgaagctaagctcaccaacaccacaaccgagagccggtgtccgacacaaggagagccctctctgaatgaggaacaggacaaacgctttatctgcaagcattccatggtggatagaggctggggcaacgggtgtggactgttcggcaaaggcgggattgtgacgtgcgccatgtttacctgcaaaaagaatatggaagggaaagtcgttctccctgagaacctggaatacacaatcgtgattacaccccacagcggggaggagcatgcggtgggaaatgacacaggcaagcacggcaaagaaatcaagatcacccctcagtcttccattacggaggccgaacttaccgggtatggaacagtcaccatggagtgtagcccccggacaggcctggatttcaacgaaatggtgctcctgcagatggaggacaaggcttggcttgttcaccgccaatggtttctggatctcccgctgccttggctgcccggggccgacacccagggatctaattggatccagaaggagacgctcgtgacattcaagaaccctcatgctaaaaagcaggacgtcgtggttctgggctcccaagaaggggccatgcacaccgcccttacaggcgctaccgagattcagatgagctccggaaatctgctctttaccggccatctgaaatgcagacttcggatggataagctgcagctcaaagggatgtcttacagcatgtgtacaggaaagttcaagatcgtgaaagaaattgcggagacgcaacacggcaccatcgtcatcagagtgcagtatgagggggacggatccccctgcaagattcccttcgaaatcatggatctggagaaacgccatgtcctgggccggctcattacagtgaaccctatcgttaccgaaaaggacagcccggtgaacattgaggccgaacccccttttggggattcttacatcattatcggcgtcgagcccggacagctgaaacttaattggttcaagaagggctccagcatcgggcagatgtttgagacaaccatgagaggagctaaacgcatggccattctgggcgacacggcctgggatttcgggtctctcggaggcgtgtttacaagcatcgggaaggctctgcaccaagttttcggcgccatttacggagcggctttttccggcgtgtcttggaccatgaaaatcctgattggggtcatcatcacctggattggaatgaacagccggtccacaagcctttctgtgtccctcgtgctggttggcatcgtcaccctgtatctcggggtgatggtgcaggccgacacaggatgtgtcgtgagctggaagaataaagaactgaagtgcggctctgggattttcatcacggataacgttcacacctggacagagcagtacaagtttcagcctgaatcccccagcaaacttgcctccgctattcaaaaggcccatgaggaaggcatctgtggaatcagatctgtgacccgcctggagaatctcatgtggaaacagattacaccggagctgaaccacatcctgagcgaaaatgaggtcaaacttaccattatgacgggcgacatcaaagggattatgcaggctggaaagcggtccctcagacctcagcccaccgaactgaaatattcttggaagacatggggcaaggccaaaatgctgagcaccgagtcccataaccaaacattcctcatcgatgggcctgaaaccgcggagtgccccaatacaaaccgcgcctggaatagcctggaggtggaagactacggatttggcgttttctctaccaacatctggcttaagctgcgggagaaacaggacgtgttttgtgattccaagctcatgagcgctgccattaaagacaatagagctgtccacgccgatatgggctattggatcgaatctgcgctgaacgacacgtggaagatggagaaggcctccttcattgagatcaaaagctgccactggcctaagtctcatacactgtggagcaatggggtgcttgaatccgagatgattatccccaaaaacttcgctggaccggttagccagcacaactaccgccctggctatcatacccagaccgccgggccctggcacctcggaaagctggaaatggattttgacttctgtgagggcacaaccgtggtcgtgacggaagattgcgggaatcggggaccctctctgagaacaaccacagcttccggcaaactcattaccgagtggtgctgtcggagctgcacactgcctccgcttcgctacagaggcgaggacgggtgttggtacggaatggaaatccggcccctgaaggagaaggaagagaacctcgtgaatagcctggtcaccgccggccatgggcaaatcgataacttttctctgggagttcttggcatggccctcttcctggaagagatgctgagaacgcgcgtggggaccaaacacgctattctcctggtggcggtcagctttgtgacacttatcaccggaaatatgtccttccgggacctgggcagagttatggtgatggtcggcgccacaatgaccgatgacattgggatgggagtgacgtatctcgctctgctggccgcctttaaggttcgccctacattcgctgccggccttctgctcagaaaactgacctctaaggagctcatgatggcgacaatcgggattgctctgcttagccagtccaccatccccgaaaccatcctggagctcacagatgccctggccctgggaatgatggtgcttaaaattgtccggaacatggaaaagtaccagctggctgtgacgatcatggccatttcttgcgttcctaatgcggtgatcctccaaaacgcttggaaggtcagctgtaccattctggccgccgtgtccgtgagccccctcctgcttacatcttcccagcagaaagctgactggatccctctggccctcaccatcaagggcctgaatcccacagctatttttctgaccacgcttagccgcacatctaaaaagagatcctggccgctgaacgaggccgtcatggcggttgggatggtgagcatcctcgcctcttccctgctcaaaaatgacattcctatgaccggacccctggtggctggcggccttctgaccgtctgctatgtgctgacagggcggagcgccgatctcgaactggagcgcgctgccgacgttaagtgggaggatcaggccgaaatctccggaagctctcctattcttagcatcaccatttccgaggacggctctatgagcatcaaaaacgaagaggaggaacacacactgacgatcctcattagaaccgggctgctcgtgatctccggagtcttccccgtgtctattccgatcacagctgcggcctggtacctgtgggaggttaagaagcaacgggctggcgtgctttgggatgtcccttctccccctcccgtggggaaagccgaactggaggacggagcctatcgcattaagcagagaggcatctttggctactcccagatcggggctggagtctataaagaaggcaccttccatacaatgtggcacgtgaccagaggggccgttctgatgcatcgcggaaagagaattgagccctcctgggcggatgtgaaaaaggacctcatcagctacggcgggggatggaagctggagggcgaatggaaagagggcgaagaggtccaggtgcttgctctggaacctgggaagaatccgcgggccgttcaaacgaaacccggactctttaagaccaacacaggcaccattggggccgtgtccctggatttcagccctggaacatctggctcccccatcgtcgacagaaaagggaaggtggtgggactctacggcaatggcgttgtcacccgcagcggggcttatgtgtctgccattgcgcagacagagaagtccatcgaggataaccctgaaatcgaggacgatattttccggaaaaagagactgacgatcatggaccttcaccccggagctggcaaaaccaagcgctacctgcctgccattgtgcgggaagccatcaaaagagggctgcgcacactcattctggctccgacccgggtcgtggccgctgagatggaagaggcccttagaggactgcccatccgctatcagacccctgcgattcgggccgagcatacaggcagagaaatcgttgacctcatgtgtcacgctacgtttaccatgcggctgctcagccccgtgcgcgtccctaactacaatctgatcattatggatgaggcccacttcacagaccccgcttccatcgccgccagagggtatatttctacccgggtggaaatgggcgaggctgcgggaatctttatgacagccaccccgcctggcagccgcgatcccttcccccagtccaacgctcctattatggacgaggaaagagagatccccgaacggagctggaactctgggcatgagtgggttacggattttaagggaaagacagtgtggttcgtcccttccatcaaagccggcaacgacattgccgcttgccttagaaagaatgggaaaaaggtgatccaactgagccgcaaaacctttgattctgaatacgttaagacccgggccaacgactgggatttcgtggtcacaaccgacattagcgagatgggagcgaattttagagctgagcgcgtgatcgatccgcggagatgtatgaagcccgtgattctgacagacggcgaggaacgcgtcatcctcgccgggcctatgcccgttacccactcctctgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaatacgccggaagggattatccctagcatgttcgagcccgaacgggagaaggtggacgccattgatggagaataccgcctcagaggcgaggctcggaaaacatttgtggacctgatgcgcagaggggatctgcctgtctggctcgcctatcgggtggctgccgagggaatcaactacgctgacagacgctggtgtttcgatggcattaagaataaccaaatccttgaagagaacgttgaagtggagatctggaccaaagagggggaacggaagaagctgaaacccagatggctggacgcccgcatttattccgatcctctcgcgctgaaggagttcaaagaatttgccgctggccggaagtctcttacactgaatctcatcaccgagatgggaagactgcccacgttcatgacccagaaagcccgggacgctctggataacctcgccgtccttcacacagccgaagtgggcgggcgcgcttacaatcacgcgctgagcgagctgccggagaccctcgaaacactgcttctgctcaccctgctggccacagttaccggaggcatttttctcttccttatgtccgggaagggaatcggcaagatgacgctgggcatgtgctgcattatcacagctagcatcctgctctggtatgcccagattcagcctcattggatcgccgcttctattatcctggagtttttccttattgtgctgctcatccccgaacccgagaaacaaagaacccctcaggacaaccagctgacctacgtcgtgatcgccattctgacagtcgtggcggccaccatggctaatgaaatggggtttctcgagaagaccaagaaggaccttggactgggctccatcacgacccaggagagcgaatccaacattctggatatcgacctccggccggcctctgcttggacactgtatgccgttgcgaccacattcgtgacccccatgcttcgccacagcattgaaaattcctctgtgaacgtcagcctgacggccatcgctaatcaagccaccgttctcatggggctgggaagaggctggcctctgtccaaaatggatattggggtgcccctccttgctatcggatgttacagccaggtgaaccctatcacactgaccgccgctctgctcctgcttgtcgcccattacgcgattatcggccccggcctgcaggccaaggctacacgggaagcccagaagcgcaccgctgccgggattatgaaaaatcctacggtggacggaatcacagttattgatctcgagccgatcccctatgaccctaagtttgaaaaacaactgggccaggtgatgctgctcgtcctttgcgtgacccaggtcctgatgatgagaacaacctgggccctgtgtgaggcgctcaccctggctacagggcccatctctacgctttgggagggaaaccctggccggttctggaataccacaattgccgtgtccatggctaacatctttcgcgggagctacctggccggagccggcctcctgttctctattatgaagaataccacaaacaccagacggggcacggggaatatcggagaaacactgggcgagaaatggaagtccagactcaacgctcttggaaagagcgaatttcagatttataaaaagtctggaatccaagaggttgatcgcaccctggccaaagagggcatcaagagaggggaaaccgaccaccatgcggtgagcagaggatccgccaaactgcgctggttcgtcgagcggaacatggtgacacccgaaggcaaggttgtggatctcggctgcgggagaggaggctggtcttactattgtgggggactgaaaaatgtccgcgaggtgaagggccttaccaaagggggaccgggccacgaggaacctattcccatgagcacatacggctggaacctggtgcggctccagtccggggttgacgtcttctttacgccccctgagaaatgcgataccctgctgtgtgacatcggagaaagctcccccaatcctacaattgaggctggcagaaccctccgcgtgcttaacctggtggaaaattggctgaacaataacacacagttctgcgtcaaggttctcaatccgtatatgccctctgtgatcgagaaaatggaaaccctgcaacggaagtacgggggagcccttgtgagaaaccctctgagccgcaattccacgcacgagatgtactgggtctctaacgctaccggcaatattgtgagctccgttaacatgatctctcggatgctcatcaatagatttacaatgaaacataagaaggccacctatgagcccgatgtggacctggggagcggaacacgcaacattggcatcgaaaacgagattcctaatctggacatcattggcaaaagaatcgaaaagattaaacaggagcacgaaacctcctggcattacgatcaggaccacccctataagacatgggcgtaccacgggagctatgagaccaaacagacgggatctgcctccagcatggtcaacggcgtggttaagctccttacaaagccgtgggatgtggtccctatggtgacccaaatggctatgaccgacacaacgcccttcgggcagcagcgggtgtttaaagagaaggtcgatacccgcacacaggaacctaaagagggaaccaagaaactgatgagaatcacagccgaatggctgtggaaggagctcggcaagaaaaagacaccccggatgtgtacaagagaggagttcacccggaaagttcgctctaatgctgccctgggggctatctttacggacgagaacaagtggaaatccgccagagaagcggtggaggatagccggttctgggaacttgtggaccgcgagagaaatctgcatctcgagggaaagtgcgaaacctgtgtctacaacatgatgggcaaacgggagaagaagctgggcgaatttgggaaagccaagggatctcgcgctatttggtatatgtggctgggcgccagattcctcgagtttgaagctctggggttccttaatgaggatcactggttttcccggggaaacagcctgtccggcgtggagggggaaggcctccataaactgggatacatccttcgcgacgttagcaagaaagagggcggggccatgtacgccgatgacacagcgggatgggacaccagaattacactggaagatctcaagaatgaggaaatggtgaccaaccacatgaagggcgagcataaaaagctggctgaggccatcttcaaactgacgtatcaaaataaggtcgtgcgggttcagcgccctacacccagagggaccgtgatggacattatctctcggaaagatcagcgcggaagcggccaggtcgggacatacggcctcaacaccttcacgaatatggaagcccaactgatcagacagatggagggagaaggcatttttaagtccatccagcggcttaccgtgacagaggagattgctgttcaaaactggctggccagagtggggcgcgaacggctctctagaatggctatcagcggagacgattgcgtcgtgaagccgctggacgatcgcttcgcctccgcgcttaccgccctgaatgacatgggcaaagtccggaaggatattcagcagtgggagccttctagagggtggaacgactggacacaggtgcccttttgcagccaccacttccatgaactcgttatgaaagatggacgcatgctggtggtcccctgtcggaaccaagacgagctgatcggcagagctcgcatctcccagggggccggctggtctctcaaggaaaccgcttgcctgggaaaaagctatgcccagatgtggacacttatgtactttcaccggagagatctgcgcctcgcggccaatgctatttgttccgccgtgcctagccattgggtgccgacctctcggacgacatggtccatccacgctaagcacgagtggatgaccaccgaggacatgctggccgtttggaacagagtgtggattcaggaaaatccctggatggaggacaagacacctgtcgaaagctgggaggaagtgccctatcttggcaaacgggaggatcaatggtgcgggtctctgatcggactcacctccagagctacatgggccaagaacattcagacggcgatcaatcaggttcgcagcctgattggcaacgaggaatacaccgactatatgccttccatgaaacggttcagaaaggaggaagaggaagccggggtgctgtggtga

SEQ ID NO: 19899 - RNA, 9876 nt, synthetic construct
  misc_feature 1..9876: note = derived and/or modified CDS sequence (opt5) from DENV-2__EU482557__SS-prME
  source 1..9876: mol_type = other RNA
accgccggagtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccgtgagcatcccgattacggctgcggcctggtacctgtgggaggtcaagaagcaacgggctggcgtgctttgggatgtcccttctccccctcccgtggggaaagccgaactggaggacggagcctatcgcatcaagcagagaggcatttttggctacagccagatcggggctggagtttataaagaaggcaccttccatacaatgtggcacgtgaccagaggggccgtcctgatgcatcgcggaaagagaatcgagcccagctgggcggatgtgaaaaaggacctcatttcctacggcgggggatggaagctggagggcgaatggaaagagggcgaagaggttcaggtgcttgctctggaacctgggaagaatccgcgggccgtccaaacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcaccccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcataccggcagagaaattgtcgacctcatgtgtcacgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccagagcaacgctcctatcatggacgaggaaagagagattcccgaacggtcttggaactccgggcatgagtgggtcacagattttaagggaaagaccgtgtggttcgttcctagcatcaaagccggcaacgacatcgccgcttgccttagaaagaatgggaaaaaggtgattcaactgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccactctagcgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccaaattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccagcctcattggattgccgcttccatcattctggagtttttccttatcgtgctgctcattcccgaacccgagaaacaaagaacgcctcaggacaaccagctgacatacgtcgtgatcgccatcctgaccgttgtggcggccaccatggctaatgaaatggggtttctcgagaagaccaagaaggaccttggactgggcagcattaccacacaggagtccgaatctaacatcctggatattgacctccggccggccagcgcttggacgctgtatgccgtggcgaccacattcgtcacccccatgcttcgccactccatcgaaaattctagcgttaacgtgtccctgacagccattgctaatcaagccaccgtgctcatggggctgggaagaggctggcctctgagcaaaatggatatcggggtccccctccttgctattggatgttactctcaggtgaaccctatcacgctgaccgccgctctgctcctgcttgttgcccattacgcgatcattggccccggcctgcaggccaaggctacacgggaagcccagaagcgcaccgctgccgggatcatgaaaaatcctacagtggacggaattaccgtcatcgatctcgagccgattccctatgaccctaagtttgaaaaacaactgggccaggtgatgctgctcgtcctttgcgtgacgcaggttctgatgatgagaacaacctgggccctgtgtgaggcgctcacactggctaccgggcccatctccaccctttgggagggaaaccctggccggttctggaatacaacgatcgccgtgagcatggctaacatttttcgcgggtcttacctggccggagccggcctcctgttctccatcatgaagaataccacaaacaccagacggggcacagggaatattggagaaaccctgggcgagaaatggaaaagcagactcaacgctcttgggaagtctgaatttcagatctataaaaagagcggcattcaagaggtcgatcgcacgctggccaaagagggcatcaagagaggggaaacagaccaccatgcggtgtccagaggatctgccaaactgcgctggttcgttgagcggaacatggtgacccccgaaggcaaggtcgtggatctcggctgcgggagaggaggctggagctactattgtgggggactgaaaaatgtgcgcgaggttaagggccttaccaaagggggaccgggccacgaggagcctatccccatgtccacatacggctggaacctggtccggctccagagcggggtggacgtgttctttacaccccctgagaaatgcgatacactgctgtgtgacattggagaatcctctcccaatcctacgatcgaggctggcagaaccctccgcgtccttaacctggttgaaaattggctgaacaataacacacagttctgcattaaggtgctcaatccgtatatgcccagcgtgatcgagaaaatggaaaccctgcaacggaagtacgggggagcccttgtcagaaaccctctgtcccgcaattctacacacgagatgtactgggtgagcaacgctaccggcaatattgtttcctctgtgaacatgatcagccggatgctcatcaatagatttacgatgaaacataagaaggccacctatgagcccgatgtcgacctggggtccggaacacgcaacattggcatcgaaaacgagattcctaatctggacatcattggcaaaagaatcgaaaagattaaacaggagcacgaaaccagctggcattacgatcaggaccacccctataagacatgggcgtaccacgggtcttatgagaccaaacagacaggatccgccagctctatggtgaacggcgttgtgaagctccttaccaagccgtgggatgtcgtgcctatggtgacgcaaatggctatgacagacaccacccccttcgggcagcagcgggtctttaaagagaaggttgatacacgcacgcaggaacctaaagagggaaccaagaaactgatgagaatcacagccgaatggctgtggaaggagctcggcaagaaaaagacaccccggatgtgtacaagagaggagttcacccggaaagtgcgctccaatgctgccctgggggctatctttacagacgagaacaagtggaaaagcgccagagaagcggtggaggattctcggttctgggaacttgtcgaccgcgagagaaatctgcatctcgagggaaagtgcgaaacctgtgtgtacaacatgatgggcaaacgggagaagaagctgggcgaatttgggaaagccaagggatcccgcgctatttggtatatgtggctgggcgccagattcctcgagtttgaagctctggggttccttaatgaggatcactggtttagccggggaaactccctgagcggcgttgagggggaaggcctccataaactgggatacatccttcgcgacgtgtctaagaaagagggcggggccatgtacgccgatgacacggcgggatgggacaccagaattacactggaagatctcaagaatgaggaaatggtcaccaaccacatgaagggcgagcataaaaagctggctgaggccatcttcaaactgacatatcaaaataaggtggttcgggtgcagcgccctacccccagagggacggtcatggacattatcagccggaaagatcagcgcggatccggccaggtggggacatacggcctcaacaccttcacaaatatggaagcccaactgatcagacagatggagggagaaggcatttttaagtctatccagcggcttaccgttacggaggagattgctgtgcaaaactggctggccagagtcgggcgcgaacggctcagcagaatggctatctccggagacgattgcgtggtcaagccgctggacgatcgcttcgcctctgcgcttaccgccctgaatgacatgggcaaagtgcggaaggatattcagcagtgggagcctagcagagggtggaacgactggacacaggttcccttttgctcccaccacttccatgaactcgtgatgaaagatggacgcgtcctggtggtgccctgtcggaaccaagacgagctgatcggcagagctcgcatctctcagggggccggctggagcctcaaggaaaccgcttgcctgggaaaatcctatgcccagatgtggacacttatgtactttcaccggagagatctgcgcctcgcggccaatgctatttgtagcgccgttccttctcattgggtgccgacctcccggacaacctggagcatccacgctaagcacgagtggatgacgacagaggacatgctggccgtctggaacagagtgtggattcaggaaaatccctggatggaggacaagacccctgttgaatcttgggaggaagtgccctatcttggcaaacgggaggatcaatggtgcgggtccctgatcggactcaccagcagagctacatgggccaagaacattcagaccgcgatcaatcaggtccgctccctgattggcaacgaggaatacacagactatatgccttctatgaaacggttcagaaaggaggaagaggaagccggggtgctgtggtga

SEQ ID NO: 19900 - RNA, 9876 nt, synthetic construct
  misc_feature 1..9876: note = derived and/or modified CDS sequence (opt5) from DENV-2__EU482560__SS-prME
  source 1..9876: mol_type = other RNA
acagccggagtgatcgtgatgctgattcccacagttatggctttccacctcacgacccggaatggggaacctcatatgatcgtgggacggcaggaaaagggcaaaagcctgctttttaagacagaagacgggattaatatgtgcaccctgatggccatcgatctcggagaactgtgtgaggacacaattacctacaaatgcccgcttctgaagcaaaacgaacccgaggatatcgactgttggtgcaattccacatctacctgggtgacgtatggcacctgtacaaccacaggggagcaccgcagagaaaaacggagcgtcgcgctcgtgcctcatgttggaatgggcctggagacccgcacggaaacatggatgtcctctgagggcgcttggaagcacgtgcagagaatcgagacctggattctgcggcatcccgggttcacaatcatggccgccattctcgcttacaccatcggaaccacacactttcagcgcgccctgattttcatccttctgacggctgtcgcccctagcatgaccatgagatgcattggcatctccaaccgggattttgtggaaggggtttctggaggcagctgggtggacatcgtcctcgagcacgggtcctgtgtgacaaccatggcgaagaataaacccacactggatttcgaacttattaagaccgaggccaaacagcctgctacgctgcgcaagtattgcatcgaagccaaactcacaaacaccaccacagagagcagatgtccgacccaaggagagccctctctgaatgaagaacaggacaagcggtttatttgcaagcattccatggtggatcgcggctggggcaacgggtgtggactgttcggcaaagggggaatcgtcacatgcgctatgtttacgtgcaagaaaaatatggaaggcaaggttgtgcagcctgagaacctcgaatacaccattgtgatcacaccccacagcggggaggagcatgccgtcggaaatgacaccggcaaacacggcaaggaaatcaaaattacacctcagtcttccatcaccgaggcggaactgacggggtatggaaccgtgacaatggagtgtagccccagaaccggccttgatttcaacgaaatggttctgctccaaatggaggacaaggcctggctggtgcaccggcagtggtttcttgatctgccgctcccttggctgcccggggctgacacacagggatctaattggattcagaaggagaccctggtcacgttcaaaaaccctcatgccaagaaacaagacgtggttgtgctcggctcccaggaaggggctatgcacacagccctgaccggcgccacagagatccagatgagctccggaaatcttctgtttaccggccatctcaagtgccgcctgagaatggataaacttcaactgaaggggatgtcttacagcatgtgtaccggaaagttcaaaattgtcaaggaaatcgctgagacacagcacggcacgatcgtgattcgggtccagtatgagggggacggatccccctgcaaaatccccttcgaaattaccgatctcgagaagagacatgtgctgggccgcctgatcacagttaaccctattgtgaccgaaaaagacagcccggtcaacatcgaggcggaacccccttttggggattcttacattatcatcggcgtggagcccggacagctcaagctgaattggttcaagaaaggctccagcattgggcaaatgtttgagacaaccatgcggggagccaagagaatggctatccttggcgacacggcctgggatttcgggtctctgggaggcgtttttacaagcattgggaaagccctccaccaggtgttcggcgctatctacggagccgcgttttccggcgtctcttggaccatgaagattctgatcggggtgatcattacctggatcggaatgaacagccgctccacaagcctgtctgtgtcccttgttctcgtcggcgtggtgaccctgtatctgggggctatggtccaggccgacagcggatgtgtggtttcttggaaaaataaggaactcaagtgcggctccgggattttcatcacagataacgtgcacacgtggaccgagcagtacaaatttcaacctgaaagcccctccaagctggcctctgctattcagaaagcccatgaggaaggcatctgtggaatccggagcgtcacaagacttgagaatctgatgtggaagcagattaccccggagctcaaccacatcctgtccgaaaatgaggtgaaactgacaattatgaccggcgacatcaaggggattatgcaggctggaaaacgctctcttcggcctcaacccacggaactcaagtatagctggaagacctggggcaaagccaagatgctgtccacagagagccataaccagaccttcctgatcgatgggcctgaaacagcggagtgccccaataccaacagagcctggaactctctcgaggttgaagactacggatttggcgtgttcacaaccaacatctggctgaaacttcgcgagaagcaggacgctttttgtgattccaaactgatgagcgccgctattaaggacaatcgggccgtccacgcggatatgggctattggatcgaatctgccctcaacgacacgtggaagatggagaaagctagcttcattgaggtcaagagctgccactggcctaaatctcatacactgtggagcaatggggttctggaatccgagatgatcattcccaagaacttcgccggaccggtgagccagcacaaccatagacctggctaccacacccaaaccgctgggccctggcatcttggaaaactcgaaatggattttgacttctgtgagggcacaaccgtcgtggtgacggaagattgcgggaatcgcggaccctctctgcggacaaccacagcctccggcaagctgatcaccgagtggtgctgtagaagctgcacactccctccgctgcggtatcgcggcgaggacgggtgttggtacggaatggaaattagaccccttaaggagaaagaagagaacctggtcaattccctcgttaccgccggccacgggcagatcgataacttttctctgggagtgctgggcatggctcttttcctcgaagagatgctgcggacgagagtggggaccaagcacgcgatcctgctcgtcgccgtgagcctggttacacttattaccggaaatatgtcctttcgcgacctgggccgggtgatggtcatggtgggcgctacaatgaccgatgacatcgggatgggagttacgtacctcgccctgctggccgctttcaaagtgagacctacatttgccgcgggccttctgctccgcaagctgacctctaaagagctcatgatggctacaattgggatcgccctgcttagccagtccaccattcccgaaaccatcctggagctcacagatgccctggctctgggaatgatggtccttaagatcgtgagaaacatggaaaagtatcaactggccgttacgattatggcgatctcttgcgtgcctaatgctgtcattctccagaacgcctggaaagtgagctgtaccatcctggccgctgtgtccgtcagccccctcctgcttacatcttcccagcagaaggccgactggattcctctggctctcaccatcaaaggcctgaatcccacagccatcttcctgaccacgcttagccggacatctaagaaacgctcctggccgctgaacgaggcgattatggccgttgggatggtgagcatcctcgcttcttccctgctcaagaatgacattcctatgaccggacccctggtggccggcggccttctgaccgtctgctacgtgctgacagggagaagcgctgatctcgaactggagcgggccgccgacgttaaatgggaggatcaagctgaaatctccggaagctctcctattcttagcatcaccatttccgaggacggctctatgagcatcaagaacgaagaggaggaacagacactgacgatcctcattcgcaccgggctgctcgtgatctccggagtctttcccgtgtctattccgatcacagcggccgcttggtatctgtgggaggttaagaaacagagagccggcgtgctttgggatgtcccttctccccctcccgtggaaaaggccgagctggaagacggggcttaccggattaaacagcgcggattcctgggctattcccaaatcggcgccggggtctacaaggagggaacctttcatacaatgtggcacgtgaccagaggcgcggttctcatgcatcgggggaaacgcatcgagccctcctgggctgatgtgaagaaggacctgattagctatggaggcgggtggaaacttgaaggagagtggaaggaaggcgaggaagtccaggtgctggccctcgagcctggcaaaaatccgagagccgttcagacgaagcccgggatcttcaaaaccaacacaggaaccattggcgctgtgtccctggattttagccctgggacatctggatcccccatcgtcgaccggaagggcaaggtggtggggctctacggaaatggcgttgtcaccagaagcggcgcctacgtgtctgcgattgctcagacagagaaatccatcgaaaacaaccctgagatcgaagatgacattttccgcaagaaacggctgacgatcatggatcttcaccccggggccggaaagaccaaaagatatctgcctgccattgtgcgcgaggctatcaagcggggcctgagaacactcattctggccccgacccgcgtcgtggctgccgaaatggaggaggcgcttcgggggctgcccatcagataccaaacccctgccattcgcgctgaacatacaggacgggagatcgttgacctcatgtgtcacgccacgttcaccatgagactgctcagccccgtgcgggtccctaattataacctgatcattatggacgaagctcactttacagatcccgcctccatcgccgctcgcggctacatttctaccagagtggagatgggggaggcggccggcatcttcatgacagctaccccgcctggaagccgggacccctttccccagtccaatgcccctattatggatgaagaaagagaaatccccgagagaagctggaactctggccatgaatgggttacggacttcaaggggaaaacagtgtggtttgtcccttccatcaaggccggaaatgatattgctgcctgccttcggaaaaacggcaagaaagtgatccagctgagcagaaagaccttcgactctgagtatgttaagacccgcgcgaatgattgggactttgtggtcacaaccgatattagcgagatgggggctaacttcaaagccgaacgggtgatcgacccgagacgctgtatgaagcccgtgattctgacagatggagaggaacgggtcatcctcgccggccctatgcccgttacccactcctctgctgcccaaagacgcgggcggatcggcagaaatcctaaaaacgagaatgaccagtacatttatatgggagaacccctggagaacgacgaggattgcgcgcattggaaggaagccaaaatgcttctggacaatatcaacacgccggagggcattatccctagcatgtttgaacccgagcgcgaaaaggtggatgctattgacggggagtacagactccggggagaggcccgcaaaacattcgtggatctgatgagacggggcgacctgcctgtctggctcgcttacaaggtggccgctgaagggatcaattatgccgatcgcaagtggtgttttgacggaattaaaaacaaccagatccttgaggaaaatgttgaggtggagatctggaccaaggaaggcgagcgcaaaaagctgaaaccccggtggctggatgcgagaatttactccgaccctctcgccctgaaggagttcaaggagttcgctgccgggcgcaaatctcttacactgaacctcatcaccgaaatgggccggctgcccacgtttatgacccagaaggctagaaatgccctggataacctcgccgtccttcacacagctgaggcgggaggccgcgcctataatcacgctctgagcgagctgccggaaaccctcgagacactgcttctgctcaccctgctggccacagtgaccgggggaattttcctctttcttatgtccggcaaagggatcggaaagatgacgctgggcatgtgctgcattatcacagccagcatcctgctctggtacgctcaaattcagcctcattggatcgccgcgtctattatcctggagttctttcttattgttctgctcatccccgagcccgaaaaacagcggacccctcaggacaaccaactgacctatgtggtcatcgccattctgacagtggtcgctgccaccatggctaatgagatgggcttcctcgagaagacaaagaaagatcttgggctgggatccatcacgacccaggaaagcgagtccaacattctggacatcgacctcagaccggcctctgcgtggacactgtacgccgtggctaccacatttgttacccccatgcttcggcacagcattgaaaattcctctgtgaacgtgagcctgacggccatcgctaatcaggccaccgtcctcatgggcctggggaagggatggcctctgtccaaaatggatattggcgttcccctccttgctatcgggtgttatagccaggtgaaccctatcacactgaccgccgcgctgctcctgcttgtggcccattacgctattatcggacccggcctgcaagccaaggctacacgcgaggcccagaaaagagccgcggctggcattatgaagaatcctaccgtcgacgggatcacggtgattgatctcgaaccgatcccctacgaccctaagttcgagaaacagctgggacaggttatgctgctcatcctttgcgtgacacaagtcctgatgatgcggaccacatgggccctgtgtgaggctctcaccctggccaccggccccatttctacactttgggaagggaaccctggacgcttttggaatacgaccatcgccgtgtccatggctaacattttcagaggcagctatctggccggggcgggactcctgttttctatcatgaagaatacaaccaacacacggcgcggcaccggcaacattggggagacgctgggagaaaaatggaagtccagactcaatgcccttggcaaaagcgagttccagatctacaagaaatctgggatccaggaggtcgatcggacactggctaaggaaggaattaagcgcggcgagaccgaccaccatgccgtgagcagagggtccgctaaactgcggtggtttgttgaaagaaacatggtgacccccgagggaaaggtcgtggatctcggctgcggccgcgggggatggtcttattactgtggcgggctgaaaaatgttcgggaagtgaagggacttacaaaaggcgggccgggacacgaggagcctatccccatgagcacctatggctggaacctggtcagactccaatccggcgtggacgtgttcttcacaccccctgaaaagtgcgatacgctgctgtgtgacattggggagagctcccccaatcctaccatcgaagccggacgcacactccgggttcttaacctggtcgagaattggctgaacaataacacccagttttgcattaaggtgctcaatccgtacatgccctctgtgatcgagaaaatggagacactgcagagaaagtatggcggggcgcttgtccgcaaccctctgagcagaaattccacccacgagatgtactgggtttctaacgccacgggaaatatcgtgagctccgtgaacatgatttctagaatgctcatcaaccgcttcaccatgaaacataagaaagctacatacgaacccgatgtcgacctgggcagcgggacccggaatattggaatcgagtccgaaattcctaacctggatatcattggcaagagaatcgagaagatcaaacaggaacacgagacaagctggcattatgaccaagaccacccctacaagacctgggcctatcacggctcttacgagacaaaacagaccgggtccgctagctctatggtgaatggagttgtgcgcctccttacgaagccgtgggatgtcgtgcctatggttacacagatggccatgaccgacaccacaccctttggccagcaacgggtgttcaaagaaaaggtcgatacgagaacccaggagcctaaggaagggaccaaaaagctgatgaaaattaccgctgagtggctgtggaaggagctcggcaaaaagaaaacaccccgcgtgtgtaccagagaagagtttacacggaaggtgcgctccaacgccgcgctgggcgccatcttcaccgacgaaaataagtggaaaagcgctagagaggccgtcgaagatgggcggttttgggagcttgttgacagagagcggaacctgcatctcgaaggaaagtgcgagacgtgtgtgtataatatgatgggcaaacgcgaaaagaaactgggcgagttcgggaaggctaagggatctagagccatttggtacatgtggctgggcgcccggtttctcgagttcgaggcgctggggtttcttaacgaggatcactggttctcccgcggaaatagcctgtccggcgtggaaggggagggcctccatagactgggatatatccttcgggacgtcggcaaaaaggaagggggagctatgtacgccgatgacaccgccggctgggatacacgcattaccctggaggacctcaaaaacgaagagatggtgacaaatcacatgaagggggagcataaaaagctggctgaagccatctttaagctgacctaccagaacaaagttgtgagagtccagcggcctacgccccgcggaacagtgatggacatcattagcagacgggatcaacgcggctctgggcaggttggcacctatggactcaatacattcaccaacatggaggctcagctgatcagacaaatggaaggcgaggggattttcaagagcatccagcaccttacggccaccgaggaaattgcggtgcagaattggctggcccgggtcggacgcgagagactctcccggatggctatctctggcgacgattgcgtggttaaaccgatcgacgatagatttgccagcgctctgacagcccttaacgacatggggaaggtgcgcaaagatattcagcaatgggaaccttcccggggatggaacgactggacccaggtccccttctgctctcaccattttcacgagctggtgatgaaggatggcagagtcctcgtggttccctgtcgcaatcaggacgaactgatcgggcgggcgagaattagccagggcgccggatggtccctgaaggagacagcttgcctcggcaaatcttacgcccaaatgtggaccctgatgtatttccatcgccgggatcttagactggctgccaacgctatctgtagcgccgtgccttcccactgggtcccgacaagccgcaccacgtggtctattcacgcgaagcatgagtggatgacaaccgaagacatgctcgccgtgtggaatcgggtgtggatccaggagaacccctggatggaagataaaacccctgttgagtcctgggaagaggtgccctacctggggaagagagaggaccagtggtgcggaagccttattggcctgacatctcgcgctacctgggccaaaaatatccagacagccatctcccaagtccggagcctcattgggaacgaagagtatacggactacatgccttccatgaagagatttcggagagaagaggaagaggctggagtgctgtggtga

SEQ ID NO: 19901 - RNA, 9876 nt, synthetic construct
  misc_feature 1..9876: note = derived and/or modified CDS sequence (opt5) from DENV-2__EU482561__SS-prME
  source 1..9876: mol_type = other RNA
accgccggcgtgatcattatgctgatccccaccgctatggccttccacctcacgacccggaacggggagcctcatatgattgtcggacggcaggaaaagggcaagtccctgctttttaagaccgaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggccctcttcctggaagagatgctgagaacacgcgtcgggaccaaacacgccatgctcctggtggttgtgtcctttgtcacgcttatcaccggaaacatgtctttccgggacctgggcagagtgatggttatggtgggcgctacaatgaccgatgacatcgggatgggaattacatatctcgccctgctggccgcttttaaggtccgccctaccttcgccgcgggccttctgctcagaaaactgacgagcaaggagctcatgatggctacaatcgggattgccctgctttcccagtctaccatccccgaaacaattctggagctcaccgatgccctggctctgggaatgatggtgcttaaaatcgttcggaatatggaaaagtaccagctggccgtgaccatcatggcgattagctgcgtccctaacgctgtgatcctccaaaatgcctggaaggtgtcctgtacaattctggccgctgtcagcgtttctcccctcctgcttacgtccagccagcagaaagccgactggatccctctggctctcaccattaagggcctgaaccccacagccatctttctgaccacactttctcgcacctccaaaaagagaagctggccgctgaatgaggcgatcatggccgtggggatggtgtctattctcgcttccagcctgctcaaaaacgacatccctatgacgggacccctggtcgccggcggccttctgacagtgtgctatgttctgaccgggcggtccgctgatctcgaactggagcgcgccgccgacgtgaagtgggaggatcaggctgaaattagcggatctagccctatcctttccattaccatctctgaggacggcagcatgtccattaaaaatgaagaggaggaacaaacactgaccatcctcatcagaacagggctgctcgtcatttctggagtgttccccgttagcatcccgattacggcggccgcttggtacctgtgggaggtgaagaagcagcgggccggcgtcctttgggatgtgccttctccccctcccgtcgggaaagccgaactggaggacggagcttatcgcatcaagcagagaggcattctgggctacagccagatcggggccggagtgtataaagaaggcacctttcacacaatgtggcatgttaccagaggggcggtgctcatgcaccgcggaaagagaatcgagcccagctgggctgatgtcaaaaaggacctgatttcctacggcgggggatggaaacttgagggcgaatggaaagagggcgaagaggtgcaagttctggccctcgaacctgggaagaacccgcgggccgtgcagacaaaacccggactgttcaagaccaatacgggcaccatcggggctgtcagcctcgatttttctcctggaacatccggcagccccattgtggacagaaaagggaaggtggttggactgtacggcaacggcgtcgtgacccgctctggggcctatgtgtccgcgatcgctcagacagaaaagagcattgaggataatcctgaaatcgaggacgatatcttccggaaaaagagacttaccattatggacctgcatcccggagccggcaaaacaaagcgctacctgcctgccatcgtccgggaagctattaaaagagggctccgcacgctgatccttgccccgacccgggtggttgctgccgagatggaagaggcgctgagaggactccccattcgctatcagacccctgcgatccgggctgagcacaccggcagagaaattgtggacctgatgtgtcatgccaccttcacaatgcggctcctgtcccccgtccgcgtgcctaactacaaccttatcatcatggatgaggctcactttacggaccccgcctctattgccgctagagggtatatcagcacccgggttgaaatgggcgaggcggccggaattttcatgacagctaccccgcctggctcccgcgatccctttccccaaagcaatgcccctatcatggacgaggaaagagagattcccgaacggtcttggaactccgggcacgagtgggtgacagatttcaagggaaagaccgtctggtttgtgcctagcatcaaagccggcaatgacatcgctgcctgcctgagaaagaacgggaaaaaggttattcagctgtctcgcaaaacgttcgatagcgaatacgtgaagacacgggcgaatgactgggattttgtcgtgaccaccgacatctccgagatgggagctaacttcaaggccgagagagtgattgatccgcgccggtgtatgaaacccgtcatcctcacagacggcgaagagagagttattctggccgggcctatgcccgtgacccattctagcgctgcccagcgccggggcagaatcggacgcaatcctaagaacgaaaatgaccaatatatctacatgggcgagccccttgaaaacgatgaggactgcgcgcactggaaagaggccaagatgctgctcgataatattaacacaccggaagggatcattccttccatgtttgagcccgaaagagagaaagtggacgctatcgatggagaataccggctgcgcggcgaggccagaaagaccttcgtcgacctgatgcggcgcggggatctccctgtgtggcttgcttatagagttgccgctgagggaattaattacgccgaccggagatggtgttttgatggcatcaaaaacaatcagattctggaagagaacgtggaagtcgagatctggacgaaggagggggaacgcaagaaactgaagccccggtggctcgacgcgagaatctattctgatcctctggcccttaaagagttcaaggagttcgctgccggccgcaaaagcctgacactcaacctgattaccgagatgggacggctgcccacatttatgacccagaaggctagagacgccctcgataatcttgccgtgctgcatacggctgaagcgggcgggcgggcctacaaccacgctctgtccgagctcccggagaccctggaaacacttctgctcctgaccctgctcgccacagttaccggaggcatcttcctttttctgatgagcgggaagggaattggcaaaatgacactgggcatgtgctgcatcattaccgcctctatcctcctgtggtatgctcagatccaacctcactggattgccgcgtccatcattcttgagttctttctgatcgtgctcctgattcccgaacccgagaagcagcgcacgcctcaggacaatcagctgacatacgtcgtgatcgccatcctcaccgtcgtggctgccaccatggctaacgaaatggggttccttgagaaaacaaagaaagacctgggactgggcagcattgccacccaagagtccgaatctaatatcctcgatattgacctgagaccggcgagcgcctggacactttatgctgttgccacgacctttgtgacacccatgctgcggcattccatcgagaactctagcgtgaatgtctccctcaccgctattgccaaccaggctacagttctgatggggctgggaaagggctggcctctcagcaagatggatatcggggtgccccttctggccattggatgttactctcaggtgaatcctatcaccctgacggcggccctcctgcttctggtcgctcactacgccatcattggccccggcctccaggctaaagccacccgcgaagcccaaaagagagcggctgccgggatcatgaaaaaccctacagtggacggaattaccgttatcgatctggagccgattccctatgaccctaagttcgaaaaacagctgggccaggtgatgctccttatcctgtgcgtcacacaggtgctgatgatgcggaccacgtgggctctctgtgaggccctgacacttgccaccgggcccatctccacactgtgggagggaaatcctggccgcttttggaacaccaccattgctgtcagcatggccaatatcttcagagggtcttacctcgcgggagccggcctgctgttttccattatgaagaacacaacgaatacccggcgcggcacagggaacatcggagaaaccctcggcgagaagtggaaaagcagacttaatgctctggggaagtctgagttccaaatttataaaaagagcggaatccaggaggtggatcggacactggccaaagagggcatcaagagaggggaaaccgaccatcacgctgtttcccgcggatctgccaaactccggtggtttgtggagagaaacatggtcacgcccgaaggcaaggtggttgatctgggctgcgggcgcggaggctggagctactattgtgggggacttaagaacgtgcgggaggtcaaaggcctgacaaaagggggaccgggccatgaagaacctattcccatgtccacctacggctggaatctcgtgagactgcagagcggggtggacgttttcttcacaccccctgagaaatgcgatacactgctctgtgacatcggagaatcctctcccaaccctaccattgaggcgggccgcacacttcgggtcctgaatctggtggaaaactggctcaataacaatacgcaattttgcatcaaggtgctgaacccgtatatgcccagcgtcattgagaaaatggaaacccttcagagaaagtacgggggagccctggttcgcaatcctctctcccggaactctacacacgagatgtactgggtgagcaatgctaccggcaacatcgtgtcctctgtcaatatgatcagcagaatgctgattaaccgcttcacaatgaagcacaaaaaggccacctatgagcccgatgtggacctggggtccggaacgcggaatatcggcattgaaagcgagatccctaacctcgacattatcggcaaaagaattgaaaagatcaaacaggagcatgaaacctcttggcactacgatcaggaccatccctataagacatgggcttaccacgggtcctatgagaccaagcaaacaggaagcgcctcttccatggttaacggcgtggtccgccttctgaccaaaccgtgggatgtggttcctatggtgacacagatggctatgaccgacacgacaccctttgggcagcagagagtcttcaaggagaaagtggatacccggacccaagaacctaaggagggaaccaagaagctgatgaagatcacggccgaatggctctggaaagagctgggcaagaaaaagacaccccgcatgtgtacaagagaggaatttacccggaaagtgagaagcaatgcggcccttggggctattttcacagacgagaacaagtggaaatctgcccgggaagctgtcgaggattcccgcttttgggaactgatcgacagagagcggaatctccacctggagggaaagtgcgaaacctgtgtttacaacatgatgggcaagcgcgagaaaaagctgggcgagttcgggaaagccaagggaagcagagccatttggtatatgtggctcggcgcgcggtttctggagttcgaagctcttgggtttctgaatgaggatcattggttctcccgcggaaacagcctctctggcgtggagggggaaggcctgcacagacttggatacatcctgcgggacgtgagcaaaaaggagggcggggccatgtacgccgatgacacagctggatgggacacccgcattacgctcgaagatctgaagaatgaggaaatggtcaccaaccatatgaaaggcgagcacaagaaactggccgaggctatctttaagctcacatatcagaataaagtggttagagtgcagcggcctacaccccgcgggacagtcatggacatcatttccagacgggatcagcgcggatctggccaagtggggacctacggcctgaacacgttcacaaatatggaagcccagcttatcagacagatggagggagaaggcattttcaagagcatccaacatctgaccgttacagaggagattgcggtgcagaactggctcgcccgggtcgggagagaacgcctgtcccggatggctatctctggagacgattgcgtggttaagccgcttgacgatagatttgccagcgctctgaccgccctcaatgacatgggcaaagtgcgcaaggatatccagcagtgggagccttcccgggggtggaacgactggacgcaagtccccttctgctctcaccactttcatgaactgattatgaaagatggaagagtgctggtcgtgccctgtcgcaatcaggacgagctcatcggccgggcgagaattagccagggggccggctggtccctgaaggaaaccgcttgccttggaaaaagctatgcccagatgtggacactgatgtacttccaccgccgggatctcagactggctgccaacgctatctgttctgccgttccttcccattgggtgccgaccagccgcacaacctggtctattcacgcgaagcacgagtggatgacaaccgaggacatgcttgccgtctggaaccgggtgtggatccaagaaaatccctggatggaggacaagacgcctgtggaatcctgggaggaagttccctatctgggcaaaagagaggatcagtggtgcgggagcctcattggactgacatcccgggctacctgggccaagaacatccagaccgccatcaatcaggtgagatctctgattggcaacgaggaatacacagactatatgcctagcatgaaacgctttcggagagaggaagaggaagctggggtcctctggtga

SEQ ID NO: 19902 - RNA, 9876 nt, synthetic construct
  misc_feature 1..9876: note = derived and/or modified CDS sequence (opt5) from DENV-2__EU569703__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccgtgagcatcccgattacggctgcggcctggtacctgtgggaggtcaagaagcaacgggctggcgtgctttgggatgtcccttctccccctcccgtggggaaagccgaactggaggacggagcctatcgcatcaagcagagaggcatttttggctacagccagatcggggctggagtttataaagaaggcaccttccatacaatgtggcacgtgaccagaggggccgtcctgatgcatcgcggaaagagaatcgagcccagctgggcggatgtgaaaaaggacctcatttcctacggcgggggatggaagctggagggcgaatggaaagagggcgaagaggttcaggtgcttgctctggaacctgggaagaatccgcgggccgtccaaacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcaccccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcataccggcagagaaattgtcgacctcatgtgtcacgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccagagcaacgctcctatcatggacgaggaaagagagattcccgaacggtcttggaactccgggcatgagtgggtcacagattttaagggaaagaccgtgtggttcgttcctagcatcaaagccggcaacgacatcgccgcttgccttagaaagaatgggaaaaaggtgattcaactgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccactctagcgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccaaattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccagcctcattggattgccgcttccatcattctggagtttttccttatcgtgctgctcattcccgaacccgagaaacaaagaacgcctcaggacaaccagctgacatacgtcgtgatcgccatcctgaccgttgtggcggccaccatggctaatgaaatggggtttctcgagaagaccaagaaggaccttggactgggcagcattaccacacaggagtccgaatctaacatcctggatattgacctccggccggccagcgcttggacgctgtatgccgtggcgaccacattcgtcacccccatgcttcgccactccatcgaaaattctagcgttaacgtgtccctgacagccattgctaatcaagccaccgtgctcatggggctgggaagaggctggcctctgagcaaaatggatatcggggtccccctccttgctattggatgttactctcaggtgaaccctatcacgctgaccgccgctctgctcctgcttgttgcccattacgcgatcattggccccggcctgcaggccaaggctacacgggaagcccagaagcgcgctgccgccgggatcatgaaaaatcctaccgtggacggaattacagtcatcgatctcgagccgattccctatgaccctaagtttgaaaaacaactgggccaggtgatgctgctcgtcctttgcgtgacccaggttctgatgatgagaacgacatgggcgctgtgtgaggctctcaccctggccacagggcccatctccaccctttgggagggaaaccctggccggttctggaataccacaatcgctgtgagcatggccaacatttttcgcgggtcttacctggccggagctggcctcctgttctccatcatgaagaatacgaccaacacaagacggggcaccgggaatattggagaaacactgggcgagaaatggaaaagcagactcaacgcccttgggaagtctgaatttcagatctataaaaagagcggcattcaagaggtcgatcgcaccctggcgaaagagggcatcaagagaggggaaacggaccaccatgccgtgtccagaggatctgctaaactgcgctggttcgttgagcggaacatggtgacacccgaaggcaaggtcgtggatctcggctgcgggagaggaggctggagctactattgtgggggactgaaaaatgtgcgcgaggttaagggccttaccaaagggggaccgggccacgaggagcctatccccatgtccacctacggctggaacctggtccggctccagagcggggtggacgtgttctttacaccccctgagaaatgcgataccctgctgtgtgacattggagaatcctctcccaatcctacaatcgaggccggcagaacgctccgcgtccttaacctggttgaaaattggctgaacaataacacccagttctgcattaaggtgctcaatccgtatatgcccagcgtgatcgagaaaatggaaacactgcaacggaagtacgggggagctcttgtcagaaaccctctgtcccgcaattctacccacgagatgtactgggtgagcaacgccacaggcaatattgtttcctctgtgaacatgatcagccggatgctcatcaatagatttaccatgaaacataagaaggcgacgtatgagcccgatgtcgacctggggtccggaacccgcaacattggcatcgaaaacgagattcctaatctggacatcattggcaaaagaatcgaaaagattaaacaggagcacgaaacaagctggcattacgatcaggaccacccctataagacctgggcctaccacgggtcttatgagacaaaacagaccggatccgctagctctatggtgaacggcgttgtgcggctccttacaaagccgtgggatgtcgtgcctatggtgacccaaatggccatgacggacacaacccccttcgggcagcagcgcgtctttaaggagaaagttgataccagaacacaggaacctaaggagggaacgaaaaagctgatgcggatcaccgctgaatggctgtggaaagagctcggcaagaagaaaacacccagaatgtgtacccgggaggagttcacacgcaaggtgagatccaatgccgctctgggggccatctttaccgacgagaacaaatggaaaagcgcgcgggaagccgtggaggattctcgcttctgggaacttgtcgacagagagcggaatctgcatctcgagggaaaatgcgaaacatgtgtgtacaacatgatgggcaagcgcgagaaaaagctgggcgaatttgggaaggctaaaggatccagagccatttggtatatgtggctgggcgctcggttcctcgagtttgaagccctggggttccttaatgaggatcactggtttagccgcggaaactccctgagcggcgttgagggggaaggcctccataagctgggatacatccttagagacgtgtctaaaaaggagggcggggccatgtacgcggatgacaccgctggatgggacacgcggattaccctggaagatctcaaaaatgaggaaatggtcacaaaccacatgaagggcgagcataagaaactggccgaggccatcttcaagctgacctatcaaaataaagtggttcgcgtgcagagacctacaccccgggggaccgtcatggacattatcagccgcaaggatcagagaggatccggccaggtggggacgtacggcctcaacacattcaccaatatggaagctcaactgatccggcagatggagggagaaggcatttttaaatctatccagagacttacagttaccgaggagattgccgtgcaaaactggctggctcgcgtcgggcgggaaagactcagccgcatggccatctccggagacgattgcgtggtcaagccgctggacgatcggttcgcgtctgcccttacggctctgaatgacatgggcaaggtgagaaaagatattcagcagtgggagcctagccgcgggtggaacgactggacccaggttcccttttgctcccaccacttccatgaactcgtgatgaaggatggacgggtcctggtggtgccctgtagaaaccaagacgagctgatcggccgcgcccggatctctcagggggctggctggagcctcaaagaaacagcctgcctgggaaagtcctatgcgcagatgtggacccttatgtactttcacagacgcgatctgcggctcgccgctaatgccatttgtagcgctgttccttctcattgggtgccgacatccagaaccacatggagcatccacgccaaacacgagtggatgaccacggaggacatgctggctgtctggaaccgggtgtggattcaggaaaatccctggatggaggacaagacacctgttgaatcttgggaggaagtgccctatcttggcaagagagaggatcaatggtgcgggtccctgatcggactcaccagccgcgccacctgggcgaaaaacattcagacagccatcaatcaggtccggtccctgattggcaacgaggaatacaccgactatatgccttctatgaagagattccgcaaagaggaagaggaagctggggtgctgtggtga

SEQ ID NO: 19903 - RNA, 9876 nt, synthetic construct
  misc_feature 1..9876: note = derived and/or modified CDS sequence (opt5) from DENV-2__EU529694__SS-prME
  source 1..9876: mol_type = other RNA
accgccggcgtgttcatcatgctgattcccaccgctatggcctttcacctcacgacccggaacggggagcctcatatgatcgtcggacggcaggaaaagggcaagtccctgcttttcaagaccgaggacggggttaatatgtgcaccctgatggcgatggatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggattgagacctggatcctgcgccatcccgggtttacaatcatggccgctattctcgcctacaccatcggaaccacacacttccagagagctctgatttttatccttctgacggccgtggcgcctagcatgaccatgcggtgcattggcatctccaaccgcgatttcgtcgaaggggtgtctggaggcagctgggttgacattgtgctcgagcacgggtcctgtgtcacaaccatggccaagaataagcccacactggattttgaacttatcaaaaccgaggctaagcagcctgccacgctgagaaaatattgcatcgaagctaagctcacaaacaccaccacagagagccggtgtccgacccaaggagagccctctctgaatgaagaacaggacaaacgcttcgtgtgcaagcattccatggtggatagaggctggggcaacgggtgtggactgtttggcaaagggggaattgtcacatgcgccatgttcacgtgcaaaaagaatatggaaggcaaagttgtgctccctgagaacctggaatacaccatcgtgattacaccccacagcggggaggagcatgcggtcggaaatgacaccggcaagcacggcaaagaaatcaagattacacctcagtcttccatcaccgaggccgaacttacggggtatggaaccgtgacaatggagtgtagcccccggaccggcctggattttaacgaaatggttctcctgcagatggaggacaaggcttggcttgtgcaccgccaatggttcctggatctcccgctgccttggctgcccggggccgacacacagggatctaattggatccagaaggagaccctcgtcacgtttaagaaccctcatgctaaaaagcaggacgtggttgtgctgggctcccaagaaggggccatgcacacagcccttaccggcgctacagagattcagatgagctccggaaatctcctgttcaccggccatctgaaatgcagacttcggatggataagctgcagctcaaagggatgtcttacagcatgtgtaccggaaagttcaagatcgtcaaagaaattgcggagacacaacacggcacgatcgtgattagagtccagtatgagggggacggatccccctgcaagatcccctttgaaatcatggatctggagaaacgccatgtgctgggccggctcattaccgttaaccctatcgtggccgaaaaggacagcccggtcaacattgaggctgaaccccctttcggggattcttacatcattatcggcgtggagcccggacagctgaaacttaattggtttaagaagggctccagcattgggcagatgttcgagacaaccatgagaggagccaaacgcatggccatcctgggcgacacagcttgggattttgggtctctcggaggcgttttcaccagcatcgggaaggccctgcaccaagtgtttggcgcgatttacggagctgccttctccggcgtctcttggacgatgaaaatcctgattggggtgatcattacatggatcggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatctttattacagataatgtgcacacctggacagagcagtacaagttccagcctgaatccccctctaaacttgccagcgctatccaaaaggcccatgaggaaggcatttgtggaatcagatccgtcacgcgcctggagaacctcatgtggaaacagattaccccggagctgaatcacatcctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaacctttctcattgatgggcctgaaacagctgagtgccccaacaccaatcgcgcctggaactccctggaggttgaagactacggattcggcgtgtttacaaccaatatctggcttaagctgcgggagaaacaggacgtcttctgtgatagcaagctcatgtctgctgccattaaagacaacagagcggtgcacgccgatatgggctattggatcgaatccgctctgaatgacacatggaagatggagaaggccagcttcatcgaggttaaatcttgccactggcctaagagccataccctgtggtccaacggggtgcttgaaagcgagatgattatccccaaaaattttgctggaccggtctctcagcacaactaccgccctggctatcatacgcagacagccgggccctggcacctcggaaagctggaaatggatttcgacttttgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataatttcagcctgggagtgcttggcatggcgctctttctggaagagatgctgagaacacgcgtcgggaccaaacacgccatgctcctggtggctgtttccttcgtgacgcttatcaccggaaacatgtcttttcgggacctgggcagagtcatggtgatggttggcgccacaatgaccgatgacattgggatgggaatcacatatctcgccctgctggctgccttcaaggtgcgccctacctttgcggctggccttctgctcagaaaactgacgagcaaggagctcatgatggccacaatcgggattgccctgctttcccagtctaccatccccgaaacaattctggagctcaccgatgctctggccctgggaatgatggtccttaaaatcgtgcggaatatggaaaagtaccagctggcggttaccattatggctatcagctgcgtgcctaacgccgtcatcctccaaaatgcctggaaggtgtcctgtacaattctggctgccgtgagcgtctctcccctcctgcttacgtccagccagcagaaagctgactggatccctctggccctcaccattaagggcctgaaccccacagcgatcttcctgaccacactttctcgcacctccaaaaagagaagctggccgctgaatgaggccattatggctgttgggatggtgtctatcctcgcctccagcctgctcaaaaacgacatccctatgacgggacccctggtggctggcggccttctgacagtctgctatgtgctgaccgggcggtccgccgatctcgaactggagcgcgccgctgacgttaagtgggaggatcaggcggaaattagcggatctagccctatcctttccattaccatctctgaggacggcagcatgtccattaaaaatgaagaggaggaacaaacactgaccatcctcattagaacagggctgctcgtgatctctggagtctttcccgtgagcatcccgattacggccgctgcctggtacctgtgggaggttaagaagcagcgggccggcgtgctttgggatgtcccttctccccctcccgtggggaaagctgaactggaggacggagcctatcgcatcaagcagagaggcattctgggctacagccagatcggggcgggagtctataaagaaggcaccttccacacaatgtggcatgtgaccagaggggctgttctcatgcaccgcggaaagagaattgagcccagctgggccgatgtgaaaaaggacctgatctcctacggcgggggatggaaacttgagggcgaatggaaagagggcgaagaggtccaagtgctggccctcgaacctgggaagaacccgcgggctgttcagacaaaacccggactgtttaagaccaatacgggcaccatcggggccgtgagcctcgatttctctcctggaacatccggcagccccattgtcgacagaaaagggaaggtggtgggactgtacggcaacggcgttgtcacccgctctggggcgtatgtgtccgctatcgcccagacagaaaagagcattgaggataatcctgaaatcgaggacgatattttccggaaaaagagacttaccatcatggacctgcatcccggagccggcaaaacaaagcgctacctgcctgctatcgtgcgggaagccattaaaagagggctccgcacgctgatccttgctccgacccgggtcgtggccgcggagatggaagaggccctgagaggactccccattcgctatcagacccctgctatccgggccgagcacaccggcagagaaattgttgacctgatgtgtcatgctacctttacaatgcggctcctgtcccccgtgcgcgtccctaactacaaccttatcattatggatgaggcccacttcacggaccccgcctctatcgctgcgagagggtatatcagcacccgggtggaaatgggcgaggccgctggaatttttatgacagccaccccgcctggctcccgcgatcccttcccccaaagcaatgcccctatcatggacgaggaaagagagattcccgaacggtcttggaactccgggcacgagtgggttacagattttaagggaaagaccgtgtggttcgtccctagcatcaaagctggcaatgacattgccgcgtgcctgagaaagaacgggaaaaaggtgatccagctgtctcgcaaaacgtttgatagcgaatacgttaagacacgggctaatgactgggatttcgtggtcaccaccgacatctccgagatgggagccaactttaaggccgagagagtgattgatccgcgccggtgtatgaaacccgtgatcctcacagacggcgaagagagagtcattctggctgggcctatgcccgttacccattctagcgccgcgcagcgccggggcagaatcggacgcaatcctaagaacgaaaatgaccaatatatttacatgggcgagccccttgaaaacgatgaggactgcgcccactggaaagaggctaagatgctgctcgataatatcaacacaccggaagggatcattccttccatgttcgagcccgaaagagagaaagtggacgccatcgatggagaataccggctgcgcggcgaggctagaaagacctttgtggacctgatgcggcgcggggatctccctgtctggcttgcctatagagtggctgccgagggaattaattacgcggaccggagatggtgtttcgatggcatcaaaaacaatcagattctggaagagaacgttgaagtggagatctggacgaaggagggggaacgcaagaaactgaagccccggtggctcgacgccagaatttattctgatcctctggctcttaaagagttcaaggaatttgccgctggccgcaaaagcctgacactcaacctgatcaccgagatgggacggctgcccacattcatgacccagaaggccagagacgccctcgataatcttgctgtcctgcatacggcggaagccggcgggcgggcttacaaccacgccctgtccgagctcccggagaccctggaaacacttctgctcctgaccctgctcgccacagtgaccggaggcatctttcttttcctgatgagcgggaagggaattggcaaaatgacactgggcatgtgctgcatcattaccgcttctatcctcctgtggtatgcccagattcaacctcactggatcgcggcctccatcattcttgagtttttcctgatcgttctcctgattcccgaacccgagaagcagcgcacgcctcaggacaatcagctgacatacgtggtcatcgctattctcaccgtggtcgccgctaccatggccaacgaaatggggtttcttgagaaaacaaagaaagacctgggactgggcagcatcgcgacccaagagtccgaatctaatatcctcgatattgacctgagaccggccagcgcttggacactttatgccgtggctacgaccttcgttacacccatgctgcggcattccatcgagaactctagcgtgaatgtgtccctcaccgccattgctaaccaggccacagtcctgatggggctgggaaagggctggcctctcagcaagatggatatcggggttccccttctggcgattggatgttactctcaggtgaatcctatcaccctgacggccgctctcctgcttctggtggcccactacgctattatcggccccggcctccaggccaaagccacccgcgaagcgcaaaagagagctgccgctgggatcatgaaaaaccctacagtcgacggaattaccgtgatcgatctggagccgattccctatgaccctaagtttgaaaaacagctgggccaggttatgctccttatcctgtgcgtgacacaggtcctgatgatgcggaccacgtgggccctctgtgaggccctgacacttgctaccgggcccatttccacactgtgggagggaaatcctggccgcttctggaacaccaccatcgccgtgagcatggcgaatatctttagagggtcttacctcgccggagctggcctgctgttctccattatgaagaacacaacgaatacccggcgcggcacagggaacatcggagaaaccctcggcgagaagtggaaaagcagacttaatgccctggggaagtctgaatttcaaatttataaaaagagcggaatccaggaggtcgatcggacactggctaaagagggcattaagagaggggaaaccgaccatcacgccgtgtcccgcggatctgcgaaactccggtggttcgttgagagaaacatggtgacgcccgaaggcaaggtcgtggatctgggctgcgggcgcggaggctggagctactattgtgggggacttaagaacgttcgggaggtgaaaggcctgacaaaagggggaccgggccatgaggagcctatccccatgtccacctacggctggaatctcgtcagactgcagagcggggtggacgtgttctttacaccccctgagaaatgcgatacactgctctgtgacatcggagaatcctctcccaaccctaccattgaggccggccgcacacttcgggttctgaatctggtcgaaaactggctcaataacaatacgcaattctgcatcaaggtgctgaacccgtatatgcccagcgtgattgagaaaatggaaacccttcagagaaagtacgggggagctctggtccgcaatcctctctcccggaactctacacacgagatgtactgggttagcaatgccaccggcaacatcgtgtcctctgtgaatatgattagcagaatgctgatcaaccgctttacaatgaagcacaaaaaggctacctatgagcccgatgtcgacctggggtccggaacgcggaatatcggcattgaaagcgagatccctaacctcgacattatcggcaaaagaattgaaaagatcaaacaggagcatgaaacctcttggcactacgatcaggaccatccctataagacatgggcctaccacgggtcctatgagaccaagcaaacaggaagcgcttcttccatggtgaacggcgttgtgcgccttctgaccaaaccgtgggatgtcgtgcctatggttacacagatggccatgaccgacacgacacccttcgggcagcagagagtgtttaaggagaaagtcgatacccggacccaagaacctaaggagggaaccaagaagctgatgaagattacggcggaatggctctggaaagagctgggcaagaaaaagacaccccgcatgtgtacaagagaggagttcacccggaaagtgagaagcaatgccgctcttggggccatctttacagacgagaacaagtggaaatctgctcgggaagccgtggaggattcccgcttctgggaactgatcgacagagagcggaatctccacctggagggaaagtgcgaaacctgtgtctacaacatgatgggcaagcgcgagaaaaagctgggcgaatttgggaaagccaagggaagcagagcgatttggtatatgtggctcggcgctcggttcctggagtttgaagcccttgggttcctgaatgaggatcattggttttcccgcggaaacagcctctctggcgttgagggggaaggcctgcacagacttggatacatcctgcgggacgtgagcaaaaaggagggcggggccatgtacgctgatgacacagccggatgggacacccgcattacgctcgaagatctgaagaatgaggaaatggtgaccaaccatatgaaaggcgagcacaagaaactggctgaggccatcttcaagctcacatatcagaataaagtcgtgagagttcagcggcctacaccccgcgggacagtgatggacattatctccagacgggatcagcgcggatctggccaagtcgggacctacggcctgaacacgttcacaaatatggaagcgcagcttatcagacagatggagggagaaggcatttttaagagcatccaacatctgaccgtgacagaggagattgccgttcagaactggctcgctcgggtggggagagaacgcctgtcccggatggccatctctggagacgattgcgtcgtgaagccgcttgacgatagattcgctagcgccctgaccgcgctcaatgacatgggcaaagttcgcaaggatattcagcagtgggagccttcccgggggtggaacgactggacgcaagtgcccttttgctctcaccacttccatgaactggtcatgaaagatggaagagtgctggtcgtgccctgtcgcaatcaggacgagctcatcggccgggccagaatcagccagggggctggctggtccctgaaggaaaccgcctgccttggaaaaagctatgctcagatgtggacactgatgtactttcaccgccgggatctcagactggccgctaacgccatttgttctgcggttccttcccattgggtgccgaccagccgcacaacctggtctatccacgccaagcacgagtggatgacaaccgaggacatgcttgctgtctggaaccgggtgtggattcaagaaaatccctggatggaggacaagacgcctgtggaatcctgggaggaagttccctatctgggcaaaagagaggatcagtggtgcgggagcctcatcggactgacatcccgggccacctgggccaagaacattcagaccgctatcaatcaggtgagatctctgattggcaacgaggaatacacagactatatgcctagcatgaaacgcttccggagagaggaagaggaagccggggtcctctggtga

SEQ ID NO: 19904 - RNA, 9876 nt, synthetic construct
  misc_feature 1..9876: note = derived and/or modified CDS sequence (opt5) from DENV-2__EU529695__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacaaacactgaccatcctcatcagaacagggctgctcgtgatttctggagttttccccgtgagcatcccgattacggctgcggcctggtacctgtgggaggtcaagaagcagcgggctggcgtgctttgggatgtcccttctccccctcccgtggggaaagccgaactggaggacggagcctatcgcatcaagcagagaggcatttttggctacagccagatcggggctggagtttataaagaaggcaccttccacacaatgtggcatgtgaccagaggggccgtcctgatgcaccgcggaaagagaatcgagcccagctgggcggatgtgaaaaaggacctcatttcctacggcgggggatggaagctggagggcgaatggaaagagggcgaagaggttcaagtgcttgctctggaacctgggaagaatccgcgggccgtccagacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcatcccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcacaccggcagagaaattgtcgacctcatgtgtcatgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccaaagcaacgctcctatcatggacgaggaaagagagattcccgaacggtcttggaactccgggcacgagtgggtcacagattttaagggaaagaccgtgtggttcgttcctagcatcaaagccggcaacgacatcgccgcttgccttagaaagaatgggaaaaaggtgattcagctgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccattctagcgccgctcagcggagaggccgcatcggaagaaaccctaaaaatgaaaacgaccaatatatctacatgggcgagcccctggaaaatgatgaggactgcgcccactggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccagattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcatacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccaacctcactggattgccgcttccatcattctggagtttttccttatcgtgctgctcattcccgaacccgagaaacagagaacgcctcaggacaaccagctgacatacgtcgtgatcgccatcctgaccgttgtggcggccaccatggctaatgaaatggggtttctcgagaagaccaagaaggaccttggactgggcagcattatcacccaagagtccgaatctaacattctggatatcgacctccggccggccagcgcttggacactgtatgccgtggcgacgaccttcgtcacacccatgcttcgccattccattgaaaattctagcgttaacgtgtccctgaccgccatcgctaatcaggccacagtgctcatggggctgggaagaggctggcctctgagcaaaatggatattggggtccccctccttgctatcggatgttactctcaggtgaaccctatcaccctgacggccgctctgctcctgcttgttgcccactacgcgattatcggccccggcctgcaggccaaggctacccgggaagcccaaaagcgcgctgccgccgggattatgaaaaatcctacagtggacggaatcaccgtcattgatctcgagccgatcccctatgaccctaagtttgaaaaacagctgggccaggtgatgctgctcgtcctttgcgtgacacaggttctgatgatgagaaccacgtgggcgctgtgtgaggctctcacactggccaccgggcccatctccacactttgggagggaaaccctggccggttctggaataccaccattgctgtgagcatggccaacatctttcgcgggtcttacctggccggagctggcctcctgttctccattatgaagaatacaacgaacaccagacggggcacagggaatatcggagaaaccctgggcgagaaatggaaaagcagactcaacgcccttgggaagtctgaatttcaaatttataaaaagagcggaatccaggaggtcgatcgcacactggcgaaagagggcatcaagagaggggaaaccgaccatcacgccgtgtccagaggatctgctaaactgcgctggttcgttgagcggaacatggtgacgcccgaaggcaaggtcgtggatctcggctgcgggagaggaggctggagctactattgtgggggactgaaaaatgtgcgcgaggttaagggccttacaaaagggggaccgggccatgaggagcctattcccatgtccacctacggctggaacctggtccggctccagagcggggtggacgtgttctttacaccccctgagaaatgcgatacactgctgtgtgacatcggagaatcctctcccaatcctaccattgaggccggcagaacactccgcgtccttaacctggttgaaaattggctgaacaataacacgcaattctgcatcaaggtgctcaatccgtatatgcccagcgtgattgagaaaatggaaaccctgcagcggaagtacgggggagctcttgtcagaaaccctctgtcccgcaattctacacacgagatgtactgggtgagcaacgccaccggcaatatcgtttcctctgtgaacatgatcagccggatgctcattaatagatttacaatgaaacacaagaaggcgacctatgagcccgatgtcgacctggggtccggaacgcgcaacatcggcattgaaaacgagatccctaatctggacattatcggcaaaagaattgaaaagatcaaacaggagcatgaaaccagctggcactacgatcaggaccatccctataagacatgggcctaccacgggtcttatgagaccaaacaaacaggatccgctagctctatggtgaacggcgttgtgcggctccttaccaagccgtgggatgtcgtgcctatggtgacacagatggccatgaccgacacgacacccttcgggcagcagcgcgtctttaaggagaaagttgataccagaacccaagaacctaaggagggaaccaagaagctgatgcggatcacggctgaatggctgtggaaagagctcggcaagaagaaaacccccagaatgtgtacacgggaggagttcacccgcaaggtgagatccaatgccgctctgggggccatttttacagacgagaacaaatggaaaagcgcgcgggaagccgtggaggattctcgcttctgggaacttgtcgacagagagcggaatctgcacctcgagggaaaatgcgaaacctgtgtgtacaacatgatgggcaagcgcgagaaaaagctgggcgaatttgggaaggctaaaggatccagagccatctggtatatgtggctgggcgctcggttcctcgagtttgaagccctggggttccttaatgaggatcattggtttagccgcggaaactccctgagcggcgttgagggggaaggcctccacaagctgggatacattcttagagacgtgtctaaaaaggagggcggggccatgtacgcggatgacacagctggatgggacacccggatcacgctggaagatctcaaaaatgaggaaatggtcaccaaccatatgaagggcgagcacaagaaactggccgaggccattttcaagctgacatatcagaataaagtggttcgcgtgcagagacctacaccccgggggacagtcatggacatcatcagccgcaaggatcagagaggatccggccaagtggggacctacggcctcaacacgttcacaaatatggaagctcagctgattcggcagatggagggagaaggcatctttaaatctattcaacatcttaccgttacagaggagatcgccgtgcagaactggctggctagagtcgggcgcgaacggctcagcagaatggccatttccggagacgattgcgtggtcaagccgctggacgatcgcttcgcgtctgcccttaccgctctgaatgacatgggcaaggtgcggaaagatatccagcagtgggagcctagcagagggtggaacgactggacgcaagttcccttttgctcccaccacttccatgaactcgtgatgaaggatggacgcgtcctggtggtgccctgtcggaaccaggacgagctgatcggcagagcccgcatttctcagggggctggctggagcctcaaagaaaccgcctgcctgggaaagtcctatgcgcagatgtggacacttatgtactttcaccggagagatctgcgcctcgccgctaatgccatctgtagcgctgttccttctcattgggtgccgacctcccggacaacctggagcattcacgccaaacacgagtggatgacaaccgaggacatgctggctgtctggaacagagtgtggatccaagaaaatccctggatggaggacaagacgcctgttgaatcttgggaggaagtgccctatcttggcaagcgggaggatcagtggtgcgggtccctgattggactcacaagcagagccacctgggcgaaaaacatccagaccgccattaatcaggtccgctccctgatcggcaacgaggaatacacagactatatgccttctatgaagcggttcagaaaagaggaagaggaagctggggtgctgtggtga

SEQ ID NO: 19905 - RNA, 9876 nt, synthetic construct
  misc_feature 1..9876: note = derived and/or modified CDS sequence (opt5) from DENV-2__EU482562__SS-prME
  source 1..9876: mol_type = other RNA
acagccggcgtgatcattatgctgatccccacagctatggccttccacctcacgacccggaacggggagcctcatatgattgtcggacggcaggaaaagggcaagtccctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgatcctgtatctcggggccatggtccaggccgacagcggatgtgtggtttcttggaagtccaaagaactgaagtgcggcagcgggattttcatcacagataatgtgcacacctggacagagcagtacaagtttcagcctgaatccccctctaaacttgctagcgccattcaaaaggctcatgaggaaggcatctgtggaatcagatccgtcacgcgcctggagaacctcatgtggaaacagattaccccggagctgaatcacatcctgtctgaaaacgaggtgaaacttacaattatgaccggcgacatcaaagggattatgcaggccggaaagcggagcctcagacctcagcccacagaactgaaatattcctggaagacctggggcaaggcgaaaatgctgagcacggagtctcataatcaaaccttcctcatcgatgggcctgaaacagccgagtgccccaacaccaatcgcgcttggaactccctggaggttgaagactacggatttggcgtgttcacaaccaatatctggcttaagctgcgggagaaacaggacgtcttttgtgatagcaagctcatgtctgccgctattaaagacaacagagccgtgcacgcggatatgggctattggatcgaatccgccctgaatgacacatggaagatggagaaggctagcttcattgaggttaaatcttgccactggcctaagagccataccctgtggtccaacggggtgcttgaaagcgagatgatcattcccaaaaatttcgccggaccggtctctcagcacaactaccgccctggctatcatacgcagacagctgggccctggcacctcggaaagctggaaatggattttgacttctgtgagggcaccaccgtggtggtcacagaagattgcgggaaccggggaccctccctgagaaccacgacagccagcggcaaactcatcaccgagtggtgctgtcggtcctgcacactgcctccgcttcgctacagaggcgaggacgggtgttggtacggaatggaaattcggcccctgaaggagaaggaagagaatctcgttaactctctggtgaccgccggccatgggcaaatcgataattttagcctgggagtgcttggcatggctctcttcctggaagagatgctgagaacacgcgtcgggaccaaacacgcgatcctcctggtggccgtttcctttgtgacgcttattaccggaaacatgtctttccgggacctgggcagagtcatggtgatggttggcgctacaatgaccgatgacatcgggatgggagtgacatatctcgccctgctggccgcttttaaggtccgccctaccttcgccgcgggccttctgctcagaaaactgacgagcaaggagctcatgatggctacaattgggatcgccctgctttcccagtctaccattcccgaaacaatcctggagctcaccgatgccctggctctgggaatgatggtgcttaaaatcgttcggaatatggaaaagtaccagctggccgtgaccattatggcgatcagctgcgtccctaacgctgtgattctccaaaatgcctggaaggtgtcctgtacaatcctggccgctgtcagcgtttctcccctcctgcttacgtccagccagcagaaagccgactggattcctctggctctcaccatcaagggcctgaaccccacagccatctttctgaccacactttctcgcacctccaaaaagagaagctggccgctgaatgaggcgattatggccgtggggatggtgtctatcctcgcttccagcctgctcaaaaacgacattcctatgacgggacccctggtcgccggcggccttctgacagtgtgctatgttctgaccgggcggtccgctgatctcgaactggagcgcgccgccgacgtgaagtgggaggatcaggctgaaatcagcggatctagccctattctttccatcaccatttctgaggacggcagcatgtccatcaaaaatgaagaggaggaacaaacactgaccatcctcattagaacagggctgctcgtcatctctggagtgttccccgttagcattccgatcacggcggccgcttggtacctgtgggaggtgaagaagcagcgggccggcgtcctttgggatgtgccttctccccctcccgtcgggaaagccgaactggaggacggagcttatcgcattaagcagagaggcatcctgggctacagccagatcggggccggagtgtataaagaaggcacctttcacacaatgtggcatgttaccagaggggcggtgctcatgcaccgcggaaagagaattgagcccagctgggctgatgtcaaaaaggacctgatctcctacggcgggggatggaaacttgagggcgaatggaaagagggcgaagaggtgcaagttctggccctcgaacctgggaagaacccgcgggccgtgcagacaaaacccggactgttcaagaccaatacgggcaccattggggctgtcagcctcgatttttctcctggaacatccggcagccccatcgtggacagaaaagggaaggtggttggactgtacggcaacggcgtcgtgacccgctctggggcctatgtgtccgcgattgctcagacagaaaagagcatcgaggataatcctgaaatcgaggacgatattttccggaaaaagagacttaccatcatggacctgcatcccggagccggcaaaacaaagcgctacctgcctgccattgtccgggaagctatcaaaagagggctccgcacgctgattcttgccccgacccgggtggttgctgccgagatggaagaggcgctgagaggactccccatccgctatcagacccctgccattcgggctgagcacaccggcagagaaatcgtggacctgatgtgtcatgccaccttcacaatgcggctcctgtcccccgtccgcgtgcctaactacaaccttatcattatggatgaggctcactttacggaccccgcctctatcgccgctagagggtatattagcacccgggttgaaatgggcgaggcggccggaatcttcatgacagctaccccgcctggctcccgcgatccctttccccaaagcaatgcccctattatggacgaggaaagagagatccccgaacggtcttggaactccgggcacgagtgggtgacagatttcaagggaaagaccgtctggtttgtgcctagcatcaaagccggcaatgacattgctgcctgcctgagaaagaacgggaaaaaggttatccagctgtctcgcaaaacgttcgatagcgaatacgtgaagacacgggcgaatgactgggattttgtcgtgaccaccgacatttccgagatgggagctaacttcaaggccgagagagtgatcgatccgcgccggtgtatgaaacccgtcattctcacagacggcgaagagagagttatcctggccgggcctatgcccgtgacccattctagcgctgcccagcgccggggcagaatcggacgcaatcctaagaacgaaaatgaccaatatatttacatgggcgagccccttgaaaacgatgaggactgcgcgcactggaaagaggccaagatgctgctcgataatatcaacacaccggaagggattatcccttccatgtttgagcccgaaagagagaaagtggacgctattgatggagaataccggctgcgcggcgaggccagaaagaccttcgtcgacctgatgcggcgcggggatctccctgtgtggcttgcttatagagttgccgctgagggaatcaattacgccgaccggagatggtgttttgatggcattaaaaacaatcagatcctggaagagaacgtggaagtcgagatctggacgaaggagggggaacgcaagaaactgaagccccggtggctcgacgcgagaatttattctgatcctctggcccttaaagagttcaaggagttcgctgccggccgcaaaagcctgacactcaacctgatcaccgagatgggacggctgcccacatttatgacccagaaggctagagacgccctcgataatcttgccgtgctgcatacggctgaagcgggcgggcgggcctacaaccacgctctgtccgagctcccggagaccctggaaacacttctgctcctgaccctgctcgccacagttaccggaggcattttcctttttctgatgagcgggaagggaatcggcaaaatgacactgggcatgtgctgcattatcaccgcctctatcctcctgtggtatgctcagattcaacctcactggatcgccgcgtccattatccttgagttctttctgattgtgctcctgatccccgaacccgagaagcagcgcacgcctcaggacaatcagctgacatacgtcgtgatcgccattctcaccgtcgtggctgccaccatggctaacgaaatggggttccttgagaaaacaaagaaagacctgggactgggcagcatcaccacacaagagtccgaatctaatattctcgatatcgacctgagaccggccagcgcgtggacgctttatgccgttgctaccacatttgtgacccccatgctgcggcattccattgagaactctagcgtgaatgtctccctcacagccatcgctaaccaggccaccgttctgatggggctgggaaagggctggcctctcagcaagatggatattggggtgccccttctggctatcggatgttactctcaggtgaatcctatcacgctgaccgccgcgctcctgcttctggtcgcccactacgctattatcggccccggcctccaggccaaagctacacgcgaagcccaaaagagagccgcggctgggattatgaaaaaccctaccgtggacggaatcacagttattgatctggagccgatcccctatgaccctaagttcgaaaaacagctgggccaggtgatgctccttatcctgtgcgtcacccaggtgctgatgatgcggacgacatgggccctctgtgaggctctgacccttgccacagggcccatttccaccctgtgggagggaaatcctggccgcttttggaacaccacaatcgccgtcagcatggctaatattttcagagggtcttacctcgccggagcgggcctgctgttttccatcatgaagaacacgaccaatacacggcgcggcaccgggaacattggagaaacactcggcgagaagtggaaaagcagacttaatgccctggggaagtctgagttccaaatctataaaaagagcggaatccaggaggtggatcggaccctggctaaagagggcattaagagaggggaaacggaccatcacgccgtttcccgcggatctgctaaactccggtggtttgtggagagaaacatggtcacacccgaaggcaaggtggttgatctgggctgcgggcgcggaggctggagctactattgtgggggacttaagaacgtgcgggaggtcaaaggcctgaccaaagggggaccgggccatgaagaacctatccccatgtccacctacggctggaatctcgtgagactgcagagcggggtggacgttttcttcacaccccctgagaaatgcgataccctgctctgtgacattggagaatcctctcccaaccctacaatcgaggccggccgcacgcttcgggtcctgaatctggtggaaaactggctcaataacaatacccaattttgcattaaggtgctgaacccgtatatgcccagcgtcatcgagaaaatggaaacacttcagagaaagtacgggggagcgctggttcgcaatcctctctcccggaactctacccacgagatgtactgggtgagcaatgccacaggcaacatcgtgtcctctgtcaatatgattagcagaatgctgatcaaccgcttcaccatgaagcacaaaaaggctacgtatgagcccgatgtggacctggggtccggaacccggaatattggcatcgaaagcgagattcctaacctcgacatcattggcaaaagaatcgaaaagatcaaacaggagcatgaaacatcttggcactacgatcaggaccatccctataagacctgggcctaccacgggtcctatgagacaaagcaaaccggaagcgcttcttttatggttaacggcgtggtccgccttctgacaaaaccgtgggatgtggttcctatggtgacccagatggccatgacggacacaacccccttcgggcagcagagagtctttaaggagaaagtggatacccggacacaagaacctaaggagggaacgaaaaagctgatgaagattaccgctgaatggctctggaaagagctgggcaagaaaaagacaccccgcatgtgtaccagagaggagttcacacggaaagtgagatccaatgccgcgcttggggccatctttaccgacgagaacaagtggaaaagcgctcgggaagccgtcgaggattctcgcttctgggaactgattgacagagagcggaatctccacctggagggaaagtgcgaaacatgtgtttacaacatgatgggcaagcgcgagaaaaagctgggcgaatttgggaaagctaagggatccagagccatctggtatatgtggctcggcgcccggttcctggagtttgaagcgcttgggttcctgaatgaggatcattggtttagccgcggaaactccctcagcggcgtggagggggaaggcctgcacagacttggatacattctgcgggacgtgtctaaaaaggagggcggggctatgtacgccgatgacaccgccggatgggacacgcgcatcaccctcgaagatctgaagaatgaggaaatggtcacaaaccatatgaaaggcgagcacaagaaactggctgaggccatcttcaagctcacctatcagaataaagtggttagagtgcagcggcctacaccccgcgggaccgtcatggacattatcagcagacgggatcagcgcggatccggccaagtggggacgtacggcctgaacacattcaccaatatggaagctcagcttattagacagatggagggagaaggcatctttaagtctattcaacatctgacagttaccgaggagatcgccgtgcagaactggctcgcgcgggtcgggagagaacgcctgagccggatggccatctccggagacgattgcgtggttaagccgcttgacgatagattcgcttctgccctgacggctctcaatgacatgggcaaagtgcgcaaggatattcagcagtgggagcctagccgggggtggaacgactggacccaagtccccttttgctcccaccacttccatgaactggtgatgaaagatggaagagtcctggtggttccctgtcgcaatcaggacgagctcatcggccgggccagaatttctcagggggcgggctggagcctgaaggaaacagcctgccttggaaaatcctatgctcagatgtggaccctgatgtactttcaccgccgggatctcagactggccgctaacgccatctgtagcgctgtgccttctcattgggtcccgacatcccgcaccacatggagcattcacgccaagcacgagtggatgaccacggaggacatgcttgcggtgtggaaccgggtgtggatccaagaaaatccctggatggaggacaagacacctgttgaatcttgggaggaagtgccctatctgggcaaaagagaggatcagtggtgcgggtccctcattggactgaccagccgggccacctgggctaagaacatccagacagccatcaatcaggtcagatccctgattggcaacgaggaatacaccgactatatgccttctatgaaacgcttccggagagaggaagaggaagccggggtgctctggtga

SEQ ID NO: 19906 - RNA, 9876 nt, synthetic construct
  misc_feature 1..9876: note = derived and/or modified CDS sequence (opt5) from DENV-2__EU482565__SS-prME
  source 1..9876: mol_type = other RNA
acagccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaatagcacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatatcctgggccggctcattaccgtcaaccctatcgtgacagaaaaggacagcccggttaacattgaggccgaacccccttttggggattcttacatcatcattggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtctttacgagcatcgggaaggctctgcaccaagtgttcggcgccatttacggagcggctttttccggcgtttcttggacaatgaaaatcctgatcggggtgattatcacctggattggaatgaacagccggtccaccagcctttctgtctccctcgtgctggtgggcgttgtcacactgtatctcggggtgatggtgcaggccgacagcggatgtgtcgtgtcttggaagaataaagaactgaagtgcggctccgggatcttcattaccgataacgttcacacatggacggagcagtacaagtttcagcctgaatcccctcccaaacttgcctccgctatccaaaaggcccatgaggaaggcatctgtggaattagatctgtgacccgcctggagaatctcatgtggaaacagatcacacccgagctgaaccacattctgagcgaaaatgaggtcaaacttaccatcatgacaggcgacattaaagggatcatgcaggctggaaagcggtccctcagaccccagcctaccgaactgaaatattcttggaagacgtggggcaaggccaaaatgctgagcaccgagtcccataaccaaacattcctcatcgatgggcccgaaaccgcggagtgccctaatacaaaccgcgcctggaatagcctggaggtggaagactacggatttggcgttttctctaccaacatttggcttaagctgcgggagaaacaggacgtgttttgtgattccaagctcatgagcgctgccatcaaagacaatagagctgtccacgccgatatgggctattggattgaatctgcgctgaacgacacatggaagatggagaaggcctccttcatcgaggtgaaaagctgccactggcccaagtctcataccctgtggagcaatggggttcttgaatccgagatgattatcccgaaaaacttcgctggacctgtgagccagcacaactaccgccccggctatcatacgcagacagccgggccctggcacctcggaaagctggaaatggattttgacttctgtgagggcaccaccgtcgtggtgacagaagattgcgggaatcggggaccttctctgagaaccacgacagcttccggcaaactcattaccgagtggtgctgtcggagctgcacactgccgccccttcgctacagaggcgaggacgggtgttggtacggaatggaaatccggcctctgaaggagaaggaagagaacctcgtcaattccctggttaccgccggccatgggcaaatcgataacttttctctgggagtgcttggcatggccctcttcctggaagagatgctgagaacacgcgtggggaccaaacacgctattctcctggtcgcggtgagctttgttacgcttatcaccggaaatatgtccttccgggacctgggcagagtgatggtcatggtgggcgccacaatgaccgatgacattgggatgggagttacatatctcgctctgctggccgcctttaaggtgcgccccaccttcgctgccggccttctgctcagaaaactgacgtctaaggagctcatgatggcgacaatcgggattgctctgcttagccagtccaccatccctgaaacaatcctggagctcaccgatgccctggccctgggaatgatggtccttaaaattgtgcggaacatggaaaagtaccagctggctgttaccatcatggccatttcttgcgtgcccaatgcggtcatcctccaaaacgcttggaaggtgagctgtacaattctggccgccgtgtccgtcagccctctcctgcttacgtcttcccagcagaaagctgactggatccccctggccctcaccatcaagggcctgaatccgacagctatttttctgaccacacttagccgcacctctaaaaagagatcctggcctctgaacgaggccgttatggcggtggggatggtgagcatcctcgcctcttccctgctcaaaaatgacattcccatgacgggacctctggtcgctggcggccttctgacagtgtgctatgttctgaccgggcggagcgccgatctcgaactggagcgcgctgccgacgtgaagtgggaggatcaggccgaaatctccggaagctctcccattcttagcatcaccatttccgaggacggctctatgagcatcaaaaacgaagaggaggaacacacactgaccatcctcattagaacagggctgctcgtcatctccggagtgttcccggtttctattcctatcacggctgcggcctggtacctgtgggaggtgaagaagcaacgggctggcgtcctttgggatgtgcccagccctccgcccgtcgggaaagccgaactggaggacggagcctatcgcattaagcagagaggcatctttggctactcccagatcggggctggagtgtataaagaaggcaccttccatacaatgtggcacgttaccagaggggccgtgctgatgcatcgcggaaagagaattgagccttcttgggcggatgtcaaaaaggacctcatcagctacggcgggggatggaagctggagggcgaatggaaagagggcgaagaggtgcaggttcttgctctggaaccggggaagaatccccgggccgtgcaaacaaaacctggactctttaagaccaacacgggcaccattggggccgtctccctggatttcagccccggaacatctggctcccctatcgtggacagaaaagggaaggtggttggactctacggcaatggcgtcgtgacccgcagcggggcttatgtgtctgccattgcgcagacagagaagtccatcgaggataaccccgaaatcgaggacgatattttccggaaaaagagactgaccatcatggaccttcaccctggagctggcaaaacaaagcgctacctgccggccattgtccgggaagccatcaaaagagggctgcgcacgctcattctggctcccacccgggtggttgccgctgagatggaagaggcccttagaggactgcctatccgctatcagacacccgcgattcgggccgagcataccggcagagaaatcgtggacctcatgtgtcacgctacctttacaatgcggctgctcagccctgtccgcgtgcccaactacaatctgatcattatggatgaggcccacttcacggacccggcttccatcgccgccagagggtatatttctacccgggttgaaatgggcgaggctgcgggaatctttatgacagccacccctcccggcagccgcgatcccttccctcagtccaacgctcccattatggacgaggaaagagagatccctgaacggagctggaactctgggcatgagtgggtgacagattttaagggaaagaccgtctggttcgtgccgtccatcaaagccggcaacgacattgccgcttgccttagaaagaatgggaaaaaggttatccaactgagccgcaaaacgtttgattctgaatacgtgaagacacgggccaacgactgggatttcgtcgtgaccaccgacattagcgagatgggagcgaattttagagctgagcgcgtgatcgatccccggagatgtatgaagcctgtcattctgacagacggcgaggaacgcgttatcctcgccgggcccatgcctgtgacccactcctctgccgctcagcggagaggccgcatcggaagaaaccccaaaaatgaaaacgaccagtatatttacatgggcgagccgctggaaaatgatgaggactgcgcccattggaaggaggcgaaaatgcttctggataacatcaatacacctgaagggattatccccagcatgttcgagcctgaacgggagaaggtggacgccattgatggagaataccgcctcagaggcgaggctcggaaaacctttgtcgacctgatgcgcagaggggatctgcccgtgtggctcgcctatcgggttgctgccgagggaatcaactacgctgacagacgctggtgtttcgatggcattaagaataaccaaatccttgaagagaacgtggaagtcgagatctggacgaaagagggggaacggaagaagctgaaacctagatggctggacgcccgcatttattccgatcccctcgcgctgaaggagttcaaagaatttgccgctggccggaagtctcttacactgaatctcatcaccgagatgggaagactgccgacattcatgacccagaaagcccgggacgctctggataacctcgccgtgcttcacacggccgaagttggcgggcgcgcttacaatcacgcgctgagcgagctgcctgagaccctcgaaacactgcttctgctcaccctgctggccacagtgaccggaggcatttttctcttccttatgtccgggaagggaatcggcaagatgacactgggcatgtgctgcattatcaccgctagcatcctgctctggtatgcccagattcagccccattggatcgccgcttctattatcctggagtttttccttattgtcctgctcatccccgaacctgagaaacaaagaacgccgcaggacaaccagctgacatacgtggtcatcgccattctgaccgtggttgcggccaccatggctaatgaaatggggtttctcgagaagaccaagaaggaccttggactgggctccatcaccacacaggagcccgaaagcaacattctggatatcgacctccggcctgcctccgcttggacgctgtatgccgtggcgaccacattcgtgacccccatgcttcgccactctattgagaatagctccgtcaacgtttctctgacagccatcgctaatcaagccaccgtgctcatggggctgggaagaggctggcctctgagcaaaatggatattggggtgcccctccttgctatcggatgttactcccaggtcaaccctatcacgctgaccgccgctctgctcctgcttgtggcccattacgcgattatcggcccgggcctgcaggccaaggctacacgggaagcccagaagcgcgctgccgccgggattatgaaaaatcccaccgttgacggaatcacagtgattgatctcgagcctatcccctatgaccctaagtttgaaaaacaactgggccaggtcatgctgctcgtgctttgcgtcacccaggtgctgatgatgagaacgacatgggcgctgtgtgaggctctcaccctggccacagggcccatcagcaccctttgggagggaaacccgggccggttctggaataccacaattgctgtttctatggccaacatctttcgcgggtcctacctggccggagctggcctcctgttcagcattatgaagaatacgaccaacacaagacggggcaccgggaatatcggagaaacactgggcgagaaatggaagtctagactcaacgcccttgggaagtccgaatttcagatttataaaaagagcggaatccaagaggtggatcgcaccctggcgaaagagggcatcaagagaggggaaacggaccaccatgccgtctctagaggaagcgctaaactgcgctggttcgtggagcggaacatggttacacctgaaggcaaggtggtcgatctcggctgcgggagaggaggctggtcctactattgtgggggactgaaaaatgtgcgcgaggtgaagggccttaccaaagggggacccggccacgaggaacccattcctatgtctacctacggctggaacctggttcggctccagagcggggtcgacgtgttctttacaccccctgagaaatgcgataccctgctgtgtgacatcggagaatccagcccgaatcccacaattgaggccggcagaacgctccgcgtgcttaacctggtcgaaaattggctgaacaataacacccagttctgcatcaaggttctcaatccttatatgccctccgtgattgagaaaatggaaacactgcaacggaagtacgggggagctcttgtgagaaaccctctgtctcgcaatagcacccacgagatgtactgggtctccaacgccacaggcaatatcgtgtctagcgttaacatgatctcccggatgctcattaatagatttaccatgaaacataagaaggcgacgtatgagcccgatgtggacctggggtctggaacccgcaacgtcggcatcgaaaacgagattccgaatctggacatcattggcaaaagaatcgaaaagattaaacaggagcacgaaacaagctggcattacgatcaggaccacccttataagacctgggcctaccacgggtcctatgagacaaaacagaccggaagcgcttcttccatggtgaacggcgttgtgcggctccttacaaagccctgggatgtcgtgcctatggtgacccaaatggccatgacggacacaacccccttcgggcagcagcgcgtctttaaggagaaagttgataccagaacacaggaacctaaggagggaacgaaaaagctgatgcggatcaccgctgaatggctgtggaaagagctcggcaagaagaaaacacccagaatgtgtacccgggaggagttcacacgcaaggtgagaagcaatgccgctctgggggccatctttaccgacgagaacaaatggaagtctgcgcgggaagccgtggaggattcccgcttctgggaacttgtcgacagagagcggaatctgcatctcgagggaaaatgcgaaacatgtgtgtacaacatgatgggcaagcgcgagaaaaagctgggcgaatttgggaaggctaaaggaagcagagccatttggtatatgtggctgggcgctcggttcctcgagtttgaagccctggggttccttaatgaggatcactggttttctcgcggaaactccctgagcggcgttgagggggaaggcctccataagctgggatacatccttagagacgtgtccaaaaaggagggcggggccatgtacgcggatgacaccgctggatgggacacgcggattaccctggaagatctcaaaaatgaggaaatggtcacaaaccacatgaagggcgagcataagaaactggccgaggccatcttcaagctgacctatcaaaataaagtggttcgcgtgcagagaccgacacctcgggggaccgtcatggacattatcagccgcaaggatcagagaggatctggccaggtggggacgtacggcctcaacacattcaccaatatggaagctcaactgatccggcagatggagggagaaggcatttttaaaagcatccagagacttacagttaccgaggagattgccgtgcaaaactggctggctcgcgtcgggcgggaaagactctcccgcatggccatctctggagacgattgcgtggtcaagcccctggacgatcggttcgcgagcgcccttacggctctgaatgacatgggcaaggtgagaaaagatattcagcagtgggagccctcccgcgggtggaacgactggacccaggttcctttttgctctcaccacttccatgaactcgtgatgaaggatggacgggtcctggtggtgccgtgtagaaaccaagacgagctgatcggccgcgcccggatcagccagggggctggctggtccctcaaagaaacagcctgcctgggaaagtcttatgcgcagatgtggacccttatgtactttcacagacgcgatctgcggctcgccgctaatgccatttgtagcgctgttccctcccattgggtgcctacaagcagaaccacatggtctatccacgccaaacacgagtggatgaccacggaggacatgctggctgtctggaaccgggtgtggattcaggaaaatccctggatggaggacaagacacctgttgaatcctgggaggaagtgccctatcttggcaagagagaggatcaatggtgcgggagcctgatcggactcacctctcgcgccacctgggcgaaaaacattcagacagccatcaatcaggtccggtccctgattggcaacgaggaatacaccgactatatgcctagcatgaagagattccgcaaagaggaagaggaagctggggtgctgtggtga

SEQ ID NO: 19907 - RNA, 9876 nt, synthetic construct
  misc_feature 1..9876: note = derived and/or modified CDS sequence (opt5) from DENV-2__EU529700__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaagtattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacctggaaaagtaccagctcgctgtgaccattatggccatcagctgcgtccctaatgcggtgattctgcaaaacgcttggaaggtgtcctgtacaatcctcgccgccgtcagcgtttctcccctgcttctgacgtccagccagcagaaagctgactggattcctctcgccctgaccatcaagggcctgaatcccacagctatctttcttaccacactgtctcgcacctccaaaaagagaagctggccgctcaacgaggccgtgatggcggtggggatggtctctattctggcctccagcctcctgaaaaatgacatccctatgacgggaccccttgtggctggcggcctgctgacagtttgctatgtgctcaccgggcggtccgccgatctggaacttgagcgcgctgccgacgtcaagtgggaggatcaggccgaaattagcggatctagccctatcctgtccattaccatctctgaggacggcagcatgtccattaaaaacgaagaggaggaacaaacactcaccatcctgatcagaacagggctcctggtgatttctggagttttccccgtgagcatcccgattacggctgcggcctggtacctttgggaggtcaagaagcagcgggctggcgtgctgtgggatgtcccttctccccctcccgtggggaaagccgaactggaggacggagcctatcgcatcaagcagagaggcatttttggctacagccagatcggggctggagtttataaagaaggcaccttccacacaatgtggcatgtgaccagaggggccgtcctcatgcaccgcggaaagagaatcgagcccagctgggcggatgtgaaaaaggacctgatttcctacggcgggggatggaaacttgagggcgaatggaaagagggcgaagaggttcaagtgctggctctcgaacctgggaagaatccgcgggccgtccagacaaaacccggactgtttaagaccaacacgggcaccatcggggccgtgagcctcgatttctctcctggaacatccggcagccccattgtggacagaaaagggaaggttgtcggactgtacggcaatggcgtggtgacccgctctggggcttatgtctccgccatcgcgcagacagaaaagagcattgaggataaccctgaaatcgaggacgatatcttccggaaaaagagacttaccattatggacctgcatcccggagctggcaaaacaaagcgctacctgcctgccatcgtgcgggaagccattaaaagagggctccgcacgctgatccttgctccgacccgggttgtggccgctgagatggaagaggccctgagaggactccccattcgctatcagacccctgcgatccgggccgagcacaccggcagagaaattgtcgacctgatgtgtcatgctacctttacaatgcggctcctgtcccccgtgcgcgttcctaactacaatcttatcatcatggatgaggcccacttcacggaccccgcttctattgccgccagagggtatatcagcacccgggtggaaatgggcgaggctgcgggaatttttatgacagccaccccgcctggctcccgcgatcccttcccccaaagcaacgctcctatcatggacgaggaaagagagattcccgaacggtcttggaactccgggcacgagtgggtcacagattttaagggaaagaccgtgtggttcgttcctagcatcaaagccggcaacgacatcgccgcttgcctgagaaagaatgggaaaaaggtgattcagctgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctcacagacggcgaggaacgcgtgattctggccgggcctatgcccgtgacccattctagcgccgctcagcggagaggccgcatcggaagaaaccctaaaaatgaaaacgaccaatatatctacatgggcgagccccttgaaaatgatgaggactgcgcccactggaaggaggcgaaaatgctgctcgataacattaatacaccggaagggatcattccttccatgttcgagcccgaacgggagaaggtcgacgccatcgatggagaataccgcctgagaggcgaggctcggaaaacctttgtggacctgatgcgcagaggggatctccctgtttggcttgcctatcgggtggctgccgagggaattaactacgctgacagacgctggtgtttcgatggcatcaagaataaccagattctggaagagaacgtcgaagtggagatctggacgaaagagggggaacggaagaagctgaaacccagatggctcgacgcccgcatctattctgatcctctggcgcttaaggagttcaaagaatttgccgctggccggaagtccctgacactcaatctgattaccgagatgggaagactgcccacattcatgacccagaaagcccgggacgctctcgataaccttgccgttctgcatacggccgaagtgggcgggcgcgcttacaatcacgcgctgtccgagctcccggagaccctggaaacacttctgctcctgaccctgctcgccacagtcaccggaggcatctttcttttcctgatgagcgggaagggaattggcaagatgacactgggcatgtgctgcatcattaccgcttctatcctcctgtggtatgcccagatccaacctcactggattgccgcttccatcattcttgagtttttcctgatcgtgctcctgattcccgaacccgagaaacagagaacgcctcaggacaaccagctgacatacgtcgtgatcgccatcctcaccgttgtggcggccaccatggctaatgaaatggggtttcttgagaagaccaagaaggacctgggactgggcagcattaccacacaagagtccgaatctaacatcctcgatattgacctgcggccggccagcgcttggacgctttatgccgtggcgaccacattcgtcacccccatgctgcgccattccatcgaaaattctagcgttaacgtgtccctcacagccattgctaatcaggccaccgtgctgatggggctgggaagaggctggcctctcagcaaaatggatatcggggtcccccttctggctattggatgttactctcaggtgaaccctatcacgctgaccgccgctctcctgcttctggttgcccactacgcgatcattggccccggcctccaggccaaggctacacgggaagcccaaaagcgcgctgccgccgggatcatgaaaaatcctaccgtggacggaattacagtcatcgatctggagccgattccctatgaccctaagtttgaaaaacagctgggccaggtgatgctccttgtcctgtgcgtgacccaggttctgatgatgagaacgacatgggcgctctgtgaggctctgacccttgccacagggcccatctccaccctgtgggagggaaaccctggccggttctggaataccacaatcgctgtgagcatggccaacatttttcgcgggtcttacctcgccggagctggcctgctgttctccatcatgaagaatacgaccaacacaagacggggcaccgggaatattggagaaacactcggcgagaaatggaaaagcagacttaacgccctggggaagtctgaatttcaaatctataaaaagagcggcattcaggaggtcgatcgcaccctggcgaaagagggcatcaagagaggggaaacggaccatcacgccgtgtccagaggatctgctaaactccgctggttcgttgagcggaacatggtgacacccgaaggcaaggtcgtggatctgggctgcgggagaggaggctggagctactattgtgggggacttaaaaatgtgcgcgaggttaagggcctgaccaaagggggaccgggccatgaggagcctatccccatgtccacctacggctggaacctcgtccggctgcagagcggggtggacgtgttctttacaccccctgagaaatgcgataccctgctctgtgacattggagaatcctctcccaatcctacaatcgaggccggcagaacgcttcgcgtcctgaacctggttgaaaattggctcaacaataacacccaattctgcattaaggtgctgaatccgtatatgcccagcgtgatcgagaaaatggaaacacttcagcggaagtacgggggagctctggtcagaaaccctctctcccgcaattctacccacgagatgtactgggtgagcaacgccacaggcaatattgtttcctctgtgaacatgatcagccggatgctgatcaatagatttaccatgaaacacaagaaggcgacgtatgagcccgatgtcgacctggggtccggaacccgcaacattggcatcgaaaacgagattcctaatctcgacatcattggcaaaagaatcgaaaagattaaacaggagcatgaaacaagctggcactacgatcaggaccatccctataagacctgggcctaccacgggtcttatgagacaaaacaaaccggatccgctagctctatggtgaacggcgttgtgcggcttctgacaaagccgtgggatgtcgtgcctatggtgacccagatggccatgacggacacaacccccttcgggcagcagcgcgtctttaaggagaaagttgataccagaacacaagaacctaaggagggaacgaaaaagctgatgcggatcaccgctgaatggctctggaaagagctgggcaagaagaaaacacccagaatgtgtacccgggaggagttcacacgcaaggtgagatccaatgccgctcttggggccatctttaccgacgagaacaaatggaaaagcgcgcgggaagccgtggaggattctcgcttctgggaactggtcgacagagagcggaatctccacctggagggaaaatgcgaaacatgtgtgtacaacatgatgggcaagcgcgagaaaaagctgggcgaatttgggaaggctaaaggatccagagccatttggtatatgtggctcggcgctcggttcctggagtttgaagcccttgggttcctgaatgaggatcattggtttagccgcggaaactccctcagcggcgttgagggggaaggcctgcacaaacttggatacatcctgagagacgtgtctaaaaaggagggcggggccatgtacgcggatgacaccgctggatgggacacgcggattaccctcgaagatctgaaaaatgaggaaatggtcacaaaccatatgaagggcgagcacaagaaactggccgaggccatcttcaagctcacctatcagaataaagtggttcgcgtgcagagacctacaccccgggggaccgtcatggacattatcagccgcaaggatcagagaggatccggccaagtggggacgtacggcctgaacacattcaccaatatggaagctcagcttatccggcagatggagggagaaggcatttttaaatctatccaacatctgacagttaccgaggagattgccgtgcagaactggctcgctagagtcgggcgcgaacggctgagcagaatggccatctccggagacgattgcgtggtcaagccgcttgacgatcgcttcgcgtctgccctgacggctctcaatgacatgggcaaggtgcggaaagatattcagcagtgggagcctagcagagggtggaacgactggacccaagttcccttttgctcccaccacttccatgaactggtgatgaaggatggacgcgtcctggtggtgccctgtcggaaccaggacgagctcatcggcagagcccgcatctctcagggggctggctggagcctgaaagaaacagcctgccttggaaagtcctatgcgcagatgtggaccctgatgtactttcaccggagagatctccgcctggccgctaatgccatttgtagcgctgttccttctcattgggtgccgacatcccggaccacatggagcatccacgccaaacacgagtggatgaccacggaggacatgcttgctgtctggaacagagtgtggattcaagaaaatccctggatggaggacaagacacctgttgaatcttgggaggaagtgccctatctgggcaagcgggaggatcagtggtgcgggtccctcatcggactgaccagcagagccacctgggcgaaaaacattcagacagccatcaatcaggtccgctccctgattggcaacgaggaatacaccgactatatgccttctatgaagcggttcagaaaagaggaagaggaagctggggtgctctggtga

SEQ ID NO: 19908 - RNA, 9876 nt, synthetic construct
  misc_feature 1..9876: note = derived and/or modified CDS sequence (opt5) from DENV-2__EU529701__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatggatctcggagaactgtgtgaggacacaatcacctacaaatgcccgcttctgcgccaaaatgaacccgaggatattgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggatcctgcgccatcccgggttcacaattatggccgctatcctcgcctacaccattggaaccacacactttcagagagctctgatcttcattcttctgacggccgtggcgcctagcatgaccatgcggtgcatcggcatttccaaccgcgattttgtcgaaggggtgtctggaggcagctgggttgacatcgtgctcgagcacgggtcctgtgtcacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaagggggaatcgtgacatgcgccatgtttacgtgcaaaaagaatatggaaggcaaagtcgttcagcctgagaacctggaatacaccattgtgatcacaccccacagcggggaggagcatgcggtgggaaatgacaccggcaagcacggcaaagaaattaagatcacacctcagtcttccatcaccgaggccgaacttacggggtatggaaccgtcacaatggagtgtagcccccggaccggcctggatttcaacgaaatggtgctcctgcaaatggaggacaaggcttggcttgttcaccgccagtggtttctggatctcccgctgccttggctgcccggggccgacacacagggatctaattggattcagaaggagaccctcgtgacgttcaagaaccctcatgctaaaaagcaagacgtcgtggttctgggctcccaggaaggggccatgcacacagcccttaccggcgctacagagatccagatgagctccggaaatctgctctttaccggccatctgaaatgcagacttcggatggataagctgcaactcaaagggatgtcttacagcatgtgtaccggaaagttcaagattgtgaaagaaatcgcggagacacagcacggcacgattgtcatcagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcattggcgtcgagcccggacagctgaaacttaattggttcaagaagggctccagcatcgggcaaatgtttgagaccacaatgagaggagctaaacgcatggccatcctgggcgacaccgcctgggatttcgggtctctcggaggcgtgtttacgagcgttgggaaggctctgcaccaggtgttcggcgccatttacggagcggctttttccggcgtctcttggacaatgaaaatcttcattggggtgatcattacctggatcggaatgaacagccggtccaccagcctgtctgtgtcccttgttctcgtcggcgtggtgacactgtatctgggggccatggtccaggccgacagcggatgtgtggtttcttggaagaataaagaactcaagtgcggctccgggatctttattaccgataacgtgcacacatggacggagcagtacaagttccaacctgaaagcccctccaaactggcttctgccatccagaaggctcatgaggaaggcatttgtggaatcagaagcgtcacccgccttgagaatctgatgtggaaacagattacaccggagctcaaccacatcctgtccgaaaatgaggtgaagctgaccatcatgacaggcgacattaaagggatcatgcaggccggaaagcggtctcttagacctcaacccaccgaactcaaatatagctggaagacgtggggcaaggcgaaaatgctgtccaccgagagccataaccagacatttctgattgatgggcctgaaaccgccgagtgccccaatacaaaccgcgcttggaactctctcgaggttgaagactacggattcggcgtgtttaccacaaacatctggctgaaacttcgggagaaacaggacgtcttctgtgattccaagctgatgagcgccgctattaaagacaatagagccgtgcacgcggatatgggctattggatcgaatctgccctcaacgacacctggaagatggagaaggcttccttcatcgaggttaaaagctgccactggcctaagtctcatacgctgtggagcaatggggtgctggaatccgagatgattatccccaaaaactttgccggaccggtcagccagcacaactaccgccctggctatcatacacaaaccgctgggccctggcaccttggaaagctcgaaatggatttcgacttttgtgagggcaccacagtggtggtcaccgaagattgcgggaatcggggaccctctctgagaacgacaaccgcctccggcaaactgattacagagtggtgctgtcggagctgcaccctccctccgctgcgctacagaggcgaggacgggtgttggtacggaatggaaatccggccccttaaggagaaggaagagaacctggttaattccctcgtgacagccggccatgggcagattgataacttctctctgggagtgctgggcatggctctttttctcgaagagatgctgagaacccgcgtcgggacgaaacacgcgatcctgctcgtggccgttagcttcgtgaccctgattacaggaaatatgtcctttcgggaccttggcagagtcatggtgatggttggcgctaccatgacagatgacatcgggatgggagtgacctatctggccctcctggccgctttcaaggtccgccctacgtttgccgcgggcctgcttctgagaaaactcacatctaaggagctgatgatggctaccatcgggattgccctcctgagccagtccacaatccccgaaaccattcttgagctgaccgatgccctcgctctgggaatgatggtgctgaaaatcgttcggaacatggaaaagtaccaacttgccgtgacaattatggcgatctcttgcgtccctaatgctgtgatcctgcagaacgcctggaaggtgagctgtacgattctcgccgctgtctccgttagccccctgctcctgacctcttcccagcagaaagccgactggatccctcttgctctgacaattaagggcctcaatcccaccgccatcttcctgacaaccctgagccgcacgtctaaaaagagatcctggccgcttaacgaggcgattatggccgtggggatggtgagcatcctggcttcttccctcctgaaaaatgacatccctatgacaggacccctcgtcgccggcggcctgcttaccgtgtgctatgttctgaccgggcggagcgctgatctggaactcgagcgcgccgccgacgtgaagtgggaggatcaagctgaaatttccggaagctctcctatcctgagcattacaatctccgaggacggctctatgagcattaaaaacgaagaggaggaacagacccttacaatcctgattagaacggggctcctggtcatctccggagtgtttcccgtttctatcccgattaccgcggccgcttggtacctctgggaggtgaagaagcagcgggccggcgtcctgtgggatgtgccttctccccctcccgtcgggaaagccgaacttgaggacggagcttatcgcatcaagcagagaggcattctgggctactcccaaatcggggccggagtgtataaagaaggcacattccacaccatgtggcatgttacaagaggggcggtgctgatgcaccgcggaaagagaattgagccctcctgggctgatgtcaaaaaggacctcatcagctacggcgggggatggaagctggagggcgaatggaaagagggcgaagaggtgcaggttcttgccctggaacctgggaagaatccgcgggccgtgcagaccaaacccggactctttaagacgaacaccggcacaatcggggctgtctccctggatttcagccctggaacctctggctcccccattgtggacagaaaagggaaggtggttggactctacggcaatggcgtcgtgacacgcagcggggcctatgtgtctgcgatcgctcagaccgagaagtccattgaggataaccctgaaatcgaggacgatattttccggaaaaagagactgacaatcatggaccttcatcccggagccggcaaaacgaagcgctacctgcctgccatcgtccgggaagctattaaaagagggctgcgcaccctcatcctggccccgacacgggtggttgctgccgagatggaagaggcgcttagaggactgcccattcgctatcaaacccctgccatccgggctgagcacaccggcagagaaattgtggacctcatgtgtcatgccacatttacgatgcggctgctcagccccgtccgcgtgcctaactacaatctgatcattatggatgaggctcacttcaccgaccccgcctccatcgccgctagagggtatatctctacacgggttgaaatgggcgaggcggccggaatttttatgaccgctacaccgcctggcagccgcgatcccttcccccagtccaacgcccctatcatggacgaggaaagagagattcccgaacggagctggaactctgggcacgagtgggtgaccgattttaagggaaagacggtctggttcgtgccttccatcaaagccggcaacgacattgctgcctgccttagaaagaatgggaaaaaggttatccagctgagccgcaaaacatttgattctgaatacgtgaagacccgggcgaacgactgggatttcgtcgtgaccacagacatcagcgagatgggagctaattttaaggccgagagagtgattgatccgcgccggtgtatgaaacccgtcatcctgaccgacggcgaagagagagttattctcgccgggcctatgcccgtgacacattcctctgctgcccaacgccggggcagaatcggacgcaaccctaagaatgaaaacgaccagtatatttacatgggcgagcccctggaaaatgatgaggactgcgcgcactggaaagaggccaagatgcttctggataacatcaataccccggaagggatcattcctagcatgttcgagcccgaaagagagaaagtggacgctatcgatggagaataccggctccgcggcgaggccagaaagacgtttgtcgacctgatgcggcgcggggatctgcctgtgtggctcgcttatagagttgccgctgagggaattaactacgccgaccggagatggtgtttcgatggcatcaaaaataaccagattcttgaagagaacgtggaagtcgagatctggacaaaggagggggaacgcaagaaactgaagccccggtggctggacgcgagaatttattccgatcctctcgccctgaaagagttcaaggaatttgctgccggccgcaaatctcttaccctgaatctcatcacagagatgggacggctgcccaccttcatgacgcagaaggctagagacgccctggataacctcgccgtgcttcataccgctgaagcgggcgggaaggcctacaatcacgctctgagcgagctgccggagacactcgaaaccctgcttctgctcacactgctggccaccgttacaggaggcatctttctcttccttatgtccgggaaaggaattggcaagatgaccctgggcatgtgctgcatcattacggccagcatcctgctctggtatgctcaaattcagcctcactggatcgccgcgtctatcattctggagtttttccttatcgtgctgctcattcccgaacccgagaaacagcggacacctcaggacaaccaactgacctacgtcgtgatcgccattctgaccgtcgtggctgccacaatggctaatgaaatggggtttctcgagaagaccaaaaaggaccttggactgggctccatcacaacgcaggagagcgaatccaacatcctggatattgacctccgcccggcctctgcgtggaccctgtatgccgttgctacaaccttcgtgacacccatgcttagacatagcatcgaaaatagctctgtgaacgtcagcctgaccgccattgctaatcaggccacggttctcatggggctgggaaagggctggcctctgtccaaaatggatatcggggtgcccctccttgctattggatgttacagccaggtgaaccctatcaccctgacagccgcgctgctcctgcttgtcgcccactacgctattatcggccccggcctgcaagccaaggctacccgggaagcccagaaacgcgccgcggctgggatcatgaagaatcctacagtggacggaattaccgttatcgatctcgagccgattccctatgaccctaaatttgaaaagcagctgggccaggtgatgctgctcatcctttgcgtcacgcaagtgctgatgatgagaacaacctgggccctgtgtgaggctctcacactggccaccgggcccatttctaccctttgggagggaaaccctggccggttctggaatacaacgatcgccgtctccatggctaacatctttcgcgggagctacctggccggagcgggcctcctgttctctattatgaagaataccacaaacaccagacggggcacagggaatatcggagaaaccctgggcgagaaatggaagtcccgcctcaacgcccttgggaaaagcgaatttcagatttataagaaatctggaatccaggaggtggatagaacgctggctaaggagggcattaaaagaggggaaacagaccatcacgccgttagcagaggatccgctaagctgcgctggttcgtggagcggaacatggtcacccccgaaggcaaggtggttgatctcggctgcgggagaggaggctggtcttactattgtgggggactgaaaaatgtgcgcgaggtcaagggccttaccaaagggggaccgggccatgaggaacctatccccatgagcacatacggctggaacctggtgcggctccaatccggggtggacgttttctttacaccccctgagaagtgcgataccctgctgtgtgacatcggagaaagctcccccaatcctacgattgaggccggcagaaccctccgcgtccttaacctggtggaaaattggctgaacaataacacacagttctgcatcaaagtgctcaatccgtatatgccctctgtcattgagaagatggaaaccctgcagcggaagtacgggggagcgcttgttagaaaccctctgagccgcaattccacacacgagatgtactgggtgtctaacgccaccggcaatatcgtgagctccgtcaacatgatttctcggatgctcatcaatagatttacgatgaaacacaagaaagctacctatgagcccgatgtggacctggggagcggaacacgcaacatcggcattgaatccgagatccctaacctggacattatcggcaagcggattgagaagatcaagcaggagcatgaaaccagctggcactacgatcaagaccatccctataagacatgggcctaccacgggtcttatgagaccaaacagacaggatccgctagctctatggttaatggcgtggtcagactccttaccaagccgtgggatgtggttcctatggtgacgcagatggccatgacagacaccacccccttcgggcagcaacgcgtctttaaagagaaggtggatacaagaacgcaggaacctaaagagggaaccaagaagctgatgaaaattacagctgaatggctgtggaaggagctcggcaaaaagaaaacaccccggatgtgtacacgcgaggagttcaccagaaaggtgcggtccaacgccgcgctgggggccatctttacagacgagaataaatggaaaagcgctagagaagccgtcgaggattctcggttctgggaacttgttgaccgcgagagaaacctgcacctcgagggaaagtgcgaaacctgtgtgtacaatatgatgggcaaacgggagaagaaactgggcgaatttgggaaggctaaaggatcccgcgccatctggtatatgtggctgggcgccagattcctcgagtttgaagcgctggggttccttaacgaggatcattggtttagccggggaaattccctgagcggcgtggagggggaaggcctccaccgcctgggatacattcttagagacgtctctaagaaggagggcggggctatgtacgccgatgacacggccggatgggacacccggatcacactggaagatctcaaaaacgaggaaatggtgaccaatcatatgaagggcgagcacaaaaagctggctgaggccattttcaaactgacatatcagaacaaggttgtgcgcgtccagagacctacaccccgggggacggtgatggacatcattagccgcagagatcaacggggatccggccaggttgggacatacggcctcaataccttcacaaacatggaagctcagctgatccgccaaatggagggagaaggcatctttaagtctattcagcatcttaccgtgacggaggagatcgccgtccagaattggctggcgagagtggggcgggaaagactcagccgcatggccatttccggagacgattgcgttgtgaaaccgctggacgatcggttcgcttctgcccttaccgctctgaacgacatgggcaaggtcagaaaagatatccagcaatgggagcctagccgcgggtggaatgactggacacaggtgcccttttgctcccaccacttccatgaactcgtcatgaaggatggacgggtgctggttgtgccctgtagaaaccaggacgagctgattggccgcgcccggatctctcagggggcgggctggagcctcaaagaaaccgcctgcctgggaaagtcctatgctcaaatgtggacacttatgtactttcacagacgcgatctgcggctcgccgctaacgccatctgtagcgctgtcccttctcattgggtgccgacctccagaacaacctggagcattcacgccaagcacgagtggatgacgacagaggacatgctggcggtgtggaatcgcgtttggatccaggaaaacccctggatggaggacaaaacccctgtggaatcttgggaggaagtcccctatcttggcaagcgggaggatcagtggtgcgggtccctgattggactcaccagcagagccacatgggctaaaaatatccagaccgccattaaccaagtgcggtccctgatcggcaatgaggaatacacagactatatgccttctatgaagagattccgccgggaggaagaggaagccggggttctgtggtga

SEQ ID NO: 19909 - RNA, 9876 nt, synthetic construct
  misc_feature 1..9876: note = derived and/or modified CDS sequence (opt5) from DENV-2__EU569704__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatcgatctcggagaactgtgtgaggacaccattacctacaaatgcccgcttctgcgccaaaatgaacccgaggatatcgactgttggtgcaattccacgtctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttctgcctgagaaccttgaatacaccatcgtgattacaccccacagcggggaggagcatgcggtgggaaatgacaccggcaagcacggcaaagaaatcaagatcacacctcagtcttccattaccgaggccgaactgacggggtatggaaccgtcacaatggagtgtagcccccggaccggcctcgatttcaacgaaatggtgctgcttcagatggaggacaaggcttggctggttcaccgccaatggtttctcgatctgccgctgccttggctccccggggccgacacacagggatctaattggatccagaaggagaccctggtgacgttcaagaaccctcatgctaaaaagcaggacgtcgtggttcttggctcccaagaaggggccatgcacacagccctgaccggcgctacagagattcagatgagctccggaaatctcctgtttaccggccatcttaaatgcagactgcggatggataagctccagctgaaagggatgtcttacagcatgtgtaccggaaagttcaagatcgtgaaagaaattgcggagacacaacacggcacgatcgtcatcagagtgcagtatgagggggacggatccccctgcaagattcccttcgaaatcatggatctggagaaacgccatgtcctcggccggctgattaccgtgaaccctatcgttacagaaaaggacagcccggtgaacattgaggccgaacccccttttggggattcttacatcattatcggcgtcgagcccggacagcttaaactgaattggttcaagaagggctccagcatcgggcagatgtttgagaccacaatgagaggagctaaacgcatggccattctcggcgacaccgcctgggatttcgggtctctgggaggcgtgtttacgagcatcgggaaggctctgcaccaagttttcggcgccatttacggagcggctttttccggcgtgtcttggacaatgaaaatccttattggggtcatcatcacctggattggaatgaacagccggtccaccagcctctctgtgtccctggtgctggttggcgtcgtgacactctatctgggggccatggtgcaggccgacagcggatgtgtcgtgtcttggaagaataaagaacttaagtgcggctccgggatcttcattaccgataacgttcacacatggacggagcagtacaagtttcagcctgaaagcccctccaaactggcttctgccatccaaaaggctcatgaggaaggcatttgtggaatcagaagcgtgacccgcctcgagaatctgatgtggaaacagatcacaccggagctgaaccacattctttccgaaaatgaggtcaagctcaccatcatgacaggcgacattaaagggatcatgcaggccggaaagcggtctctgagacctcagcccaccgaactgaaatatagctggaagacgtggggcaaggcgaaaatgctctccaccgagagccataaccaaacattcctgattgatgggcctgaaaccgccgagtgccccaatacaaaccgcgcttggaactctcttgaggtggaagactacggatttggcgttttcaccacaaacatctggctgaagctccgggagaaacaggacgtgttttgtgattccaagctgatgagcgccgctatcaaagacaatagagccgtccacgcggatatgggctattggattgaatctgccctgaacgacacctggaagatggagaaggcttccttcatcgaggtgaaaagctgccactggcctaagtctcatacgctttggagcaatggggttctcgaatccgagatgattatccccaaaaacttcgccggaccggtgagccagcacaactaccgccctggctatcatacacagaccgctgggccctggcacctgggaaagctggaaatggattttgacttctgtgagggcaccacagtcgtggtgaccgaagattgcgggaatcggggaccctctctcagaacgacaaccgcctccggcaaactgattacagagtggtgctgtcggagctgcacccttcctccgctgcgctacagaggcgaggacgggtgttggtacggaatggaaatccggcccctcaaggagaaggaagagaacctggtcaattccctggttacagccggccatgggcaaattgataacttttctcttggaatcctcggcatggctctgttcctggaagagatgctcagaacccgcgtggggacgaaacacgcgatcctgcttgtggccgtcagctttgtgaccctgattacaggaaatatgtccttccgggacctcggcagagttatggtgatggtcggcgctaccatgacagatgacatcgggatgggagtgacctatctggccctgcttgccgcttttaaggttcgccctacgttcgccgcgggcctgctcctgagaaaactcacatctaaggagctgatgatggctaccattgggatcgcccttctgagccagtccacaattcccgaaaccatcctcgagctgaccgatgccctggctcttggaatgatggtgctgaaaatcgtccggaacatggaaaagtaccagctcgccgtgacaattatggcgatctcttgcgttcctaatgctgtgattctgcaaaacgcctggaaggtcagctgtacgatcctcgccgctgtgtccgtgagccccctgcttctgacctcttcccagcagaaagccgactggattcctctcgctctgacaatcaagggcctgaatcccaccgccatctttcttacaaccctgagccgcacgtctaaaaagagatcctggccgctcaacgaggcgattatggccgtcgggatggttagcatcctggcttcttccctcctgaaaaatgacattcctatgacaggaccccttgtggccggcggcctgctgaccgtgtgctatgtcctcaccgggcggagcgctgatctggaacttgagcgcgccgccgacgtgaagtgggaggatcaggctgaaatctccggaagctctcctattctgagcatcacaatttccgaggacggctctatgagcatcaaaaacgaagaggaggaacaaaccctcacaatcctgattagaacggggctcctggttatctccggagtgttccccgtctctattccgatcaccgcggccgcttggtacctttgggaggtgaagaagcagcgggccggcgttctgtgggatgtgccttctccccctcccgtcgggaaagccgaactggaggacggagcttatcgcattaagcagagaggcatcctcggctactcccagatcggggccggagtgtataaagaaggcacatttcacaccatgtggcatgtcacaagaggggcggtgctgatgcaccgcggaaagagaattgagccctcctgggctgatgttaaaaaggaccttatcagctacggcgggggatggaagctggagggcgaatggaaagagggcgaagaggtgcaagtcctcgccctggaacctgggaagaatccgcgggccgtgcagaccaaacccggactcttcaagacgaacaccggcacaattggggctgtttccctggattttagccctggaacctctggctcccccatcgtggacagaaaagggaaggtcgtgggactttacggcaatggcgtggttacacgcagcggggcctatgtctctgcgattgctcagaccgagaagtccatcgaggataaccctgaaatcgaggacgatattttccggaaaaagagactgacaatcatggacctgcatcccggagccggcaaaacgaagcgctacctccctgccattgtgcgggaagctatcaaaagagggctgcgcacccttattctggccccgacacgggtggtcgctgccgagatggaagaggcgctcagaggactgcccatccgctatcagacccctgccattcgggctgagcacaccggcagagaaatcgtggacctcatgtgtcatgccacattcacgatgcggctgcttagccccgttcgcgtgcctaactacaatctgatcattatggatgaggctcactttaccgaccccgcctccatcgccgctagagggtatatttctacacgggtcgaaatgggcgaggcggccggaatcttcatgaccgctacaccgcctggcagccgcgatccctttccccaatccaacgcccctattatggacgaggaaagagagatccccgaacggagctggaactctgggcacgagtgggtgaccgatttcaagggaaagacggtttggtttgtgccttccatcaaagccggcaacgacattgctgcctgcctgagaaagaatgggaaaaaggtcatccagctcagccgcaaaacattcgattctgaatacgtgaagacccgggcgaacgactgggattttgttgtgaccacagacattagcgagatgggagctaatttcaaggccgagagagtcatcgatccgcgccggtgtatgaaacccgtgattctgaccgacggcgaagagagagtgatccttgccgggcctatgcccgtcacacattcctctgctgcccagcgccggggcagaatcggacgcaaccctaagaatgaaaacgaccaatatatttacatgggcgagcccctggaaaatgatgaggactgcgcgcactggaaagaggccaagatgctcctggataacatcaataccccggaagggattatccctagcatgtttgagcccgaaagagagaaagttgacgctattgatggagaataccggctgcgcggcgaggccagaaagacgttcgtggacctcatgcggcgcggggatcttcctgtgtggctggcttatagagtcgccgctgagggaatcaactacgccgaccggagatggtgttttgatggcattaaaaataaccagatcctggaagagaacgtggaagttgagatctggacaaaggagggggaacgcaagaaactcaagccccggtggctggacgcgagaatttattccgatcctcttgccctgaaagagttcaaggagttcgctgccggccgcaaatctctcaccctgaatctgatcacagagatgggacggctccccacctttatgacgcagaaggctagagacgcccttgataacctggccgtgctgcataccgctgaagcgggcgggcgggcctacaatcacgctctcagcgagctgccggagacacttgaaaccctgctcctgctgacactccttgccaccgtcacaggaggcattttcctgtttctgatgtccgggaagggaatcggcaaaatgaccctcggcatgtgctgcattatcacggccagcatcctgctttggtatgctcagattcaacctcactggatcgccgcgtctattatcctggagttctttctcattgtgctgctgatccccgaacccgagaagcagcgcacacctcaggacaaccagctcacctacgttgtgatcgccattcttaccgtcgtggctgccacaatggctaatgaaatggggttcctggagaaaaccaagaaagacctgggactcggctccatcacaacgcaagagagcgaatccaacattctggatatcgaccttagaccggcctctgcgtggaccctgtatgccgtcgctacaacctttgtgacacccatgctccggcatagcattgaaaatagctctgttaacgtgagcctgaccgccatcgctaatcaggccacggtgctgatggggctcggaaagggctggcctctttccaagatggatattggggtccccctgctggctatcggatgttacagccaggttaaccctatcaccctcacagccgcgctgcttctgctcgtggcccactacgctattatcggccccggcctgcaggccaaagctacccgcgaagcccaaaagagagccgcggctgggattatgaaaaatcctacagtggacggaatcaccgtcattgatctggagccgatcccctatgaccctaagttcgaaaaacagctcggccaggtgatgcttctgatcctgtgcgttacacaggtgctcatgatgcggacaacctgggccctgtgtgaggctcttacactggccaccgggcccatttctaccctctgggagggaaaccctggccgcttttggaatacaacgatcgccgtctccatggctaacattttcagagggagctacctggccggagcgggcctgctcttttctatcatgaagaataccacaaacacccggcgcggcacagggaatattggagaaacccttggcgagaagtggaaatccagactgaacgccctgggaaagagcgagttccaaatctataaaaagtctggaatccaggaggtggatcggacgctcgctaaagagggcattaagagaggggaaacagaccatcacgccgtcagccgcggatccgctaaactgcggtggtttgtggagagaaacatggttacccccgaaggcaaggtggtcgatcttggctgcgggcgcggaggctggtcttactattgtgggggactgaagaatgtgcgggaggttaaaggcctcaccaaagggggaccgggccatgaagaacctatccccatgagcacatacggctggaacctggtgagactgcagtccggggtcgacgtgttcttcacaccccctgagaaatgcgatacactcctttgtgacattggagaaagctcccccaatcctacgatcgaggccggccgcaccctgcgggtgctgaacctcgttgaaaattggctgaacaataacacacaattttgcattaaggtccttaatccgtatatgccctctgtgatcgagaaaatggaaaccctgcagagaaagtacgggggagcgctcgtgcgcaaccctctgagcagaaattccacacacgagatgtactgggtctctaacgccaccggcaatatcgttagctccgtgaacatgatttctagaatgctgatcaatcgcttcacgatgaagcacaaaaaggctacctatgagcccgatgtggacctcgggagcggaacacggaacattggcatcgaatccgagattcctaaccttgacatcattggcaaaagaatcgaaaagatcaaacaggagcatgaaaccagctggcactacgatcaggaccatccctataagacatgggcctaccacgggtcttatgagaccaagcaaacaggatccgctagctctatggtcaatggcgtggttcgcctgctgaccaaaccgtgggatgtggtccctatggtgacgcagatggccatgacagacaccaccccctttgggcagcagagagttttcaaggagaaagtggatacacggacgcaagaacctaaggagggaaccaaaaagctcatgaagattacagctgaatggctgtggaaagagcttggcaagaaaaagacaccccgcatgtgtacaagagaggaatttacccggaaagtcagatccaacgccgcgctgggggccatcttcacagacgagaataagtggaaaagcgctcgggaagccgtggaggattctcgcttttgggaactcattgacagagagcggaacctgcacctggagggaaagtgcgaaacctgtgtgtacaatatgatgggcaagcgcgagaaaaagctcggcgagttcgggaaagctaagggatccagagccatctggtatatgtggctgggcgcccggtttcttgagttcgaagcgctggggtttctcaacgaggatcattggttcagccgcggaaattccctgagcggcgtcgagggggaaggccttcacagactgggatacattctccgggacgtttctaaaaaggagggcggggctatgtacgccgatgacacggccggatgggacacccgcatcacactggaagatctgaagaacgaggaaatggtgaccaatcatatgaaaggcgagcacaagaaactcgctgaggccatctttaagctgacatatcagaacaaagtggtcagagtgcagcggcctacaccccgcgggacggttatggacattatcagcagacgggatcagcgcggatccggccaagtggggacatacggccttaataccttcacaaacatggaagctcagctgattagacagatggagggagaaggcatcttcaagtctattcaacatctcaccgtcacggaggagatcgccgtgcagaattggctggcgcgggttgggagagaacgccttagccggatggccatctccggagacgattgcgtggtcaagccgctggacgatagatttgcttctgccctcaccgctctgaacgacatgggcaaagtgcgcaaggatattcagcagtgggagcctagccgggggtggaatgactggacacaagttcccttctgctcccaccactttcatgaactggtgatgaaagatggaagagtcctcgtggtcccctgtcgcaaccaggacgagctgatcggccgggccagaatttctcagggggcgggctggagccttaaggaaaccgcctgcctgggaaaatcctatgctcagatgtggacactcatgtacttccaccgccgggatctgagacttgccgctaacgccatctgtagcgctgtgccttctcattgggttccgacctcccgcacaacctggagcattcacgccaagcacgagtggatgacgacagaggacatgctggcggtgtggaatcgggtctggatccaagaaaacccctggatggaggacaagacccctgtggaatcttgggaggaagtgccctatctcggcaaaagagaggatcagtggtgcgggtccctgattggactgaccagccgggccacatgggctaagaatatccagaccgccatcaaccaggttagatccctcattggcaatgaggaatacacagactatatgccttctatgaaacgctttcggagagaggaagaggaagccggggtgctgtggtga

SEQ ID NO: 19910 - RNA, 9876 nt, synthetic construct
  misc_feature 1..9876: note = derived and/or modified CDS sequence (opt5) from DENV-2__EU482568__SS-prME
  source 1..9876: mol_type = other RNA
accgccggagtgatcattatgctgatccccacagctatggccttccacctcacgaccagaaatggggaacctcatatgattgtgggacggcaggaaaagggaaaaagcctgctttttaagaccgaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttctgcctgagaaccttgaatacaccatcgtgattacaccccacagcggggaggagcatgcggtgggaaatgacaccggcaagcacggcaaagaaatcaagatcacacctcagtcttccattaccgaggccgaactgacggggtatggaaccgtcacaatggagtgtagcccccggaccggcctcgatttcaacgaaatggtgctgcttcagatggaggacaaggcttggctggttcaccgccaatggtttctcgatctgccgctgccttggctccccggggccgacacacagggatctaattggatccagaaggagaccctggtgacgttcaagaaccctcatgctaaaaagcaggacgtcgtggttcttggctcccaagaaggggccatgcacacagccctgaccggcgctacagagattcagatgagctccggaaatctcctgtttaccggccatcttaaatgcagactgcggatggataagctccagctgaaagggatgtcttacagcatgtgtaccggaaagttcaagatcgtgaaagaaattgcggagacacaacacggcacgatcgtcatcagagtgcagtatgagggggacggatccccctgcaagattcccttcgaaatcatggatctggagaaacgccatgtcctcggccggctgattaccgtgaaccctatcgttacagaaaaggacagcccggtgaacattgaggccgaacccccttttggggattcttacatcattatcggcgtcgagcccggacagcttaaactgaattggttcaagaagggctccagcatcgggcagatgtttgagaccacaatgagaggagctaaacgcatggccattctcggcgacaccgcctgggatttcgggtctctgggaggcgtgtttacgagcatcgggaaggctctgcaccaagttttcggcgccatttacggagcggctttttccggcgtgtcttggacaatgaaaatccttattggggtcatcatcacctggattggaatgaacagccggtccaccagcctctctgtgtccctggtgctggttggcgtcgtgacactctatctgggggccatggtgcaggccgacagcggatgtgtcgtgtcttggaagaataaagaacttaagtgcggctccgggatcttcattaccgataacgttcacacatggacggagcagtacaagtttcagcctgaaagcccctccaaactggcttctgccatccaaaaggctcatgaggaaggcatttgtggaatcagaagcgtgacccgcctcgagaatctgatgtggaaacagatcacaccggagctgaaccacattctttccgaaaatgaggtcaagctcaccatcatgacaggcgacattcgggggatcatgcaggccggaaaaagatctctgcgccctcagcccaccgaactgaagtatagctggaaaacgtggggcaaggcgaagatgctctccaccgagagccataaccaaacattcctgattgatgggcctgaaaccgccgagtgccccaatacaaaccgggcttggaactctcttgaggtggaagactacggatttggcgttttcaccacaaacatctggctgaaactcagagagaagcaggacgtgttttgtgattccaaactgatgagcgccgctatcaaggacaatcgcgccgtccacgcggatatgggctattggattgaatctgccctgaacgacacctggaaaatggagaaggcttccttcatcgaggtcaagagctgccactggcctaaatctcatacgctttggagcaatggggttctcgaatccgagatgattatccccaagaacttcgccggaccggtgagccagcacaactaccggcctggctatcatacacagaccgctgggccctggcacctgggaaaactggaaatggattttgacttctgtgagggcaccacagtcgtggtgaccgaagattgcgggaatagaggaccctctctccggacgacaaccgcctccggcaagctgattacagagtggtgctgtcgcagctgcacccttcctccgctgagataccggggcgaggacgggtgttggtacggaatggaaatcagacccctcaaagagaaggaagagaacctggtcaattccctggttacagccggccatgggcaaattgataacttttctcttggaatcctcggcatggctctgttcctggaagagatgctccgcacccgggtggggacgaagcacgcgatcctgcttgtggccgtcagctttgtgaccctgattacaggaaatatgtccttcagagacctcggccgcgttatggtgatggtcggcgctaccatgacagatgacatcgggatgggagtgacctatctggccctgcttgccgcttttaaagttagacctacgttcgccgcgggcctgctcctgcggaagctcacatctaaagagctgatgatggctaccattgggatcgcccttctgagccagtccacaattcccgaaaccatcctcgagctgaccgatgccctggctcttggaatgatggtgctgaagatcgtccgcaacatggaaaaataccagctcgccgtgacaattatggcgatctcttgcgttcctaatgctgtgattctgcaaaacgcctggaaggtcagctgtacgatcctcgccgctgtgtccgtgagccccctgcttctgacctcttcccagcagaaggccgactggattcctctcgctctgacaatcaaaggcctgaatcccaccgccatctttcttacaaccctgagcagaacgtctaagaaacggtcctggccgctcaacgaggcgattatggccgtcgggatggttagcatcctggcttcttccctcctgaagaatgacattcctatgacaggaccccttgtggccggcggcctgctgaccgtgtgctatgtcctcaccgggcgcagcgctgatctggaacttgagagagccgccgacgtgaaatgggaggatcaggctgaaatctccggaagctctcctattctgagcatcacaatttccgaggacggctctatgagcatcaagaacgaagaggaggaacaaaccctcacaatcctgattcggacggggctcctggttatctccggagtgttccccgtctctattccgatcaccgcggccgcttggtacctttgggaggtgaaaaagcagcgcgccggcgttctgtgggatgtgccttctccccctcccgtcgaaaaggccgagctggaagacggggcttatagaattaaacagcggggaatcctcggctactcccagatcggcgccggggtgtataaggagggaacatttcacaccatgtggcatgtcacacgcggcgcggtgctgatgcacagagggaaacgggttgagccctcctgggctgatgtgaagaaagaccttattagctacggaggcgggtggaagctggaaggagagtggaaggaaggcgaggaagtccaagtgctcgccctggagcctggcaaaaatccgagagccgttcagaccaagcccggactcttcaaaacgaacaccggaacaatcggcgctgtgtccctggattttagccctgggacctctggatcccccattgtcgaccgcaagggcaaagtggtggggctttacggaaatggcgttgtcacacggagcggcgcctatgtgtctgcgatcgctcagaccgagaagtccattgaagataaccctgagatcgaagacgatatcttcagaaagaaacgcctgacaattatggacctgcatcccggggccggaaagacgaaacggtacctccctgccatcgtgagagaggctattaagcgcggcctgcggacccttatcctggccccgacaagagtcgtggctgccgaaatggaggaggcgctccgcgggctgcccattcggtatcagacccctgccatcagagctgaacacaccggacgggagattgttgacctcatgtgtcatgccacattcacgatgcgcctgcttagccccgtgagagtccctaactacaatctgatcatcatggatgaagctcactttaccgaccccgcctccattgccgctcggggctatatctctacacgcgtggagatgggggaggcggccggcattttcatgaccgctacaccgcctggaagcagagatccctttccccaatccaacgcccctatcatggacgaagaacgggaaattcccgagagaagctggaactctggccacgaatgggttaccgatttcaaagggaagacggtgtggtttgtcccttccatcaaggccggaaacgacatcgctgcctgcctgcgcaaaaatggcaagaaagtgattcagctcagccggaagacattcgattctgagtacgttaaaaccagagcgaacgactgggattttgtggtcaccacagacatcagcgagatgggggctaatttcaaggccgaacgcgtgattgatccgcggagatgtatgaagcccgtgatcctgaccgacggagaggaacgcgtcattcttgccggccctatgcccgttacacattcctctgctgcccagcggagagggcgcatcggcagaaaccctaaaaatgagaacgaccaatatatctacatgggagaacccctggagaatgatgaggactgcgcgcactggaaggaagccaaaatgctcctggataacattaataccccggagggcatcattcctagcatgtttgaacccgagcgggaaaaggtggacgctatcgatggggagtaccgcctgagaggagaggcccggaaaacgttcgtggacctcatgcgcagaggcgatcttcctgtctggctggcttatcgggtggccgctgaagggattaactacgccgacagacgctggtgttttgatggaatcaagaataaccagattctggaggaaaacgttgaggtggagatctggacaaaagaaggcgagcggaagaagctcaaacccagatggctggacgcgcgcatctattccgatcctcttgccctgaaggagttcaaagagttcgctgccgggcggaagtctctcaccctgaatctgattacagaaatgggcagactccccacctttatgacgcagaaagctcgggacgcccttgataacctggccgtcctgcataccgctgaggcgggaggccgcgcctacaatcacgctctcagcgagctgccggaaacacttgagaccctgctcctgctgacactccttgccaccgtgacagggggaatcttcctgtttctgatgtccggcaaggggattggaaagatgaccctcggcatgtgctgcatcattacggccagcatcctgctttggtatgctcagatccaacctcactggattgccgcgtctatcattctggagttctttctcatcgttctgctgattcccgagcccgaaaaacagagaacacctcaggacaaccagctcacctacgtggtcatcgccatccttaccgtggtcgctgccacaatggctaatgagatgggcttcctggagaagaccaaaaaggacctggggctcggatccattacaacgcaagaaagcgagtccaacatcctggatattgaccttcggccggcctctgcgtggaccctgtatgccgtggctacaacctttgttacacccatgctccgccatagcatcgaaaattcctctgtgaacgtgagcctgaccgccattgctaatcaggccacggtcctgatgggcctcgggaaaggatggcctctttccaagatggatatcggcgttcccctgctggctattgggtgttacagccaggtgaaccctatcaccctcacagccgcgctgcttctgctcgtggcccactacgctatcattggacccggcctgcaggccaaggctaccagagaggcccaaaaacgggccgcggctggcatcatgaagaatcctacagtcgacgggattaccgtgatcgatctggaaccgattccctatgaccctaaattcgagaagcagctcggacaggttatgcttctgatcctgtgcgtgacgcaggtcctcatgatgcgcacaacctgggccctgtgtgaggctcttacactggccaccggccccatctctaccctctgggaagggaaccctggaagattttggaatacaacgattgccgtgtccatggctaacatcttccggggcagctacctggccggggcgggactgctcttttctattatgaaaaataccacaaacacccgcagaggcacaggcaatatcggggagacccttggagaaaagtggaagtcccggctgaacgccctgggcaaaagcgagttccaaatttataagaaatctgggatccaggaggtcgatagaacgctcgctaaggaaggaatcaaacgcggcgagacagaccatcacgccgtgagccgggggtccgctaagctgagatggtttgttgaacgcaacatggtgacccccgagggaaaagtcgtggatcttggctgcggcagagggggatggtcttactattgtggcgggctgaagaatgttcgggaagtgaagggactcaccaaaggcgggccgggacatgaggagcctattcccatgagcacatacggctggaacctggtccgcctgcagtccggcgtggacgtgttcttcacaccccctgaaaagtgcgatacactcctttgtgacatcggggagagctcccccaatcctacgattgaagccggacggaccctgagagttctgaacctcgtcgagaattggctgaacaataacacacaattttgcatcaaagtgcttaatccgtatatgccctctgtgattgaaaagatggagaccctgcagcgcaaatacggcggggcgctcgtccggaaccctctgagcagaaattccacacacgagatgtactgggtttctaacgccaccggaaatatcgtgagctccgtgaacatgatctctcgcatgctgattaatcggttcacgatgaagcacaagaaagctacctatgaacccgatgtcgacctcggcagcgggacaagaaacatcggaattgagtccgaaatccctaaccttgacattatcggcaagcgcattgagaaaatcaagcaggaacatgagaccagctggcactacgatcaggaccatccctataaaacatgggcctaccacggctcttatgagaccaagcaaacagggtccgctagctctatggtgaatggagttgtgagactgctgaccaagccgtgggatgtcgtgcctatggttacgcagatggccatgacagacaccaccccctttggccagcagcgggtgttcaaagaaaaggtcgatacacgcacgcaagagcctaaagaagggaccaagaaactcatgaagatcacagctgagtggctgtggaaggagcttggcaagaagaaaacccccagaatgtgtacacgggaagagtttaccagaaaggtgcggtccaacgccgcgctgggcgccattttcacagacgaaaataaatggaaaagcgctcgcgaggccgtggaagattctagattttgggagctcatcgaccgggagcgcaacctgcacctggaagggaaatgcgagacctgtgtctacaatatgatgggaaagagagaaaagaaactcggcgagttcggcaaggctaaagggtcccgggccatttggtatatgtggctgggagcccgctttcttgagttcgaggcgctgggctttctcaacgaggatcattggttcagcagagggaatagcctgagcggagttgaaggcgaggggcttcaccggctgggctacatcctccgcgacgtgtctaagaaagaaggaggcgctatgtacgccgatgacacggccgggtgggacaccagaattacactggaggatctgaagaacgaagagatggtgaccaatcatatgaagggagagcacaaaaagctcgctgaagccatctttaaactgacatatcagaacaaggtcgtgcgggttcagcgccctacccccagaggcacggtgatggacatcattagccggcgcgatcagagagggtccggacaagtcggcacatacgggcttaataccttcacaaacatggaggctcagctgatccggcagatggaaggcgagggaattttcaaatctatccaacatctcaccgtgacggaggaaattgccgttcagaattggctggcgagagtgggccgcgagcggcttagcagaatggccatctccggggacgattgcgtcgtgaagccgctggacgatcgctttgcttctgccctcaccgctctgaacgacatgggaaaggttcggaaagatatccagcagtgggaacctagcagaggctggaatgactggacacaagtgcccttctgctcccaccactttcatgagctggtcatgaaggatgggcgcgtgctcgtcgtgccctgtcggaaccaggacgaactgattggcagagcccgcatctctcagggcgcggggtggagccttaaagagaccgcctgcctgggcaagtcctatgctcagatgtgggccctcatgtacttccaccggagagatctgcgccttgctgccaacgctatttgtagcgccgttccttctcattgggtgccgacatcccggaccacatggagcatccacgcgaaacacgagtggatgaccacggaagacatgctggccgtctggaatagagtgtggattcaagagaacccctggatggaagacaagacacctgtggagtcttgggaagaggttccctatctcggaaagcgggaggatcagtggtgcggctccctgatcgggctgaccagcagagctacctgggccaaaaatattcagacagccatcaaccaggtgcgctccctcatcggaaatgaagagtacaccgactatatgccttctatgaagcggtttagacgcgaagaggaagaggctggcgtcctgtggtga

SEQ ID NO: 19911 - RNA, 9876 nt, synthetic construct
  misc_feature 1..9876: note = derived and/or modified CDS sequence (opt5) from DENV-2__EU482569__SS-prME
  source 1..9876: mol_type = other RNA
accgccggcgtgatcattatgctgatccccacggctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagaataaagaactgaagtgcggctccgggatcttcattaccgataacgtgcacacatggacggagcagtacaagtttcagcctgaaagcccctccaaacttgcttctgccatccaaaaggctcatgaggaaggcatttgtggaatcagaagcgtcacccgcctggagaatctcatgtggaaacagatcacaccggagctgaaccacattctgtccgaaaatgaggtgaaacttaccatcatgacaggcgacattaaagggatcatgcaggccggaaagcggtctctcagacctcagcccaccgaactgaaatatagctggaagacgtggggcaaggcgaaaatgctgtccaccgagagccataaccaaacattcctcattgatgggcctgaaaccgccgagtgccccaatacaaaccgcgcttggaactctctggaggttgaagactacggatttggcgtgttcaccacaaacatctggcttaagctgcgggagaaacaggacgtcttttgtgattccaagctcatgagcgccgctatcaaagacaatagagccgtgcacgcggatatgggctattggattgaatctgccctgaacgacacctggaagatggagaaggcttccttcatcgaggttaaaagctgccactggcctaagtctcatacgctgtggagcaatggggtgcttgaatccgagatgattatccccaaaaacttcgccggaccggtcagccagcacaactaccgccctggctatcatacacagaccgctgggccctggcacctcggaaagctggaaatggattttgacttctgtgagggcaccacagtggtggtcaccgaagattgcgggaatcggggaccctctctgagaacgacaaccgcctccggcaaactcattacagagtggtgctgtcggagctgcaccctgcctccgcttcgctacagaggcgaggacgggtgttggtacggaatggaaatccggcccctgaaggagaaggaagagaacctcgttaattccctggtgacagccggccatgggcaaattgataacttttctctgggagtgcttggcatggctctcttcctggaagagatgctgagaacccgcgtcgggacgaaacacgcgatcctcctggtggccgttagctttgtgacccttatcacaggaaatatgtccttccgggacctgggcagagtcatggtgatggttggcgctaccatgacagatgacattgggatgggagtgacctatctcgccctgctggccgcttttaaggtccgccctacgttcgccgcgggccttctgctcagaaaactgacatctaaggagctcatgatggctaccatcgggattgccctgcttagccagtccacaatccccgaaaccattctggagctcaccgatgccctggctctgggaatgatggtgcttaaaatcgttcggaacatggaaaagtaccagctggccgtgacaatcatggcgatttcttgcgtccctaatgctgtgatcctccaaaacgcctggaaggtgagctgtacgattctggccgctgtctccgttagccccctcctgcttacctcttcccagcagaaagccgactggatccctctggctctcacaattaagggcctgaatcccaccgccatctttctgacaacccttagccgcacgtctaaaaagagatcctggccgctgaacgaggcgatcatggccgtggggatggtgagcattctcgcttcttccctgctcaaaaatgacatccctatgacaggacccctggtcgccggcggccttctgaccgtgtgctatgttctgaccgggcggagcgctgatctcgaactggagcgcgccgccgacgtgaagtgggaggatcaggctgaaatttccggaagctctcctatccttagcattacaatctccgaggacggctctatgagcattaaaaacgaagaggaggaacaaaccctgacaatcctcatcagaacggggctgctcgtcatttccggagtgttccccgtttctatcccgattaccgcggccgcttggtacctgtgggaggtgaagaagcagcgggccggcgtcctttgggatgtgccttctccccctcccgtcgggaaagccgaactggaggacggagcttatcgcatcaagcagagaggcattctgggctactcccagatcggggccggagtgtataaagaaggcacatttcacaccatgtggcatgttacaagaggggcggtgctcatgcaccgcggaaagagaatcgagccctcctgggctgatgtcaaaaaggacctgattagctacggcgggggatggaaacttgagggcgaatggaaagagggcgaagaggtgcaagttctggccctcgaacctgggaagaatccgcgggccgtgcagaccaaacccggactgttcaagacgaacaccggcacaatcggggctgtctccctcgattttagccctggaacctctggctcccccattgtggacagaaaagggaaggtggttggactgtacggcaatggcgtcgtgacacgcagcggggcctatgtgtctgcgatcgctcagaccgagaagtccattgaggataaccctgaaatcgaggacgatatcttccggaaaaagagacttacaattatggacctgcatcccggagccggcaaaacgaagcgctacctgcctgccatcgtccgggaagctattaaaagagggctccgcaccctgatccttgccccgacacgggtggttgctgccgagatggaagaggcgctgagaggactccccattcgctatcagacccctgccatccgggctgagcacaccggcagagaaattgtggacctgatgtgtcatgccacattcacgatgcggctcctgagccccgtccgcgtgcctaactacaatcttatcatcatggatgaggctcactttaccgaccccgcctccattgccgctagagggtatatctctacacgggttgaaatgggcgaggcggccggaattttcatgaccgctacaccgcctggcagccgcgatccctttccccaatccaacgcccctatcatggacgaggaaagagagattcccgaacggagctggaactctgggcacgagtgggtgaccgatttcaagggaaagacggtctggtttgtgccttccatcaaagccggcaacgacatcgctgcctgcctgagaaagaatgggaaaaaggttattcagctgagccgcaaaacattcgattctgaatacgtgaagacccgggcgaacgactgggattttgtcgtgaccacagacatcagcgagatgggagctaatttcaaggccgagagagtgattgatccgcgccggtgtatgaaacccgtcatcctcaccgacggcgaagagagagttattctggccgggcctatgcccgtgacacattcctctgctgcccagcgccggggcagaatcggacgcaaccctaagaatgaaaacgaccaatatatctacatgggcgagccccttgaaaatgatgaggactgcgcgcactggaaagaggccaagatgctgctcgataacattaataccccggaagggatcattcctagcatgtttgagcccgaaagagagaaagtggacgctatcgatggagaataccggctgcgcggcgaggccagaaagacgttcgtcgacctgatgcggcgcggggatctccctgtgtggcttgcttatagagttgccgctgagggaattaactacgccgaccggagatggtgttttgatggcatcaaaaataaccagattctggaagagaacgtggaagtcgagatctggacaaaggagggggaacgcaagaaactgaagccccggtggctcgacgcgagaatctattccgatcctctggcccttaaagagttcaaggagttcgctgccggccgcaaatctctgaccctcaatctgattacagagatgggacggctgcccacctttatgacgcagaaggctagagacgccctcgataaccttgccgtgctgcataccgctgaagcgggcgggcgggcctacaatcacgctctgagcgagctcccggagacactggaaacccttctgctcctgacactgctcgccaccgttacaggaggcatcttcctttttctgatgtccgggaagggaattggcaaaatgaccctgggcatgtgctgcatcattacggccagcatcctcctgtggtatgctcagatccaacctcactggattgccgcgtctatcattcttgagttctttctgatcgtgctcctgattcccgaacccgagaagcagcgcacacctcaggacaaccagctgacctacgtcgtgatcgccatcctcaccgtcgtggctgccacaatggctaatgaaatggggttccttgagaaaaccaagaaagacctgggactgggctccattacaacgcaagagagcgaatccaacatcctcgatattgacctgagaccggcctctgcgtggaccctttatgccgttgctacaacctttgtgacacccatgctgcggcatagcatcgaaaatagctctgtgaacgtcagcctcaccgccattgctaatcaggccacggttctgatggggctgggaaagggctggcctctctccaagatggatatcggggtgccccttctggctattggatgttacagccaggtgaaccctatcaccctgacagccgcgctcctgcttctggtcgcccactacgctatcattggccccggcctccaggccaaagctacccgcgaagcccaaaagagagccgcggctgggatcatgaaaaatcctacagtggacggaattaccgttatcgatctggagccgattccctatgaccctaagttcgaaaaacagctgggccaggtgatgctccttatcctgtgcgtcacacaggtgctgatgatgcggacaacctgggccctctgtgaggctctgacacttgccaccgggcccatctctaccctgtgggagggaaaccctggccgcttttggaatacaacgattgccgtctccatggctaacatcttcagagggagctacctcgccggagcgggcctgctgttttctattatgaagaataccacaaacacccggcgcggcacagggaatatcggagaaaccctcggcgagaagtggaaatccagacttaacgccctggggaagaacgagttccaaatttataaaaagagcggaatccaggaggtggatcggacgctggctaaagagggcatcaagagaggggaaacagaccatcacgccgtttctcgcggaagcgctaaactccggtggtttgtggagagaaatatggtcattcccgaaggcaaggtggttgatctgggctgcgggcgcggaggctggtcctactattgtgggggacttaagaacgtgcgggaggtcaaaggcctgaccaaagggggaccgggccatgaagaacctatccccatgtctacctacggctggaatctcgtgagactgcagagcggggtggacgttttcttcacaccccctgagaaatgcgataccctgctctgtgacattggagaatccagccccaaccctacaatcgaggccggccgcacgcttcgggtcctgaatctggtggaaaactggctcaataacaatacccaattttgcattaaggtgctgaacccgtatatgccctccgtcatcgagaaaatggaaacacttcagagaaagtacgggggagcgctggttcgcaatcctctctctcggaacagcacccacgagatgtactgggtgtccaatgccacaggcaacatcgtgtctagcgtcaatatgatttccagaatgctgatcaaccgcttcaccatgaagcacaaaaaggctacgtatgagcccgatgtggacctggggtctggaacccggaacattggcatcgaaagcgagattcctaatctcgacatcattggcaaaagaatcgaaaagatcaaacaggagcatgaaacatcctggcactacgatcaggaccatccctataagacctgggcctaccacgggagctatgagacaaagcaaaccggatctgcttccagcatggttaacggcgtggtccgccttctgacaaaaccgtgggatgtggttcctatggtgacccagatggccatgacggacacaaccccctttgggcagcagagagtcttcaaggagaaagtggatacccggacacaagaacctaaggagggaacgaaaaagctgatgaagattaccgctgaatggctctggaaagagctgggcaagaaaaagacaccccgcatgtgtaccagagaggaatttacacggaaagtgagatctaatgccgcgcttggggccatcttcaccgacgagaacaagtggaaatccgctcgggaagccgtcgaggatagccgcttttgggaactgattgacagagagcggaatctccacctggagggaaagtgcgaaacatgtgtttacaacatgatgggcaagcgcgagaaaaagctgggcgagttcgggaaagctaagggatctagagccatctggtatatgtggctcggcgcccggtttctggagttcgaagcgcttgggtttctgaatgaggatcattggttctcccgcggaaacagcctctccggcgtggagggggaaggcctgcacagacttggatacattctgcgggacgtgagcaaaaaggagggcggggctatgtacgccgatgacaccgccggatgggacacgcgcatcaccctcgaagatctgaagaatgaggaaatggtcacaaaccatatgaaaggcgagcacaagaaactggctgaggccatctttaagctcacctatcagaataaagtggttagagtgcagcggcctacaccccgcgggaccgtcatggacattatctctagacgggatcagcgcggaagcggccaagtggggacgtacggcctgaacacattcaccaatatggaagctcagcttattagacagatggagggagaaggcatcttcaagtccattcaacatctgacagttaccgaggagatcgccgtgcagaactggctcgcgcgggtcgggagagaacgcctgtctcggatggccatcagcggagacgattgcgtggttaagccgcttgacgatagatttgcttccgccctgacggctctcaatgacatgggcaaagtgcgcaaggatattcagcagtgggagccttctcgggggtggaacgactggacccaagtccccttctgcagccaccactttcatgaactggtgatgaaagatggaagagtcctggtggttccctgtcgcaaccaggacgagctcatcggccgggccagaatttcccagggggcgggctggtctctgaaggaaacagcctgccttggaaaaagctatgctcagatgtggaccctgatgtacttccaccgccgggatctcagactggccgctaatgccatctgttccgctgtgcctagccattgggtcccgacatctcgcaccacatggtccattcacgccaagcacgagtggatgaccacggaggacatgcttgcggtgtggaaccgggtgtggatccaagaaaatccctggatggaggacaagacacctgttgaaagctgggaggaagtgccctatctgggcaaaagagaggatcagtggtgcgggtctctcattggactgacctcccgggccacctgggctaagaacatccagacagccatcaatcaggtcagaagcctgattggcaacgaggaatacaccgactatatgccttccatgaaacgctttcggagagaggaagaggaagccggggtgctctggtga

SEQ ID NO: 19912 - RNA, 9876 nt, synthetic construct
  misc_feature 1..9876: note = derived and/or modified CDS sequence (opt5) from DENV-2__EU482570__SS-prME
  source 1..9876: mol_type = other RNA
accgcgggagtgatcattatgctgatccccaccgctatggccttccacctcacgaccagaaatggggaacctcatatgattgtcggacggcaggaaaagggcaaatccctgctttttaagaccgaagacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttcagcctgagaacctggaatacaccatcgtgattacaccccacagcggggaggagcatgcggtgggaaatgacaccggcaagcacggcaaagaaatcaagatcacacctcagtcttccattaccgaggccgaacttacggggtatggaaccgtcacaatggagtgtagcccccggaccggcctggatttcaacgaaatggtgctcctgcaaatggaggacaaggcttggcttgttcaccgccagtggtttctggatctcccgctgccttggctgcccggggccgacacacagggatctaattggatccagaaggagaccctcgtgacgttcaagaaccctcatgctaaaaagcaagacgtcgtggttctgggctcccaggaaggggccatgcacacagcccttaccggcgctacagagattcagatgagctccggaaatctgctctttaccggccatctgaaatgcagacttcggatggataagctgcaactcaaagggatgtcttacagcatgtgtaccggaaagttcaagatcgtgaaagaaattgcggagacacagcacggcacgatcgtcatcagagtgcagtatgagggggacggatccccctgcaagattcccttcgaaatcatggatctggagaaacgccatgtcctgggccggctcattaccgtgaaccctatcgttacagaaaaggacagcccggtgaacattgaggccgaacccccttttggggattcttacatcattatcggcgtcgagcccggacagctgaaacttaattggttcaagaagggctccagcatcgggcaaatgtttgagaccacaatgagaggagctaaacgcatggccattctgggcgacaccgcctgggatttcgggtctctcggaggcgtgtttacgagcatcgggaaggctctgcaccaggttttcggcgccatttacggagcggctttttccggcgtgtcttggacaatgaaaatcctgattggggtcatcatcacctggattggaatgaacagccggtccaccagcctttctgtgtccctcgtgctggttggcgtcgtgacactgtatctcggggccatggtgcaggccgacagcggatgtgtcgtgtcttggaagaataaagaactgaagtgcggctccgggatcttcattaccgataacgttcacacatggacggagcagtacaagtttcaacctgaaagcccctccaaacttgcttctgccatccagaaggctcatgaggaaggcatttgtggaatcagaagcgtgacccgcctggagaatctcatgtggaaacaggtcacaccggagctgaaccacatcctgtccgaaaatgaggtgaaacttaccattatgacaggcgacatcaaagggattatgcaggccggaaagcggtctctcagacctcaacccaccgaactgaaatatagctggaagacgtggggcaaggcgaaaatgctgtccaccgagagccataaccagacattcctcatcgatgggcctgaaaccgccgagtgccccaatacaaaccgcgcttggaactctctggaggttgaagactacggatttggcgtgttcaccacaaacatttggcttaagctgcgggagaaacaggacgtcttttgtgattccaagctcatgagcgccgctatcaaagacaatagagccgtgcacgcggatatgggctattggatcgaatctgccctgaacgacacctggaagatggagaaggcttccttcattgaggttaaaagctgccactggcctaagtctcatacgctgtggagcaatggggtgcttgaatccgagatgatcattcccaaaaacttcgccggaccggtcagccagcacaactaccgccctggctatcatacacaaaccgctgggccctggcacctcggaaagctggaaatggattttgacttctgtgagggcaccacagtggtggtcaccgaagattgcgggaatcggggaccctctctgagaacgacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgttaattccctggtgacagccggccatgggcagatcgataacttttctctgggagtgcttggcatggctctcttcctggaagagatgctgagaacccgcgtcgggacgaaacacgcgattctcctggtggccgttagctttgtgacccttatcacaggaaatatgtccttccgggacctgggcagagtcatggtgatggttggcgctaccatgacagatgacatcgggatgggagtgacctatctcgccctgctggccgcttttaaggtccgccctacgttcgccgcgggccttctgctcagaaaactgacatctaaggagctcatgatggctaccattgggatcgccctgcttagccagtccacaattcccgaaaccatcctggagctcaccgatgccctggctctgggaatgatggtgcttaaaattgttcggaacatggaaaagtaccaactggccgtgacaatcatggcgatctcttgcgtccctaatgctgtgattctccagaacgcctggaaggtgggctgtacgatcctggccgctgtcagcgttagccccctcctgcttaccagctctcagcagaaagccgactggattcctctggctctcacaatcaaggggctgaatcccaccgccatttttctgacaaccctttcccgcacgagcaaaaagagatcttggccgctgaacgaggcgatcatggccgtgggaatggtgtccatcctcgctagctctctgctcaaaaatgacattcctatgacaggccccctggtcgccggcgggcttctgaccgtgtgctatgttctgaccggacggtccgctgatctcgaactggagcgcgccgccgacgtgaagtgggaggatcaagctgaaatcagcggctccagccctattctttctatcacaattagcgaggacgggtccatgtctatcaaaaacgaagaggaggaacagaccctgacaattctcatcagaacgggactgctcgtcatcagcggcgtgttccccgtttccattccgatcaccgcggccgcttggtacctgtgggaggtgaagaagcagcgggccggggtcctttgggatgtgccttctccccctcccgtcggaaaagccgaactggaggacggcgcttatcgcattaagcagagaggcatcctggggtacagccaaattggagccggcgtgtataaagaagggacatttcacaccatgtggcatgttacacggggagcggtgctcatgcaccgcggcaagagaatcgagccctcctgggctgatgtcaaaaaggacctgatctcttacgggggaggctggaaacttgagggcgaatggaaagagggggaagaggtgcaggttctggccctcgaacctggaaagaatccgcgggccgtgcagaccaaacccggcctgttcaagacgaacaccgggacaattggagctgtcagcctcgatttttcccctggcaccagcgggtctcccatcgtggacagaaaaggaaaggtggttggcctgtacggcaatggggtcgtgacacgctccggagcctatgtgagcgcgattgctcagaccgagaagtctatcgaggataaccctgaaattgaggacgatatcttccggaaaaagagacttacaatcatggacctgcatcccggcgccgggaaaacgaagcgctacctgcctgccattgtccgggaagctatcaaaagaggactccgcaccctgattcttgccccgacacgggtggttgctgccgagatggaagaggcgctgagaggcctccccatccgctatcaaacccctgccattcgggctgagcacaccgggagagaaatcgtggacctgatgtgtcatgccacattcacgatgcggctcctgtcccccgtccgcgtgcctaactacaatcttattatcatggatgaggctcactttaccgaccccgccagcatcgccgctagaggctatatttccacacgggttgaaatgggagaggcggccggcatcttcatgaccgctacaccgcctgggtctcgcgatccctttccccagagcaacgcccctattatggacgaggaaagagagatccccgaacggtcctggaatagcggacacgagtgggtgaccgatttcaagggcaagacggtctggtttgtgccttctattaaagccgggaacgacatcgctgcctgcctgagaaagaatggcaagaaggttatccagctgtcccgcaaaacattcgatagcgaatacgtgaagacccgggcgaacgactgggattttgtcgtgaccacagacatttctgagatgggcgctaatttcaaggccgagagagtgatcgatccgcgccggtgtatgaaacccgtcattctcaccgacggggaagagagagttatcctggccggccctatgcccgtgacacatagctccgctgcccaacgccggggaagaattggccgcaaccctaagaatgaaaacgaccagtatatctacatgggggagccccttgaaaatgatgaggactgcgcgcactggaaagaggccaagatgctgctcgataacatcaataccccggaaggaattatcccttctatgtttgagcccgaaagagagaaagtggacgctattgatggcgaataccggctgcgcggggaggccagaaagacgttcgtcgacctgatgcggcgcggagatctccctgtgtggcttgcttatagagttgccgctgagggcatcaactacgccgaccggagatggtgttttgatgggattaaaaataaccagatcctggaagagaacgtggaagtcgagatttggacaaaggagggcgaacgcaagaaactgaagccccggtggctcgacgcgagaatctatagcgatcctctggcccttaaagagttcaaggagttcgctgccggacgcaaatccctgaccctcaatctgatcacagagatgggccggctgcccacctttatgacgcagaaggctagagacgccctcgataaccttgccgtgctgcataccgctgaagccgggggaaaggcctacaatcacgctctgtctgagctcccggagacactggaaacccttctgctcctgacactgctcgccaccgttacaggcgggattttcctttttctgatgagcggaaaaggcatcggcaagatgaccctggggatgtgctgcattatcacggcctccattctcctgtggtatgctcaaatccagcctcactggatcgccgcgagcattatccttgagttctttctgattgtgctcctgatccccgaacccgagaaacagcggacacctcaggacaaccaactgacctacgtcgtgattgccatcctcaccgtcgtggctgccacaatggctaatgaaatgggattccttgagaagaccaaaaaggacctgggcctggggtctatcacaacgcaggagtccgaaagcaacattctcgatatcgacctgcgcccggcctccgcgtggaccctttatgccgttgctacaacctttgtgacacccatgctgagacattctattgagaatagctccgtgaacgtctctctcaccgccatcgctaatcaggccacggttctgatgggactgggcaaggggtggcctctcagcaaaatggatattggagtgccccttctggctatcggctgttactcccaggtgaaccctattaccctgacagccgcgctcctgcttctggtcgcccactacgctatcatcggccccgggctccaagccaaggctacccgggaagcccagaaacgcgccgcggctggaattatgaagaatcctacagtggacggcatcaccgttattgatctggagccgatcccctatgaccctaaattcgaaaagcagctgggacaggtgatgctccttattctgtgcgtcacgcaagtgctgatgatgagaacaacctgggccctctgtgaggctctgacacttgccaccggacccatcagcaccctgtgggagggcaaccctgggcggttttggaatacaacgatcgccgtctctatggctaacattttccgcggatcctacctcgccggcgcgggcctgctgtttagcatcatgaagaataccacaaacaccagacgggggacaggaaatattggcgaaaccctcggggagaaatggaagtctcgccttaacgccctgggaaaatccgagttccagatctataagaaaagcggcattcaggaggtggatagaacgctggctaaggaggggatcaaacggggagaaacagaccatcacgccgtttctagaggcagcgctaagctccgctggtttgtggagcggaacatggtcacccccgaaggcaaggtggttgatctggggtgcggaagaggcgggtggtcctactattgtggaggccttaaaaatgtgcgcgaggtcaaggggctgaccaaaggaggcccgggccatgaagaacctatccccatgtctacatacgggtggaacctcgtgcggctgcaaagcggagtggacgttttcttcacaccccctgagaagtgcgatacactgctctgtgacattggcgaatccagccccaatcctacgatcgaggccgggagaacccttcgcgtcctgaacctggtggaaaattggctcaacaataacacacagttttgcattaaagtgctgaatccgtatatgccctccgtcatcgagaagatggaaacccttcagcggaagtacggaggcgcgctggttagaaaccctctctctcgcaatagcacacacgagatgtactgggtgtccaacgccaccgggaatattgtgtctagcgtcaacatgatctcccggatgctgatcaatagattcacgatgaaacacaagaaagctacctatgagcccgatgtggacctgggatctggcacacgcaacattggcatcgaaagcgagattcctaacctcgacatcattgggaagcggatcgagaagattaagcaggagcatgaaacctcctggcactacgatcaagaccatccctataagacatgggcctaccacggaagctatgagaccaaacagacaggctctgcttccagcatggttaatggggtggtcagacttctgaccaagccgtgggatgtggttcctatggtgacgcagatggccatgacagacaccaccccctttggacagcaacgcgtcttcaaagagaaggtggatacaagaacgcaggaacctaaagagggcaccaagaagctgatgaaaatcacagctgaatggctctggaaggagctggggaaaaagaaaacaccccggatgtgtacacgcgaggaatttaccagaaaggtgcggtctaacgccgcgcttggagccatcttcacagacgagaataaatggaagtccgctagagaagccgtcgaggatagccggttttgggaactggttgaccgcgagagaaacctccacctggagggcaagtgcgaaacctgtgtgtacaatatgatgggcaaacgggagaagaaactgggggagttcggaaaggctaaaggctctcgcgccatttggtatatgtggctcggggccagatttctggagttcgaagcgcttggatttctgaacgaggatcattggttctcccggggcaatagcctctccggggtggagggcgaaggactgcaccgccttggctacatcctgaaggacgtcagcaagaaagaagggggagctatgtacgccgatgacacggccggctgggacaccagaattacactcgaagatctgaagaacgaggaaatggtgaccaatcatatgaaaggggagcacaagaaactggctgaggccatctttaagctcacatatcagaacaaggttgtgcgggtccagcgccctacccccagaggaacggtgatggacattatctctcggcgcgatcaaagaggcagcgggcaggttggcacatacggactgaataccttcacaaacatggaagctcagcttatccggcaaatggagggcgaagggattttcaaatccatccagcatctgaccgtgacggaggagattgccgtccagaattggctcgcgcgcgtgggaagagaacggctgtctagaatggttatcagcggcgacgattgcgtggtcaagccgcttgacgatcgctttgcctccgctctgaccgccctcaacgacatggggaaagtgcggaaggatattcagcaatgggagccttctagaggatggaatgactggacacaggtccccttctgcagccaccactttcatgaactggtgatgaaagatggccgcgttctggtggtcccctgtcggaaccaggacgagctcatcgggagagctcgcatctcccagggcgccggatggtctctgaaggaaaccgcgtgccttggcaagagctatgcccaaatgtggacactgatgtacttccaccggagagatctccgcctggctgccaacgctatttgttccgccgtgcctagccattgggtgccgacctctcggacaacctggtccatccacgctaaacacgagtggatgacgacagaggacatgcttgccgtttggaatagagtgtggattcaggaaaacccctggatggaggacaagacccctgtcgaaagctgggaggaagtgccctatctggggaaacgcgaggatcagtggtgcggatctctcatcggcctgacctcccgggcgacatgggccaagaatattcagaccgctatcaaccaagttagaagcctgattgggaatgaggaatacacagactatatgccttccatgaaacggtttagacgcgaggaagaggaagccggagtgctctggtga

SEQ ID NO: 19913 - RNA, 9876 nt, synthetic construct
  misc_feature 1..9876: note = derived and/or modified CDS sequence (opt5) from DENV-2__EU482571__SS-prME
  source 1..9876: mol_type = other RNA
accgccggcgtgatcattatgctgatccccaccgctatggccttccacctcacgacccggaatggggaacctcatatgattgtcggacggcaggaaaagggcaaaagcctgctttttaagaccgaggacggggttaatatgtgcaccctgatggcgatcgatctcggagaactgtgtgaggacaccattacctacaaatgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttctgcctgagaaccttgaatacaccatcgtgattacaccccacagcggggaggagcatgcggtgggaaatgacaccggcaagcacggcaaagaaatcaagatcacacctcagtcttccattaccgaggccgaactgacggggtatggaaccgtcacaatggagtgtagcccccggaccggcctcgatttcaacgaaatggtgctgcttcagatggaggacaaggcttggctggttcaccgccaatggtttctcgatctgccgctgccttggctccccggggccgacacacagggatctaattggatccagaaggagaccctggtgacgttcaagaaccctcatgctaaaaagcaggacgtcgtggttcttggctcccaagaaggggccatgcacacagccctgaccggcgctacagagattcagatgagctccggaaatctcctgtttaccggccatcttaaatgcagactgcggatggataagctccagctgaaagggatgtcttacagcatgtgtaccggaaagttcaagatcgtgaaagaaattgcggagacacaacacggcacgatcgtcatcagagtgcagtatgagggggacggatccccctgcaagattcccttcgaaatcatggatctggagaaacgccatgtcctcggccggctgattaccgtgaaccctatcgttacagaaaaggacagcccggtgaacattgaggccgaacccccttttggggattcttacatcattatcggcgtcgagcccggacagcttaaactgaattggttcaagaagggctccagcatcgggcagatgtttgagaccacaatgagaggagctaaacgcatggccattctcggcgacaccgcctgggatttcgggtctctgggaggcgtgtttacgagcatcgggaaggctctgcaccaagttttcggcgccatttacggagcggctttttccggcgtgtcttggacaatgaaaatccttattggggtcatcatcacctggattggaatgaacagccggtccaccagcctctctgtgtccctggtgctggttggcgtcgtgacactctatctgggggccatggtgcaggccgacagcggatgtgtcgtgtcttggaagaataaagaacttaagtgcggctccgggatcttcattaccgataacgttcacacatggacggagcagtacaagtttcagcctgaaagcccctccaaactggcttctgccatccaaaaggctcatgaggaaggcatttgtggaatcagaagcgtgacccgcctcgagaatctgatgtggaaacagatcacaccggagctgaaccacattctttccgaaaatgaggtcaagctcaccatcatgacaggcgacattaaagggatcatgcaggccggaaagcggtctctgagacctcagcccaccgaactgaaatatagctggaagacgtggggcaaggcgaaaatgctctccaccgagagccataaccaaacattcctgattgatgggcctgaaaccgccgagtgccccaatacaaaccgcgcttggaactctcttgaggtggaagactacggatttggcgttttcaccacaaacatctggctgaagctccgggagaaacaggacgtgttttgtgattccaagctgatgagcgccgctatcaaagacaatagagccgtccacgcggatatgggctattggattgaatctgccctgaacgacacctggaagatggagaaggcttccttcatcgaggtgaaaagctgccactggcctaagtctcatacgctttggagcaatggggttctcgaatccgagatgattatccccaaaaacttcgccggaccggtgagccagcacaactaccgccctggctatcatacacagaccgctgggccctggcacctgggaaagctggaaatggattttgacttctgtgagggcaccacagtcgtggtgaccgaagattgcgggaatcggggaccctctctcagaacgacaaccgcctccggcaaactgattacagagtggtgctgtcggagctgcacccttcctccgctgcgctacagaggcgaggacgggtgttggtacggaatggaaatccggcccctcaaggagaaggaagagaacctggtcaattccctggttacagccggccatgggcaaattgataacttttctcttggagtgctcggcatggctctgttcctggaagagatgctcagaacccgcgtggggacgaaacacgcgatcctgcttgtcgccgtgagctttgttaccctgatcacaggaaatatgtccttccgggacctcggcagagtgatggtcatggtgggcgctaccatgacagatgacattgggatgggagttacctatctggccctgcttgccgcttttaaggtgcgccctacgttcgccgcgggcctgctcctgagaaaactcacatctaaggagctgatgatggctaccatcgggattgcccttctgagccagtccacaatccccgaaaccattctcgagctgaccgatgccctggctcttggaatgatggtcctgaaaatcgtgcggaacatggaaaagtaccagctcgccgttacaatcatggcgatttcttgcgtgcctaatgctgtcatcctgcaaaacgcctggaaggtgagctgtacgattctcgccgctgtgtccgtcagccccctgcttctgacctcttcccagcagaaagccgactggatccctctcgctctgacaattaagggcctgaatcccaccgccatctttcttacaaccctgagccgcacgtctaaaaagagatcctggccgctcaacgaggcgatcatggccgttgggatggtgagcattctggcttcttccctcctgaaaaatgacatccctatgacaggaccccttgtggccggcggcctgctgaccgtctgctatgtgctcaccgggcggagcgctgatctggaacttgagcgcgccgccgacgttaagtgggaggatcaggctgaaatttccggaagctctcctatcctgagcattacaatctccgaggacggctctatgagcattaaaaacgaagaggaggaacaaaccctcacaatcctgatcagaacggggctcctggtgatttccggagtcttccccgtgtctatcccgattaccgcggccgcttggtacctttgggaggttaagaagcagcgggccggcgtgctgtgggatgtcccttctccccctcccgtggggaaagccgaactggaggacggagcttatcgcatcaagcagagaggcattctcggctactcccagatcggggccggagtctataaagaaggcacatttcacaccatgtggcatgtgacaagaggggcggttctgatgcaccgcggaaagagaatcgagccctcctgggctgatgtgaaaaaggaccttattagctacggcgggggatggaagctggagggcgaatggaaagagggcgaagaggtccaagtgctcgccctggaacctgggaagaatccgcgggccgttcagaccaaacccggactcttcaagacgaacaccggcacaatcggggctgtgtccctggattttagccctggaacctctggctcccccattgtcgacagaaaagggaaggtggtgggactttacggcaatggcgttgtcacacgcagcggggcctatgtgtctgcgatcgctcagaccgagaagtccattgaggataaccctgaaatcgaggacgatatcttccggaaaaagagactgacaattatggacctgcatcccggagccggcaaaacgaagcgctacctccctgccatcgtgcgggaagctattaaaagagggctgcgcacccttatcctggccccgacacgggtcgtggctgccgagatggaagaggcgctcagaggactgcccattcgctatcagacccctgccatccgggctgagcacaccggcagagaaattgttgacctcatgtgtcatgccacattcacgatgcggctgcttagccccgtgcgcgtccctaactacaatctgatcatcatggatgaggctcactttaccgaccccgcctccattgccgctagagggtatatctctacacgggtggaaatgggcgaggcggccggaattttcatgaccgctacaccgcctggcagccgcgatccctttccccaatccaacgcccctatcatggacgaggaaagagagattcccgaacggagctggaactctgggcacgagtgggttaccgatttcaagggaaagacggtgtggtttgtcccttccatcaaagccggcaacgacatcgctgcctgcctgagaaagaatgggaaaaaggtgattcagctcagccgcaaaacattcgattctgaatacgttaagacccgggcgaacgactgggattttgtggtcaccacagacatcagcgagatgggagctaatttcaaggccgagagagtgattgatccgcgccggtgtatgaaacccgtgatcctgaccgacggcgaagagagagtcattcttgccgggcctatgcccgttacacattcctctgctgcccagcgccggggcagaatcggacgcaaccctaagaatgaaaacgaccaatatatctacatgggcgagcccctggaaaatgatgaggactgcgcgcactggaaagaggccaagatgctcctggataacattaataccccggaagggatcattcctagcatgtttgagcccgaaagagagaaagtggacgctatcgatggagaataccggctgcgcggcgaggccagaaagacgttcgtggacctcatgcggcgcggggatcttcctgtctggctggcttatagagtggccgctgagggaattaactacgccgaccggagatggtgttttgatggcatcaaaaataaccagattctggaagagaacgttgaagtggagatctggacaaaggagggggaacgcaagaaactcaagccccggtggctggacgcgagaatctattccgatcctcttgccctgaaagagttcaaggagttcgctgccggccgcaaatctctcaccctgaatctgattacagagatgggacggctccccacctttatgacgcagaaggctagagacgcccttgataacctggccgtcctgcataccgctgaagcgggcgggcgggcctacaatcacgctctcagcgagctgccggagacacttgaaaccctgctcctgctgacactccttgccaccgtgacaggaggcatcttcctgtttctgatgtccgggaagggaattggcaaaatgaccctcggcatgtgctgcatcattacggccagcatcctgctttggtatgctcagatccaacctcactggattgccgcgtctatcattctggagttctttctcatcgttctgctgattcccgaacccgagaagcagcgcacacctcaggacaaccagctcacctacgtggtcatcgccatccttaccgtggtcgctgccacaatggctaatgaaatggggttcctggagaaaaccaagaaagacctgggactcggctccattacaacgcaagagagcgaatccaacatcctggatattgaccttagaccggcctctgcgtggaccctgtatgccgtggctacaacctttgttacacccatgctccggcatagcatcgaaaatagctctgtgaacgtgagcctgaccgccattgctaatcaggccacggtcctgatggggctcggaaagggctggcctctttccaagatggatatcggggttcccctgctggctattggatgttacagccaggtgaaccctatcaccctcacagccgcgctgcttctgctcgtggcccactacgctatcattggccccggcctgcaggccaaagctacccgcgaagcccaaaagagagccgcggctgggatcatgaaaaatcctacagtcgacggaattaccgtgatcgatctggagccgattccctatgaccctaagttcgaaaaacagctcggccaggttatgcttctgatcctgtgcgtgacgcaggtcctcatgatgcggacaacctgggccctgtgtgaggctcttacactggccaccgggcccatctctaccctctgggagggaaaccctggccgcttttggaatacaacgattgccgtgtccatggctaacatcttcagagggagctacctggccggagcgggcctgctcttttctattatgaagaataccacaaacacccggcgcggcacagggaatatcggagaaacccttggcgagaagtggaaatccagactgaacgccctgggaaagagcgagttccaaatttataaaaagtctggaatccaggaggtcgatcggacgctcgctaaagagggcatcaagagaggggaaacagaccatcacgccgtgagccgcggatccgctaaactgcggtggtttgttgagagaaacatggtgacccccgaaggcaaggtcgtggatcttggctgcgggcgcggaggctggtcttactattgtgggggactgaagaatgttcgggaggtgaaaggcctcaccaaagggggaccgggccatgaagaacctattcccatgagcacatacggctggaacctggtcagactgcagtccggggtggacgtgttcttcacaccccctgagaaatgcgatacactcctttgtgacatcggagaaagctcccccaatcctacgattgaggccggccgcaccctgcgggttctgaacctcgtcgaaaattggctgaacaataacacacaattttgcatcaaggtgcttaatccgtatatgccctctgtgattgagaaaatggaaaccctgcagagaaagtacgggggagcgctcgtccgcaaccctctgagcagaaattccacacacgagatgtactgggtttctaacgccaccggcaatatcgtgagctccgtgaacatgatctctagaatgctgattaatcgcttcacgatgaagcacaaaaaggctacctatgagcccgatgtcgacctcgggagcggaacacggaacatcggcattgaatccgagatccctaaccttgacattatcggcaaaagaattgaaaagatcaaacaggagcatgaaaccagctggcactacgatcaggaccatccctataagacatgggcctaccacgggtcttatgagaccaagcaaacaggatccgctagctctatggtgaatggcgttgtgcgcctgctgaccaaaccgtgggatgtcgtgcctatggttacgcagatggccatgacagacaccaccccctttgggcagcagagagtgttcaaggagaaagtcgatacacggacgcaagaacctaaggagggaaccaaaaagctcatgaagatcacagctgcctggctgtggaaagaacttggcaagaaaaagacaccccgcatgtgtacaagagaggagtttacccggaaagtgagatccaacgcggccctgggggctattttcacagacgaaaataagtggaaaagcgcccgggaggctgtggaagattctcgcttttgggagctcatcgacagagaacggaacctgcacctggagggaaagtgcgagacctgtgtctacaatatgatgggcaagcgcgagaagaagctcggcgagttcgggaaagccaagggatccagagccatttggtatatgtggctgggcgcgcggtttcttgagttcgaggctctggggtttctcaacgaagatcattggttcagccgcggaaattccctgagcggcgttgagggggagggccttcacagactgggatacatcctccgggacgtgtctaaaaaggaaggcggggccatgtacgccgatgacacggctggatgggacacccgcattacactggaggatctgaagaacgaagagatggtgaccaatcatatgaaaggcgaacacaagaaactcgccgaggctatctttaagctgacatatcagaacaaagtcgtgagagttcagcggcctacaccccgcgggacggtgatggacatcattagcagacgggatcagcgcggatccggccaagtcgggacatacggccttaataccttcacaaacatggaggcccagctgatcagacagatggaaggagagggcattttcaagtctatccaacatctcaccgtgacggaagagattgcggttcagaattggctggcccgggtggggagagagcgccttagccggatggctatctccggagacgattgcgtcgtgaagccgctggacgatagatttgcctctgctctcaccgccctgaacgacatgggcaaagttcgcaaggatatccagcagtgggaacctagccgggggtggaatgactggacacaagtgcccttctgctcccaccactttcatgagctggtcatgaaagatggaagagtgctcgtcgtgccctgtcgcaaccaggacgaactgattggccgggcgagaatctctcagggggccggctggagccttaaggagaccgcttgcctgggaaaatcctatgcccagatgtggacactcatgtacttccaccgccgggatctgagacttgctgccaacgctatttgtagcgccgttccttctcattgggtgccgacctcccgcacaacctggagcatccacgcgaagcacgaatggatgacgacagaggacatgctggccgtctggaatcgggtgtggattcaagagaacccctggatggaagacaagacccctgtggagtcttgggaagaggttccctatctcggcaaaagagaagatcagtggtgcgggtccctgatcggactgaccagccgggctacatgggccaagaatattcagaccgccatcaaccaggtgagatccctcatcggcaatgaggagtacacagactatatgccttctatgaaacgctttcggagagaagaggaagaggctggggtcctgtggtga

SEQ ID NO: 19914 - RNA, 9876 nt, synthetic construct
  misc_feature 1..9876: note = derived and/or modified CDS sequence (opt5) from DENV-2__EU482572__SS-prME
  source 1..9876: mol_type = other RNA
accgccggagtgatcattatgctgatccccacagctatggccttccacctcacgaccagaaatggggaacctcatatgattgtcggacggcaggaaaagggcaagagcctgctttttaagaccgaagacggggttaatatgtgcaccctgatggcgatcgatctcggagaactgtgtgaggacacaattacctacaagtgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttcagcctgagaacctggaatacaccatcgtgattacaccccacagcggggaggagcatgcggtgggaaatgacaccggcaagcacggcaaagaaatcaagatcacacctcagtcttccattaccgaggccgaacttacggggtatggaaccgtcacaatggagtgtagcccccggaccggcctggatttcaacgaaatggtgctcctgcaaatggaggacaaggcttggcttgttcaccgccagtggtttctggatctcccgctgccttggctgcccggggccgacacacagggatctaattggatccagaaggagaccctcgtgacgttcaagaaccctcatgctaaaaagcaagacgtcgtggttctgggctcccaggaaggggccatgcacacagcccttaccggcgctacagagattcagatgagctccggaaatctgctctttaccggccatctgaaatgcagacttcggatggataagctgcaactcaaagggatgtcttacagcatgtgtaccggaaagttcaagatcgtgaaagaaattgcggagacacagcacggcacgatcgtcatcagagtgcagtatgagggggacggatccccctgcaagattcccttcgaaatcatggatctggagaaacgccatgtcctgggccggctcattaccgtgaaccctatcgttacagaaaaggacagcccggtgaacattgaggccgaacccccttttggggattcttacatcattatcggcgtcgagcccggacagctgaaacttaattggttcaagaagggctccagcatcgggcaaatgtttgagaccacaatgagaggagctaaacgcatggccattctgggcgacaccgcctgggatttcgggtctctcggaggcgtgtttacgagcatcgggaaggctctgcaccaggttttcggcgccatttacggagcggctttttccggcgtgtcttggacaatgaaaatcctgattggggtcatcatcacctggattggaatgaacagccggtccaccagcctttctgtgtccctcgtgctggttggcgtcgtgacactgtatctcggggccatggtgcaggccgacagcggatgtgtcgtgtcttggaagaataaagaactgaagtgcggctccgggatcttcattaccgataacgttcacacatggacggagcagtacaagtttcaacctgaaagcccctccaaacttgcttctgccatccagaaggctcatgaggaaggcatttgtggaatcagaagcgtgacccgcctggagaatctcatgtggaaacaggtcacaccggagctgaaccacatcctgtccgaaaatgaggtgaaacttaccattatgacaggcgacatcaaagggattatgcaggccggaaagcggtctctcagacctcaacccaccgaactgaaatatagctggaagacgtggggcaaggcgaaaatgctgtccaccgagagccataaccagacattcctcatcgatgggcctgaaaccgccgagtgccccaatacaaaccgcgcttggaactctctggaggttgaagactacggatttggcgtgttcaccacaaacatttggcttaagctgcgggagaaacaggacgtcttttgtgattccaagctcatgagcgccgctatcaaagacaatagagccgtgcacgcggatatgggctattggatcgaatctgccctgaacgacacctggaagatggagaaggcttccttcattgaggttaaaagctgccactggcctaagtctcatacgctgtggagcaatggggtgcttgaatccgagatgatcattcccaaaaacttcgccggaccggtcagccagcacaactaccgccctggctatcatacacaaaccgctgggccctggcacctcggaaagctggaaatggattttgacttctgtgagggcaccacagtggtggtcaccggggattgcggaaatcggggcccctctctgagaacgacaaccgcctccggcaaactcatcacagaatggtgctgtcggagctgcaccctgcctccgcttcgctacagaggggaggacggatgttggtacggcatggagattcggcccctgaaggaaaaggaggaaaacctcgttaattccctggtgacagccgggcatggacagatcgataacttttctctgggcgtgcttgggatggctctcttcctggaggaaatgctgagaacccgcgtcggaacgaaacacgcgattctcctggtggccgttagctttgtgacccttatcacaggcaatatgtccttccgggacctgggcagagtcatggtgatggttggggctaccatgacagatgacatcggaatgggcgtgacctatctcgccctgctggccgcttttaaggtccgccctacgttcgccgcggggcttctgctcagaaaactgacatctaaggagctcatgatggctaccattggaatcgccctgcttagccagtccacaattcccgagaccatcctggaactcaccgatgccctggctctgggcatgatggtgcttaaaattgttcggaacatggagaagtaccaactggccgtgacaatcatggcgatctcttgcgtccctaatgctgtgattctccagaacgcctggaaggtgagctgtacgatcctggccgtcgtttccgtgagccccctcctgcttacctcttcccagcagaaagctgactggattcctctggccctcacaatcaaggggctgaatcccaccgctatttttctgacaacccttagccgcacgtctaaaaagagatcctggccgctgaacgaagccatcatggcggtgggaatggtcagcatcctcgcctcttccctgctcaaaaatgacattcctatgacaggccccctggtggctggcgggcttctgaccgtttgctatgtgctgaccggacggagcgccgatctcgagctggaacgcgctgccgacgtcaagtgggaggatcaagccgagatctccggcagctctcctattcttagcatcacaatttccgaagacgggtctatgagcatcaaaaacgaggaagaggagcagaccctgacaattctcatcagaacgggactgctcgtgatctccggcgttttccccgtgtctattccgatcaccgctgcggcctggtacctgtgggaagtcaagaagcagcgggctggggtgctttgggatgtcccttctccccctcccgtgggaaaagccgagctggaagacggcgcctatcgcattaagcagagaggcatcctggggtactcccaaattggagctggcgtttataaagaggggacatttcacaccatgtggcatgtgacacggggagccgtcctcatgcaccgcggcaagagaatcgaaccctcctgggcggatgtgaaaaaggacctgatcagctacgggggaggctggaaacttgagggcgagtggaaagaaggggaggaagttcaggtgctggctctcgagcctggaaagaatccgcgggccgtccagaccaaacccggcctgttcaagacgaacaccgggacaattggagccgtgtccctcgattttagccctggcacctctgggtcccccatcgtggacagaaaaggaaaggttgtcggcctgtacggcaatggggtggtgacacgcagcggagcttatgtctctgccattgcgcagaccgaaaagtccatcgaggataaccctgagattgaagacgatatcttccggaaaaagagacttacaatcatggacctgcatcccggcgctgggaaaacgaagcgctacctgcctgccattgtgcgggaggccatcaaaagaggactccgcaccctgattcttgctccgacacgggttgtggccgctgaaatggaggaagccctgagaggcctccccatccgctatcaaacccctgcgattcgggccgagcacaccgggagagagatcgtcgacctgatgtgtcatgctacattcacgatgcggctcctgagccccgtgcgcgttcctaactacaatcttattatcatggatgaagcccactttaccgaccccgcttccatcgccgccagaggctatatttctacacgggtggagatgggagaagctgcgggcatcttcatgaccgccacaccgcctgggagccgcgatccctttccccagtccaacgctcctattatggacgaggagagagaaatccccgagcggagctggaactctggacacgaatgggtcaccgatttcaagggcaagacggtgtggtttgttccttccattaaagccgggaacgacatcgccgcttgcctgagaaagaatggcaagaaggtgatccagctgagccgcaaaacattcgattctgagtacgtcaagacccgggccaacgactgggattttgtggtgaccacagacattagcgaaatgggcgcgaatttcaaggctgagagagtcatcgatccgcgccggtgtatgaaacccgttattctcaccgacggggaggaaagagtgatcctggccggccctatgcccgtgacacattcctctgccgctcaacgccggggaagaattggccgcaaccctaagaatgagaacgaccagtatatctacatgggggaaccccttgagaatgatgaagactgcgcccactggaaagaggcgaagatgctgctcgataacatcaataccccggagggaattatccctagcatgtttgaacccgagagagaaaaagtcgacgccattgatggcgagtaccggctgcgcggggaagctagaaagacgttcgtggacctgatgcggcgcggagatctccctgtttggcttgcctatagagtggctgccgagggcatcaactacgctgaccggagatggtgttttgatgggattaaaaataaccagatcctggaggaaaacgtcgaggtggaaatttggacaaaggagggcgagcgcaagaaactgaagccccggtggctcgacgccagaatctattccgatcctctggcgcttaaagagttcaaggagttcgccgctggacgcaaatctctgaccctcaatctgatcacagaaatgggccggctgcccacctttatgacgcagaaggccagagacgctctcgataaccttgccgttctgcataccgccgaggctgggggaaaggcgtacaatcacgccctgagcgaactcccggagacactggagacccttctgctcctgacactgctcgctaccgtgacaggcgggattttcctttttctgatgtccggaaaaggcatcggcaagatgaccctggggatgtgctgcattatcacggccagcattctcctgtggtatgcccaaatccagcctcactggatcgctgcctctattatccttgagttctttctgattgtcctcctgatccccgagcccgaaaaacagcggacacctcaggacaaccaactgacctacgtggtcattgcgatcctcaccgtggttgccgctacaatggccaatgagatgggattccttgaaaagaccaaaaaggacctgggcctggggtccatcacaacgcaggagagcgagtccaacattctcgatatcgacctgcgcccggcttctgcctggaccctttatgcggtggccacaacctttgtgacacccatgctgagacatagcattgaaaattcctctgtcaacgttagcctcaccgctatcgccaatcaggctacggtgctgatgggactgggcaaggggtggcctctctccaaaatggatattggagtgccccttctggccatcggctgttacagccaggtcaaccctattaccctgacagctgccctcctgcttctggtggcgcactacgccatcatcggccccgggctccaagctaaggccacccgggaggctcagaaacgcgccgccgcgggaattatgaagaatcctacagttgacggcatcaccgtgattgatctggaaccgatcccctatgaccctaaattcgagaagcagctggggcaggtcatgctccttattctgtgcgtgacgcaagtcatgatgatgagaacaacctgggctctgtgtgaagccctcacactggctaccggacccatctctaccctttgggagggcaaccctgggcggttttggaatacaacgatcgccgtgtccatggccaacattttccgcggaagctacctggctggcgccggcctcctgttttctatcatgaagaataccacaaacaccagacgggggacaggaaatattggcgagaccctgggggaaaaatggaagtcccgcctcaacgcgcttggaaaaagcgagttccagatctataagaaatctggcattcaggaagttgatagaacgctggccaaggaggggatcaaacggggagagacagaccatcacgctgtgagcagaggctccgccaagctgcgctggtttgtcgaacggaacatggtgacccccgagggcaaggttgtggatctcgggtgcggaagaggcgggtggtcttactattgtggaggcctgaaaaatgtccgcgaagtgaaggggcttaccaaaggaggcccgggccatgaggaacctatccccatgagcacatacgggtggaacctggtgcggctccaatccggagttgacgtcttcttcacaccccctgagaagtgcgatacactgctgtgtgacattggcgagagctcccccaatcctacgatcgaagctgggagaaccctccgcgtgcttaacctggtggagaattggctgaacaataacacacagttttgcattaaagtcctcaatccgtatatgccctctgttatcgaaaagatggagaccctgcagcggaagtacggaggcgcccttgtgagaaaccctctgagccgcaattccacacacgaaatgtactgggtgtctaacgcgaccgggaatattgtcagctccgtgaacatgatctctcggatgctcatcaatagattcacgatgaaacacaagaaagccacctatgagcccgatgttgacctgggaagcggcacacgcaacattggcatcgagtccgaaattcctaacctggacatcattgggaagcggatcgagaaaattaagcaggaacatgagaccagctggcactacgatcaagaccatccctataagacatgggcttaccacggatcttatgaagccaaacagaccggctccgctagctctatggtgaatggggtcgtgagactccttacaaagccgtgggatgttgtgcctatggtcacccagatggccatgacggacacaaccccctttggacagcaacgcgtgttcaaagagaaggtggataccagaacacaggagcctaaagaaggcacgaagaagctgatgaaaatcaccgctgagtggctgtggaaggaactcgggaaaaagaaaacaccccggatgtgtacccgcgaggagtttacaagaaaggtccggtccaacgccgcgctgggagccatcttcaccgacgaaaataaatggaaaagcgctagagaggccgttgaagattctcggttttgggagcttgtggaccgcgaaagaaacctgcacctcgagggcaagtgcgagacatgtgtgtacaatatgatgggcaaacgggaaaagaaactgggggagttcggaaaggctaaaggctcccgcgccatttggtatatgtggctgggggccagatttctcgagttcgaggcgctgggatttcttaacgaagatcattggttcagccggggcaattccctgagcggggtcgagggcgagggactccaccgcctgggctacatccttagagacgtgtctaagaaggaagggggagctatgtacgccgatgacaccgccggctgggacacgcggattaccctggaggatctcaaaaacgaagagatggttacaaatcatatgaagggggaacacaaaaagctggctgaggccatctttaaactgacctatcagaacaaggtggtccgcgtgcagagacctacaccccggggaaccgttatggacattatcagccgcagagatcaacggggctccggacaggtgggcacgtacggactcaatacattcaccaacatggaggctcagctgatccgccaaatggaaggcgaggggattttcaagtctatccagcatcttacagtcaccgaagagattgccgtgcagaattggctggcgagagttggacgggagagactcagccgcatggtgatctccggcgacgattgcgtcgtgaaaccgctggacgatcggtttgcctctgctcttacggccctgaacgacatggggaaggtcagaaaagatattcagcaatgggaacctagccgcggatggaatgactggacccaggtgcccttctgctcccaccactttcatgagctcgttatgaaggatggccgggtgctggtcgtgccctgtagaaaccaggacgaactgatcgggcgcgctcggatctctcagggcgccggatggagcctcaaagagacagcgtgcctgggcaagtcctatgcccaaatgtggacccttatgtacttccacagacgcgatctgcggctcgctgccaacgctatttgtagcgccgtgccttctcattgggttccgacatccagaaccacatggagcatccacgctaagcacgaatggatgaccacggaggacatgctggccgtgtggaatcgcgtctggattcaggagaacccctggatggaagacaaaacacctgtggagtcttgggaagaggttccctatcttgggaagcgggaagatcagtggtgcggatccctgatcggcctcaccagcagagcgacctgggccaaaaatattcagacagctatcaaccaagtgcggtccctgattgggaatgaggagtacaccgactatatgccttctatgaagagatttcgccgggaagaggaagaggccggagtcctgtggtga

SEQ ID NO: 19915 - RNA, 9876 nt, synthetic construct
  misc_feature 1..9876: note = derived and/or modified CDS sequence (opt5) from DENV-2__EU482573__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatcgatctcggagaactgtgtgaggacaccattacctacaaatgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttctgcctgagaaccttgaatacaccatcgtgattacaccccacagcggggaggagcatgcggtgggaaatgacaccggcaagcacggcaaagaaatcaagatcacacctcagtcttccattaccgaggccgaactgacggggtatggaaccgtcacaatggagtgtagcccccggaccggcctcgatttcaacgaaatggtgctgcttcagatggaggacaaggcttggctggttcaccgccaatggtttctcgatctgccgctgccttggctccccggggccgacacacagggatctaattggatccagaaggagaccctggtgacgttcaagaaccctcatgctaaaaagcaggacgtcgtggttcttggctcccaagaaggggccatgcacacagccctgaccggcgctacagagattcagatgagctccggaaatctcctgtttaccggccatcttaaatgcagactgcggatggataagctccagctgaaagggatgtcttacagcatgtgtaccggaaagttcaagatcgtgaaagaaattgcggagacacaacacggcacgatcgtcatcagagtgcagtatgagggggacggatccccctgcaagattcccttcgaaatcatggatctggagaaacgccatgtcctcggccggctgattaccgtgaaccctatcgttacagaaaaggacagcccggtgaacattgaggccgaacccccttttggggattcttacatcattatcggcgtcgagcccggacagcttaaactgaattggttcaagaagggctccagcatcgggcagatgtttgagaccacaatgagaggagctaaacgcatggccattctcggcgacaccgcctgggatttcgggtctctgggaggcgtgtttacgagcatcgggaaggctctgcaccaagttttcggcgccatttacggagcggctttttccggcgtgtcttggacaatgaaaatccttattggggtcatcatcacctggattggaatgaacagccggtccaccagcctctctgtgtccctggtgctggttggcgtcgtgacactctatctgggggccatggtgcaggccgacagcggatgtgtcgtgtcttggaagaataaagaacttaagtgcggctccgggatcttcattaccgataacgttcacacatggacggagcagtacaagtttcagcctgaaagcccctccaaactggcttctgccatccaaaaggctcatgaggaaggcatttgtggaatcagaagcgtgacccgcctcgagaatctgatgtggaaacagatcacaccggagctgaaccacattctttccgaaaatgaggtcaagctcaccatcatgacaggcgacattaaagggatcatgcaggccggaaagcggtctctgagacctcagcccaccgaactgaaatatagctggaagacgtggggcaaggcgaaaatgctctccaccgagagccataaccaaacattcctgattgatgggcctgaaaccgccgagtgccccaatacaaaccgcgcttggaactctcttgaggtggaagactacggatttggcgttttcaccacaaacatctggctgaagctccgggagaaacaggacgtgttttgtgattccaagctgatgagcgccgctatcaaagacaatagagccgtccacgcggatatgggctattggattgaatctgccctgaacgacacctggaagatggagaaggcttccttcatcgaggtgaaaagctgccactggcctaagtctcatacgctttggagcaatggggttctcgaatccgagatgattatccccaaaaacttcgccggaccggtgagccagcacaactaccgccctggctatcatacacagaccgctgggccctggcacctgggaaagctggaaatggattttgacttctgtgagggcaccacagtcgtggtgaccgaagattgcgggaatcggggaccctctctcagaacgacaaccgcctccggcaaactgattacagagtggtgctgtcggagctgcacccttcctccgctgcgctacagaggcgaggacgggtgttggtacggaatggaaatccggcccctcaaggagaaggaagagaacctggtcaattccctggttacagccggccatgggcaaattgataacttttctcttggagtgctcggcatggctctgttcctggaagagatgctcagaacccgcgtggggacgaaacacgcgatcctgcttgtcgccgtgagctttgttaccctgatcacaggaaatatgtccttccgggacctcggcagagtgatggtcatggtgggcgctaccatgacagatgacattgggatgggagttacctatctggccctgcttgccgcttttaaggtgcgccctacgttcgccgcgggcctgctcctgagaaaactcacatctaaggagctgatgatggctaccatcgggattgcccttctgagccagtccacaatccccgaaaccattctcgagctgaccgatgccctggctcttggaatgatggtcctgaaaatcgtgcggaacatggaaaagtaccagctcgccgttacaatcatggcgatttcttgcgtgcctaatgctgtcatcctgcaaaacgcctggaaggtgagctgtacgattctcgccgctgtgtccgtcagccccctgcttctgacctcttcccagcagaaagccgactggatccctctcgctctgacaattaagggcctgaatcccaccgccatctttcttacaaccctgagccgcacgtctaaaaagagatcctggccgctcaacgaggcgatcatggccgttgggatggtgagcattctggcttcttccctcctgaaaaatgacatccctatgacaggaccccttgtggccggcggcctgctgaccgtctgctatgtgctcaccgggcggagcgctgatctggaacttgagcgcgccgccgacgttaagtgggaggatcaggctgaaatttccggaagctctcctatcctgagcattacaatctccgaggacggctctatgagcattaaaaacgaagaggaggaacaaaccctcacaatcctgatcagaacggggctcctggtgatttccggagtcttccccgtgtctatcccgattaccgcggccgcttggtacctttgggaggttaagaagcagcgggccggcgtgctgtgggatgtcccttctccccctcccgtggggaaagccgaactggaggacggagcttatcgcatcaagcagagaggcattctcggctactcccagatcggggccggagtctataaagaaggcacatttcacaccatgtggcatgtgacaagaggggcggttctgatgcaccgcggaaagagaatcgagccctcctgggctgatgtgaaaaaggaccttattagctacggcgggggatggaagctggagggcgaatggaaagagggcgaagaggtccaagtgctcgccctggaacctgggaagaatccgcgggccgttcagaccaaacccggactcttcaagacgaacaccggcacaatcggggctgtgtccctggattttagccctggaacctctggctcccccattgtcgacagaaaagggaaggtggtgggactttacggcaatggcgttgtcacacgcagcggggcctatgtgtctgcgatcgctcagaccgagaagtccattgaggataaccctgaaatcgaggacgatatcttccggaaaaagagactgacaattatggacctgcatcccggagccggcaaaacgaagcgctacctccctgccatcgtgcgggaagctattaaaagagggctgcgcacccttatcctggccccgacacgggtcgtggctgccgagatggaagaggcgctcagaggactgcccattcgctatcagacccctgccatccgggctgagcacaccggcagagaaattgttgacctcatgtgtcatgccacattcacgatgcggctgcttagccccgtgcgcgtccctaactacaatctgatcatcatggatgaggctcactttaccgaccccgcctccattgccgctagagggtatatctctacacgggtggaaatgggcgaggcggccggaattttcatgaccgctacaccgcctggcagccgcgatccctttccccaatccaacgcccctatcatggacgaggaaagagagattcccgaacggagctggaactctgggcacgagtgggttaccgatttcaagggaaagacggtgtggtttgtcccttccatcaaagccggcaacgacatcgctgcctgcctgagaaagaatgggaaaaaggtgattcagctcagccgcaaaacattcgattctgaatacgttaagacccgggcgaacgactgggattttgtggtcaccacagacatcagcgagatgggagctaatttcaaggccgagagagtgattgatccgcgccggtgtatgaaacccgtgatcctgaccgacggcgaagagagagtcattcttgccgggcctatgcccgttacacattcctctgctgcccagcgccggggcagaatcggacgcaaccctaagaatgaaaacgaccaatatatctacatgggcgagcccctggaaaatgatgaggactgcgcgcactggaaagaggccaagatgctcctggataacattaataccccggaagggatcattcctagcatgtttgagcccgaaagagagaaagtggacgctatcgatggagaataccggctgcgcggcgaggccagaaagacgttcgtggacctcatgcggcgcggggatcttcctgtctggctggcttatagagtggccgctgagggaattaactacgccgaccggagatggtgttttgatggcatcaaaaataaccagattctggaagagaacgttgaagtggagatctggacaaaggagggggaacgcaagaaactcaagccccggtggctggacgcgagaatctattccgatcctcttgccctgaaagagttcaaggagttcgctgccggccgcaaatctctcaccctgaatctgattacagagatgggacggctccccacctttatgacgcagaaggctagagacgcccttgataacctggccgtcctgcataccgctgaagcgggcgggcgggcctacaatcacgctctcagcgagctgccggagacacttgaaaccctgctcctgctgacactccttgccaccgtgacaggaggcatcttcctgtttctgatgtccgggaagggaattggcaaaatgaccctcggcatgtgctgcatcattacggccagcatcctgctttggtatgctcagatccaacctcactggattgccgcgtctatcattctggagttctttctcatcgttctgctgattcccgaacccgagaagcagcgcacacctcaggacaaccagctcacctacgtggtcatcgccatccttaccgtggtcgctgccacaatggctaatgaaatggggttcctggagaaaaccaagaaagacctgggactcggctccattacaacgcaagagagcgaatccaacatcctggatattgaccttagaccggcctctgcgtggaccctgtatgccgtggctacaacctttgttacacccatgctccggcatagcatcgaaaatagctctgtgaacgtgagcctgaccgccattgctaatcaggccacggtcctgatggggctcggaaagggctggcctctttccaagatggatatcggggttcccctgctggctattggatgttacagccaggtgaaccctatcaccctcacagccgcgctgcttctgctcgtggcccactacgctatcattggccccggcctgcaggccaaagctacccgcgaagcccaaaagagagccgcggctgggatcatgaaaaatcctacagtcgacggaattaccgtgatcgatctggagccgattccctatgaccctaagttcgaaaaacagctcggccaggttatgcttctgatcctgtgcgtgacgcaggtcctcatgatgcggacaacctgggccctgtgtgaggctcttacactggccaccgggcccatctctaccctctgggagggaaaccctggccgcttttggaatacaacgattgccgtgtccatggctaacatcttcagagggagctacctggccggagcgggcctgctcttttctattatgaagaataccacaaacacccggcgcggcacagggaatatcggagaaacccttggcgagaagtggaaatccagactgaacgccctgggaaagagcgagttccaaatttataaaaagtctggaatccaggaggtcgatcggacgctcgctaaagagggcatcaagagaggggaaacagaccatcacgccgtgagccgcggatccgctaaactgcggtggtttgttgagagaaacatggtgacccccgaaggcaaggtcgtggatcttggctgcgggcgcggaggctggtcttactattgtgggggactgaagaatgttcgggaggtgaaaggcctcaccaaagggggaccgggccatgaagaacctattcccatgagcacatacggctggaacctggtcagactgcagtccggggtggacgtgttcttcacaccccctgagaaatgcgatacactcctttgtgacatcggagaaagctcccccaatcctacgattgaggccggccgcaccctgcgggttctgaacctcgtcgaaaattggctgaacaataacacacaattttgcatcaaggtgcttaatccgtatatgccctctgtgattgagaaaatggaaaccctgcagagaaagtacgggggagcgctcgtccgcaaccctctgagcagaaattccacacacgagatgtactgggtttctaacgccaccggcaatatcgtgagctccgtgaacatgatctctagaatgctgattaatcgcttcacgatgaagcacaaaaaggctacctatgagcccgatgtcgacctcgggagcggaacacggaacatcggcattgaatccgagatccctaaccttgacattatcggcaaaagaattgaaaagatcaaacaggagcatgaaaccagctggcactacgatcaggaccatccctataagacatgggcctaccacgggtcttatgagaccaagcaaacaggatccgctagctctatggtgaatggcgttgtgcgcctgctgaccaaaccgtgggatgtcgtgcctatggttacgcagatggccatgacagacaccaccccctttgggcagcagagagtgttcaaggagaaagtcgatacacggacgcaagaacctaaggagggaaccaaaaagctcatgaagatcacagctgaatggctgtggaaagagcttggcaagaaaaagacaccccgcatgtgtacaagagaggaatttacccggaaagtgagatccaacgccgcgctgggggccattttcacagacgagaataagtggaaaagcgctcgggaagccgtggaggattctcgcttttgggaactcatcgacagagagcggaacctgcacctggagggaaagtgcgaaacctgtgtctacaatatgatgggcaagcgcgagaaaaagctcggcgagttcgggaaagctaagggatccagagccatttggtatatgtggctgggcgcccggtttcttgagttcgaagcgctggggtttctcaacgaggatcattggttcagccgcggaaattccctgagcggcgttgagggggaaggccttcacagactgggatacatcctccgggacgtgtctaaaaaggagggcggggctatgtacgccgatgacacggccggatgggacacccgcattacactggaagatctgaagaacgaggaaatggtgaccaatcatatgaaaggcgagcacaagaaactcgctgaggccatctttaagctgacatatcagaacaaagtcgtgagagttcagcggcctacaccccgcgggacggtgatggacatcattagcagacgggatcagcgcggatccggccaagtcgggacatacggccttaataccttcacaaacatggaagctcagctgatcagacagatggagggagaaggcattttcaagtctatccaacatctcaccgtgacggaggagattgccgttcagaattggctggcgcgggtggggagagaacgccttagccggatggccatctccggagacgattgcgtcgtgaagccgctggacgatagatttgcttctgccctcaccgctctgaacgacatgggcaaagttcgcaaggatatccagcagtgggagcctagccgggggtggaatgactggacacaagtgcccttctgctcccaccactttcatgaactggtcatgaaagatggaagagtgctcgtcgtgccctgtcgcaaccaggacgagctgattggccgggccagaatctctcagggggcgggctggagccttaaggaaaccgcctgcctgggaaaatcctatgctcagatgtggacactcatgtacttccaccgccgggatctgagacttgccgctaacgccatttgtagcgctgttccttctcattgggtgccgacctcccgcacaacctggagcatccacgccaagcacgagtggatgacgacagaggacatgctggcggtctggaatcgggtgtggattcaagaaaacccctggatggaggacaagacccctgtggaatcttgggaggaagttccctatctcggcaaaagagaggatcagtggtgcgggtccctgatcggactgaccagccgggccacatgggctaagaatattcagaccgccatcaaccaggtgagatccctcatcggcaatgaggaatacacagactatatgccttctatgaaacgctttcggagagaggaagaggaagccggggtcctgtggtga

SEQ ID NO: 19916 - RNA, 9876 nt, synthetic construct
  misc_feature 1..9876: note = derived and/or modified CDS sequence (opt5) from DENV-2__EU482574__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatcgatctcggagaactgtgtgaggacaccattacctacaaatgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttctgcctgagaaccttgaatacaccatcgtgattacaccccacagcggggaggagcatgcggtgggaaatgacaccggcaagcacggcaaagaaatcaagatcacacctcagtcttccattaccgaggccgaactgacggggtatggaaccgtcacaatggagtgtagcccccggaccggcctcgatttcaacgaaatggtgctgcttcacatggaggacaaggcttggctggttcatcgccagtggtttctcgatctgccgctgccttggctccccggggccgacacacaaggatctaattggatccagaaggagaccctggtgacgttcaagaaccctcacgctaaaaagcaggacgtcgtggttcttggctcccaggaaggggccatgcatacagccctgaccggcgctacagagattcaaatgagctccggaaatctcctgtttaccggccaccttaaatgcagactgcggatggataagctccagctgaaagggatgtcttacagcatgtgtaccggaaagttcaagatcgtgaaagaaattgcggagacacagcatggcacgatcgtcatcagagtgcaatatgagggggacggatccccctgcaagattcccttcgaaatcatggatctggagaaacgccacgtcctcggccggctgattaccgtgaaccctatcgttacagaaaaggacagcccggtgaacattgaggccgaacccccttttggggattcttacatcattatcggcgtcgagcccggacagcttaaactgaattggttcaagaagggctccagcatcgggcagatgtttgagaccacaatgagaggagctaaacgcatggccattctcggcgacaccgcctgggatttcgggtctctgggaggcgtgtttacgagcatcgggaaggctctgcaccaggttttcggcgccatttacggagcggctttttccggcgtgtcttggacaatgaaaatccttattggggtcatcatcacctggattggaatgaacagccggtccaccagcctctctgtgtccctggtgctggttggcgtcgtgacactctatctgggggccatggtgcaagccgacagcggatgtgtcgtgtcttggaagaataaagaacttaagtgcggctccgggatcttcattaccgataacgttcatacatggacggagcagtacaagtttcagcctgaaagcccctccaaactggcttctgccatccagaaggctcacgaggaaggcatttgtggaatcagaagcgtgacccgcctcgagaatctgatgtggaaacaaatcacaccggagctgaaccatattctttccgaaaatgaggtcaagctcaccatcatgacaggcgacattaaagggatcatgcaggccggaaagcggtctctgagacctcagcccaccgaactgaaatatagctggaagacgtggggcaaggcgaaaatgctctccaccgagagccacaaccagacattcctgattgatgggcctgaaaccgccgagtgccccaatacaaaccgcgcttggaactctcttgaggtggaagactacggatttggcgttttcaccacaaacatctggctgaagctccgggagaaacaagacgtgttttgtgattccaagctgatgagcgccgctatcaaagacaatagagccgtccacgcggatatgggctattggattgaatctgccctgaacgacacctggaagatggagaaggcttccttcatcgaggtgaaaagctgccattggcctaagtctcacacgctttggagcaatggggttctcgaatccgagatgattatccccaaaaacttcgccggaccggtgagccagcataactaccgccctggctatcacacacagaccgctgggccctggcatctgggaaagctggaaatggattttgacttctgtgagggcaccacagtcgtggtgaccgaagattgcgggaatcggggaccctctctcagaacgacaaccgcctccggcaaactgattacagagtggtgctgtcggagctgcacccttcctccgctgcgctacagaggcgaggacgggtgttggtacggaatggaaatccggcccctcaaggagaaggaagagaacctggtcaattccctggttacagccggccacgggcagattgataacttttctcttggagtgctcggcatggctctgttcctggaagagatgctcagaacccgcgtggggacgaaacacgcgatcctgcttgtcgccgtgagctttgttaccctgatcacaggaaatatgtccttccgggacctcggcagagtgatggtcatggtgggcgctaccatgacagatgacattgggatgggagttacctatctggccctgcttgccgcttttaaggtgcgccctacgttcgccgcgggcctgctcctgagaaaactcacatctaaggagctgatgatggctaccatcgggattgcccttctgagccaatccacaatccccgaaaccattctcgagctgaccgatgccctggctcttggaatgatggtcctgaaaatcgtgcggaacatggaaaagtaccagctcgccgttacaatcatggcgatttcttgcgtgcctaatgctgtcatcctgcagaacgcctggaaggtgagctgtacgattctcgccgctgtgtccgtcagccccctgcttctgacctcttcccaacagaaagccgactggatccctctcgctctgacaattaagggcctgaatcccaccgccatctttcttacaaccctgagccgcacgtctaaaaagagatcctggccgctcaacgaggcgatcatggccgttgggatggtgagcattctggcttcttccctcctgaaaaatgacatccctatgacaggaccccttgtggccggcggcctgctgaccgtctgctatgtgctcaccgggcggagcgctgatctggaacttgagcgcgccgccgacgttaagtgggaggatcaggctgaaatttccggaagctctcctatcctgagcattacaatctccgaggacggctctatgagcattaaaaacgaagaggaggaacagaccctcacaatcctgatcagaacggggctcctggtgatttccggagtcttccccgtgtctatcccgattaccgcggccgcttggtacctttgggaggttaagaagcaacgggccggcgtgctgtgggatgtcccttctccccctcccgtggggaaagccgaactggaggacggagcttatcgcatcaagcagagaggcattctcggctactcccagatcggggccggagtctataaagaaggcacatttcataccatgtggcacgtgacaagaggggcggttctgatgcatcgcggaaagagaatcgagccctcctgggctgatgtgaaaaaggaccttattagctacggcgggggatggaagctggagggcgaatggaaagagggcgaagaggtccaggtgctcgccctggaacctgggaagaatccgcgggccgttcaaaccaaacccggactcttcaagacgaacaccggcacaatcggggctgtgtccctggattttagccctggaacctctggctcccccattgtcgacagaaaagggaaggtggtgggactttacggcaatggcgttgtcacacgcagcggggcctatgtgtctgcgatcgctcagaccgagaagtccattgaggataaccctgaaatcgaggacgatatcttccggaaaaagagactgacaattatggacctgcaccccggagccggcaaaacgaagcgctacctccctgccatcgtgcgggaagctattaaaagagggctgcgcacccttatcctggccccgacacgggtcgtggctgccgagatggaagaggcgctcagaggactgcccattcgctatcagacccctgccatccgggctgagcataccggcagagaaattgttgacctcatgtgtcacgccacattcacgatgcggctgcttagccccgtgcgcgtccctaactacaatctgatcatcatggatgaggctcactttaccgaccccgcctccattgccgctagagggtatatctctacacgggtggaaatgggcgaggcggccggaattttcatgaccgctacaccgcctggcagccgcgatccctttccccagtccaacgcccctatcatggacgaggaaagagagattcccgaacggagctggaactctgggcatgagtgggttaccgatttcaagggaaagacggtgtggtttgtcccttccatcaaagccggcaacgacatcgctgcctgcctgagaaagaatgggaaaaaggtgattcaactcagccgcaaaacattcgattctgaatacgttaagacccgggcgaacgactgggattttgtggtcaccacagacatcagcgagatgggagctaatttcaaggccgagagagtgattgatccgcgccggtgtatgaaacccgtgatcctgaccgacggcgaagagagagtcattcttgccgggcctatgcccgttacacactcctctgctgcccagcgccggggcagaatcggacgcaaccctaagaatgaaaacgaccagtatatctacatgggcgagcccctggaaaatgatgaggactgcgcgcattggaaagaggccaagatgctcctggataacattaataccccggaagggatcattcctagcatgtttgagcccgaaagagagaaagtggacgctatcgatggagaataccggctgcgcggcgaggccagaaagacgttcgtggacctcatgcggcgcggggatcttcctgtctggctggcttatagagtggccgctgagggaattaactacgccgaccggagatggtgttttgatggcatcaaaaataaccaaattctggaagagaacgttgaagtggagatctggacaaaggagggggaacgcaagaaactcaagccccggtggctggacgcgagaatctattccgatcctcttgccctgaaagagttcaaggagttcgctgccggccgcaaatctctcaccctgaatctgattacagagatgggacggctccccacctttatgacgcagaaggctagagacgcccttgataacctggccgtcctgcacaccgctgaagcgggcgggcgggcctacaatcacgctctcagcgagctgccggagacacttgaaaccctgctcctgctgacactccttgccaccgtgacaggaggcatcttcctgtttctgatgtccgggaagggaattggcaaaatgaccctcggcatgtgctgcatcattacggccagcatcctgctttggtatgctcagatccagcctcattggattgccgcgtctatcattctggagttctttctcatcgttctgctgattcccgaacccgagaagcaacgcacacctcaggacaaccagctcacctacgtggtcatcgccatccttaccgtggtcgctgccacaatggctaatgaaatggggttcctggagaaaaccaagaaagacctgggactcggctccattacaacgcaggagagcgaatccaacatcctggatattgaccttagaccggcctctgcgtggaccctgtatgccgtggctacaacctttgttacacccatgctccggcacagcatcgaaaatagctctgtgaacgtgagcctgaccgccattgctaatcaagccacggtcctgatggggctcggaaagggctggcctctttccaagatggatatcggggttcccctgctggctattggatgttacagccaggtgaaccctatcaccctcacagccgcgctgcttctgctcgtggcccattacgctatcattggccccggcctgcaggccaaagctacccgcgaagcccagaagagagccgcggctgggatcatgaaaaatcctacagtcgacggaattaccgtgatcgatctggagccgattccctatgaccctaagttcgaaaaacaactcggccaggttatgcttctgatcctgtgcgtgacgcaggtcctcatgatgcggacaacctgggccctgtgtgaggctcttacactggccaccgggcccatctctaccctctgggagggaaaccctggccgcttttggaatacaacgattgccgtgtccatggctaacatcttcagagggagctacctggccggagcgggcctgctcttttctattatgaagaataccacaaacacccggcgcggcacagggaatatcggagaaacccttggcgagaagtggaaatccagactgaacgccctgggaaagagcgagttccagatttataaaaagtctggaatccaagaggtcgatcggacgctcgctaaagagggcatcaagagaggggaaacagaccaccatgccgtgagccgcggatccgctaaactgcggtggtttgttgagagaaacatggtgacccccgaaggcaaggtcgtggatcttggctgcgggcgcggaggctggtcttactattgtgggggactgaagaatgttcgggaggtgaaaggcctcaccaaagggggaccgggccacgaagaacctattcccatgagcacatacggctggaacctggtcagactgcagtccggggtggacgtgttcttcacaccccctgagaaatgcgatacactcctttgtgacatcggagaaagctcccccaatcctacgattgaggccggccgcaccctgcgggttctgaacctcgtcgaaaattggctgaacaataacacacagttttgcatcaaggtgcttaatccgtatatgccctctgtgattgagaaaatggaaaccctgcaaagaaagtacgggggagcgctcgtccgcaaccctctgagcagaaattccacacacgagatgtactgggtttctaacgccaccggcaatatcgtgagctccgtgaacatgatctctagaatgctgattaatcgcttcacgatgaagcataaaaaggctacctatgagcccgatgtcgacctcgggagcggaacacggaacatcggcattgaatccgagatccctaaccttgacattatcggcaaaagaattgaaaagatcaaacaggagcacgaaaccagctggcattacgatcaggaccacccctataagacatgggcctaccacgggtcttatgagaccaagcagacaggatccgctagctctatggtgaatggcgttgtgcgcctgctgaccaaaccgtgggatgtcgtgcctatggttacgcaaatggccatgacagacaccaccccctttgggcagcagagagtgttcaaggagaaagtcgatacacggacgcaggaacctaaggagggaaccaaaaagctcatgaagatcacagctgaatggctgtggaaagagcttggcaagaaaaagacaccccgcatgtgtacaagagaggaatttacccggaaagtgagatccaacgccgcgctgggggccattttcacagacgagaataagtggaaaagcgctcgggaagccgtggaggattctcgcttttgggaactcatcgacagagagcggaacctgcatctggagggaaagtgcgaaacctgtgtctacaatatgatgggcaagcgcgagaaaaagctcggcgagttcgggaaagctaagggatccagagccatttggtatatgtggctgggcgcccggtttcttgagttcgaagcgctggggtttctcaacgaggatcactggttcagccgcggaaattccctgagcggcgttgagggggaaggccttcatagactgggatacatcctccgggacgtgtctaaaaaggagggcggggctatgtacgccgatgacacggccggatgggacacccgcattacactggaagatctgaagaacgaggaaatggtgaccaatcacatgaaaggcgagcataagaaactcgctgaggccatctttaagctgacatatcaaaacaaagtcgtgagagttcagcggcctacaccccgcgggacggtgatggacatcattagcagacgggatcagcgcggatccggccaggtcgggacatacggccttaataccttcacaaacatggaagctcaactgatcagacagatggagggagaaggcattttcaagtctatccagcacctcaccgtgacggaggagattgccgttcaaaattggctggcgcgggtggggagagaacgccttagccggatggccatctccggagacgattgcgtcgtgaagccgctggacgatagatttgcttctgccctcaccgctctgaacgacatgggcaaagttcgcaaggatatccagcagtgggagcctagccgggggtggaatgactggacacaggtgcccttctgctcccaccattttcacgaactggtcatgaaagatggaagagtgctcgtcgtgccctgtcgcaaccaagacgagctgattggccgggccagaatctctcagggggcgggctggagccttaaggaaaccgcctgcctgggaaaatcctatgctcagatgtggacactcatgtacttccatcgccgggatctgagacttgccgctaacgccatttgtagcgctgttccttctcactgggtgccgacctcccgcacaacctggagcatccacgccaagcatgagtggatgacgacagaggacatgctggcggtctggaatcgggtgtggattcaggaaaacccctggatggaggacaagacccctgtggaatcttgggaggaagttccctatctcggcaaaagagaggatcaatggtgcgggtccctgatcggactgaccagccgggccacatgggctaagaatattcagaccgccatcaaccaggtgagatccctcatcggcaatgaggaatacacagactatatgccttctatgaaacgctttcggagagaggaagaggaagccggggtcctgtggtga

SEQ ID NO: 19917 - RNA, 9876 nt, synthetic construct
  misc_feature 1..9876: note = derived and/or modified CDS sequence (opt5) from DENV-2__EU482575__SS-prME
  source 1..9876: mol_type = other RNA
acagccggcgtgatcattatgctgatccccacagctatggccttccacctcacgaccagaaatggggagcctcatatgattgtcggacggcaggaaaagggcaaatccctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagagacggcgcgaaaagagaagcgtggctctcgtccctcacgtgggaatgggcctggagacccggacggaaacatggatgtcctctgagggcgcctggaaacatgttcagcgcatcgagacctggattctgagacaccccgggttcacaatcatggccgctattctcgcctacaccatcggaaccacacattttcagcgggctctgattttcatccttctgacggccgtggcgcctagcatgaccatgcgctgcattggcatctccaacagagattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgcggaaatattgcatcgaagctaagctcacaaacaccaccacagagagccgctgtccgacccaaggagagccctctctgaatgaggaacaggacaaaagatttctgtgcaagcactccatggtggatcggggctggggcaacgggtgtggactcttcggcaaagggggaattgtgacatgcgccatgtttacgtgcaaaaagaatatggaaggcaaagtcgttctgcctgagaaccttgaatacaccatcgtgattacaccccatagcggggaggagcacgcggtgggaaatgacaccggcaagcatggcaaagaaatcaagatcacacctcagtcttccattaccgaggccgaactgacggggtatggaaccgtcacaatggagtgtagcccccgcaccggcctcgatttcaacgaaatggtgctgcttcagatggaggacaaggcttggctggttcacagacaatggtttctcgatctgccgctgccttggctccccggggccgacacacagggatctaattggatccagaaggagaccctggtgacgttcaagaaccctcacgctaaaaagcaggacgtcgtggttcttggctcccaagaaggggccatgcatacagccctgaccggcgctacagagattcagatgagctccggaaatctcctgtttaccggccaccttaaatgccggctgagaatggataagctccagctgaaagggatgtcttacagcatgtgtaccggaaagttcaagatcgtgaaagaaattgcggagacacaacatggcacgatcgtcatccgcgtgcagtatgagggggacggatccccctgcaagattcccttcgaaatcatggatctggagaaacggcacgtcctcggcagactgattaccgtgaaccctatcgttacagaaaaggacagcccggtgaacattgaggccgaacccccttttggggattcttacatcattatcggcgtcgagcccggacagcttaaactgaattggttcaagaagggctccagcatcgggcagatgtttgagaccacaatgcgcggagctaaacggatggccattctcggcgacaccgcctgggatttcgggtctctgggaggcgtgtttacgagcatcgggaaggctctgcatcaagttttcggcgccatttacggagcggctttttccggcgtgtcttggacaatgaaaatccttattggggtcatcatcacctggattggaatgaacagcagatccaccagcctctctgtgtccctggtgctggttggcgtcgtgacactctatctgggggccatggtgcaggccgacagcggatgtgtcgtgtcttggaagaataaagaacttaagtgcggctccgggatcttcattaccgataacgttcacacatggacggagcagtacaagtttcagcctgaaagcccctccaaactggcttctgccatccaaaaggctcacgaggaaggcatttgtggaatccgcagcgtgacccggctcgagaatctgatgtggaaacagatcacaccggagctgaaccatattctttccgaaaatgaggtcaagctcaccatcatgacaggcgacattaaagggatcatgcaggccggaaagagatctctgcgccctcagcccaccgaactgaaatatagctggaagacgtggggcaaggcgaaaatgctctccaccgagagccacaaccaaacattcctgattgatgggcctgaaaccgccgagtgccccaatacaaaccgggcttggaactctcttgaggtggaagactacggatttggcgttttctccaccaacatctggctgaagctcagagagaaacaggacgtgttttgtgatagcaagctgatgtctgccgctatcaaagacaatcgcgccgtccatgcggatatgggctattggattgaatccgccctgaacgacacatggaagatggagaaggctagcttcatcgaggtgaaatcttgccactggcctaagagccacaccctttggtccaatggggttctcgaaagcgagatgattatccccaaaaacttcgccggaccggtgtctcagcataactaccggcctggctatcacacgcagacagctgggccctggcatctgggaaagctggaaatggattttgacttctgtgagggcaccaccgtcgtggtgacagaagattgcgggaatagaggaccctccctccggaccacgacagccagcggcaaactgattaccgagtggtgctgtcgctcctgcacacttcctccgctgagataccggggcgaggacgggtgttggtacggaatggaaatcagacccctcaaggagaaggaagagaacctggtcaattctctggttaccgccggccacgggcaaattgataactttagccttggagtgctcggcatggctctgttcctggaagagatgctccgcacacgggtggggaccaaacatgcgatcctgcttgtcgccgtgtcctttgttacgctgatcaccggaaatatgtctttcagagacctcggccgcgtgatggtcatggtgggcgctacaatgaccgatgacattgggatgggagttacatatctggccctgcttgccgcttttaaggtgagacctaccttcgccgcgggcctgctcctgcggaaactcacgagcaaggagctgatgatggctacaatcgggattgcccttctgtcccagtctaccatccccgaaacaattctcgagctgaccgatgccctggctcttggaatgatggtcctgaaaatcgtgcgcaacatggaaaagtaccagctcgccgttaccatcatggcgattagctgcgtgcctaatgctgtcatcctgcaaaacgcctggaaggtgtcctgtacaattctcgccgctgtgagcgtctctcccctgcttctgacgtccagccagcagaaagccgactggatccctctcgctctgaccattaagggcctgaatcccacagccatctttcttaccacactgtctagaacctccaaaaagcggagctggccgctcaacgaggcgatcatggccgttgggatggtgtctattctggcttccagcctcctgaaaaatgacatccctatgacgggaccccttgtggccggcggcctgctgacagtctgctatgtgctcaccgggcgctccgctgatctggaacttgagagagccgccgacgttaagtgggaggatcaggctgaaattagcggatctagccctatcctgtccattaccatctctgaggacggcagcatgtccattaaaaacgaagaggaggaacaaacactcaccatcctgatccggacagggctcctggtgatttctggagtcttccccgtgagcatcccgattacggcggccgcttggtacctttgggaggttaagaagcagcgcgccggcgtgctgtgggatgtcccttctccccctcccgtggggaaagccgaactggaggacggagcttatagaatcaagcagcggggcattctcggctacagccagatcggggccggagtctataaagaaggcacctttcacacaatgtggcacgtgacccgcggggcggttctgatgcatagaggaaagcggatcgagcccagctgggctgatgtgaaaaaggaccttatttcctacggcgggggatggaagctggagggcgaatggaaagagggcgaagaggtccaagtgctcgccctggaacctgggaagaatccgagagccgttcagacaaaacccggactcttcaagaccaacacgggcaccatcggggctgtgagcctggatttttctcctggaacatccggcagccccattgtcgaccgcaaagggaaggtggtgggactttacggcaatggcgttgtcacccggtctggggcctatgtgtccgcgatcgctcagacagaaaagagcattgaggataaccctgaaatcgaggacgatatcttccgcaagaagcgcctgaccattatggacctgcaccccggagccggcaaaacaaagcggtacctccctgccatcgtgagagaagctattaaacgcgggctgcggacgcttatcctggccccgaccagagtcgtggctgccgagatggaagaggcgctccgcggactgcccattcggtatcagacccctgccatcagagctgagcataccggccgggaaattgttgacctcatgtgtcacgccaccttcacaatgcgcctgctttcccccgtgagagtccctaactacaatctgatcatcatggatgaggctcattttacggaccccgcctctattgccgctcgggggtatatcagcacccgcgtggaaatgggcgaggcggccggaattttcatgacagctaccccgcctggctccagagatccctttccccaaagcaacgcccctatcatggacgaggaacgggagattcccgaaagatcttggaactccgggcacgagtgggttacagatttcaagggaaagaccgtgtggtttgtccctagcatcaaagccggcaacgacatcgctgcctgcctgcgcaagaatgggaaaaaggtgattcagctctctcggaaaacgttcgatagcgaatacgttaagacaagagcgaacgactgggattttgtggtcaccaccgacatctccgagatgggagctaatttcaaggccgagcgcgtgattgatccgcggagatgtatgaaacccgtgatcctgacagacggcgaagaaagagtcattcttgccgggcctatgcccgttacccactctagcgctgcccagcggagaggccgcatcggaagaaaccctaagaatgaaaacgaccaatatatctacatgggcgagcccctggaaaatgatgaggactgcgcgcattggaaagaggccaagatgctcctggataacattaatacaccggaagggatcattccttccatgtttgagcccgaacgggagaaagtggacgctatcgatggagaataccgcctgagaggcgaggcccggaagaccttcgtggacctcatgcgcagaggggatcttcctgtctggctggcttatcgggtggccgctgagggaattaactacgccgacagacgctggtgttttgatggcatcaaaaataaccagattctggaagagaacgttgaagtggagatctggacgaaggagggggaacggaagaaactcaagcccagatggctggacgcgcgcatctattctgatcctcttgccctgaaagagttcaaggagttcgctgccggccggaaaagcctcacactgaatctgattaccgagatgggaagactccccacatttatgacccagaaggctcgggacgcccttgataacctggccgtcctgcacacggctgaagcgggcgggcgcgcctacaatcatgctctctccgagctgccggagacccttgaaacactgctcctgctgaccctccttgccacagtgaccggaggcatcttcctgtttctgatgagcgggaagggaattggcaaaatgacactcggcatgtgctgcatcattaccgcctctatcctgctttggtatgctcagatccaacctcactggattgccgcgtccatcattctggagttctttctcatcgttctgctgattcccgaacccgagaagcagagaacgcctcaggacaaccagctcacatacgtggtcatcgccatccttaccgtggtcgctgccaccatggctaatgaaatggggttcctggagaaaacaaagaaagacctgggactcggcagcattaccacacaagagtccgaatctaacatcctggatattgaccttcggccggccagcgcgtggacgctgtatgccgtggctaccacatttgttacccccatgctccgccactccatcgaaaattctagcgtgaacgtgtccctgacagccattgctaatcaggccaccgtcctgatggggctcggaaagggctggcctcttagcaagatggatatcggggttcccctgctggctattggatgttactctcaggtgaaccctatcacgctcaccgccgcgctgcttctgctcgtggcccattacgctatcattggccccggcctgcaggccaaagctacaagagaagcccaaaagcgggccgcggctgggatcatgaaaaatcctaccgtcgacggaattacagtgatcgatctggagccgattccctatgaccctaagttcgaaaaacagctcggccaggttatgcttctgatcctgtgcgtgacccaggtcctcatgatgcgcacgacatgggccctgtgtgaggctcttaccctggccacagggcccatctccaccctctgggagggaaaccctggcagattttggaataccacaattgccgtgagcatggctaacatcttccgggggtcttacctggccggagcgggcctgctcttttccattatgaagaatacgaccaacacacgcagaggcaccgggaatatcggagaaacacttggcgagaagtggaaaagccggctgaacgccctggggaagtctgagttccaaatttataaaaagagcggaatccaggaggtcgatagaaccctcgctaaagagggcatcaagcgcggggaaacggaccaccatgccgtgtcccggggatctgctaaactgagatggtttgttgagcgcaacatggtgacacccgaaggcaaggtcgtggatcttggctgcgggcggggaggctggagctactattgtgggggactgaagaatgttagagaggtgaaaggcctcaccaaagggggaccgggccacgaggaacctattcccatgtccacctacggctggaacctggtccgcctgcagagcggggtggacgtgttcttcacaccccctgagaaatgcgataccctcctttgtgacatcggagaatcctctcccaatcctacaattgaggccggccggacgctgagagttctgaacctcgtcgaaaattggctgaacaataacacccaattttgcatcaaggtgcttaatccgtatatgcccagcgtgattgagaaaatggaaacactgcagcgcaagtacgggggagcgctcgtccggaaccctctgtccagaaattctacccatgagatgtactgggttagcaacgccacaggcaatatcgtgtcctctgtgaacatgatcagccgcatgctgattaatcggttcaccatgaagcacaaaaaggctacgtatgagcccgatgtcgacctcgggtccggaaccagaaacatcggcattgaaagcgagatccctaaccttgacattatcggcaaacgcattgaaaagatcaaacaggagcacgaaacatcttggcattacgatcaggaccacccctataagacctgggcctaccatgggtcctatgagacaaagcaaaccggaagcgcttcttccatggtgaatggcgttgtgagactgctgacaaaaccgtgggatgtcgtgcctatggttacccagatggccatgacggacacaaccccctttgggcagcagcgggtgttcaaggagaaagtcgatacccgcacacaagaacctaaggagggaacgaaaaagctcatgaagatcaccgctgaatggctgtggaaagagcttggcaagaaaaagacacccagaatgtgtacccgggaggaatttacaagaaaagtgcggagcaacgccgcgctgggggccattttcaccgacgagaataagtggaaatctgctcgcgaagccgtggaggattccagattttgggaactcatcgaccgggagcgcaacctgcacctggagggaaagtgcgaaacatgtgtctacaatatgatgggcaagagagagaaaaagctcggcgagttcgggaaagctaagggaagccgggccatttggtatatgtggctgggcgcccgctttcttgagttcgaagcgctggggtttctcaacgaggatcactggttctccagaggaaatagcctgtctggcgttgagggggaaggccttcatcggctgggatacatcctccgcgacgtgagcaaaaaggagggcggggctatgtacgccgatgacaccgccggatgggacacgagaattaccctggaagatctgaagaacgaggaaatggtgacaaatcacatgaaaggcgagcataagaaactcgctgaggccatctttaagctgacctatcagaacaaagtcgtgcgggttcagcgccctacacccagagggaccgtgatggacatcatttcccggcgcgatcagagaggatctggccaagtcgggacgtacggccttaatacattcaccaacatggaagctcagctgatccggcagatggagggagaaggcattttcaagagcatccaacacctcacagtgaccgaggagattgccgttcagaattggctggcgagagtggggcgcgaacggctttccagaatggccatctctggagacgattgcgtcgtgaagccgctggacgatcgctttgctagcgccctcacggctctgaacgacatgggcaaagttcggaaggatatccagcagtgggagccttccagagggtggaatgactggacccaagtgcccttctgctctcatcactttcacgaactggtcatgaaagatggacgcgtgctcgtcgtgccctgtcggaaccaggacgagctgattggcagagcccgcatcagccagggggcgggctggtcccttaaggaaacagcctgcctgggaaaaagctatgctcagatgtggaccctcatgtacttccatcggagagatctgcgccttgccgctaacgccatttgttctgctgttccttcccactgggtgccgacaagccggaccacatggtctatccatgccaagcacgagtggatgaccacggaggacatgctggcggtctggaatagagtgtggattcaagaaaacccctggatggaggacaagacacctgtggaatcctgggaggaagttccctatctcggcaaacgggaggatcagtggtgcgggagcctgatcggactgacctccagagccacctgggctaagaatattcagacagccatcaaccaggtgcgctctctcatcggcaatgaggaatacaccgactatatgcctagcatgaaacggtttagacgcgaggaagaggaagccggggtcctgtggtga

SEQ ID NO: 19918 - RNA, 9876 nt, synthetic construct
  misc_feature 1..9876: note = derived and/or modified CDS sequence (opt5) from DENV-2__EU482578__SS-prME
  source 1..9876: mol_type = other RNA
accgccggcgtgatcattatgctgatccccaccgctatggccttccacctcacgacccggaacggggagcctcatatgattgtcggacggcaggaaaagggcaagtccctgctttttaagaccgaggacggggttaatatgtgcaccctgatggcgatcgatctcggagaactgtgtgaggacaccattacctacaagtgcccgcttctgcgccaaaacgaacccgaggatatcgactgttggtgcaattccacgtctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagtccaaagaactgaagtgcggcagcgggatcttcattaccgataatgtgcacacatggacggagcagtacaagtttcagcctgaatccccctctaaacttgctagcgccatccaaaaggctcatgaggaaggcatttgtggaatcagatccgtcacccgcctggagaacctcatgtggaaacagatcacaccggagctgaatcacattctgtctgaaaacgaggtgaaacttaccatcatgacaggcgacattaaagggatcatgcaggccggaaagcggagcctcagacctcagcccaccgaactgaaatattcctggaagacgtggggcaaggcgaaaatgctgagcaccgagtctcataatcaaacattcctcattgatgggcctgaaaccgccgagtgccccaacacaaatcgcgcttggaactccctggaggttgaagactacggatttggcgtgttcaccacaaatatctggcttaagctgcgggagaaacaggacgtcttttgtgatagcaagctcatgtctgccgctatcaaagacaacagagccgtgcacgcggatatgggctattggattgaatccgccctgaatgacacctggaagatggagaaggctagcttcatcgaggttaaatcttgccactggcctaagagccatacgctgtggtccaacggggtgcttgaaagcgagatgattatccccaaaaatttcgccggaccggtctctcagcacaactaccgccctggctatcatacacagaccgctgggccctggcacctcggaaagctggaaatggattttgacttctgtgagggcaccacagtggtggtcaccgaagattgcgggaaccggggaccctccctgagaacgacaaccgccagcggcaaactcattacagagtggtgctgtcggtcctgcaccctgcctccgcttcgctacagaggcgaggacgggtgttggtacggaatggaaatccggcccctgaaggagaaggaagagaatctcgttaactctctggtgacagccggccatgggcaaattgataattttagcctgggagtgcttggcatggctctcttcctggaagagatgctgagaacccgcgtcgggacgaaacacgcgatcctcctggtggccgtttcctttgtgacccttatcacaggaaacatgtctttccgggacctgggcagagtcatggtgatggttggcgctaccatgacagatgacattgggatgggagtgacctatctcgccctgctggccgcttttaaggtccgccctacgttcgccgcgggccttctgctcagaaaactgacaagcaaggagctcatgatggctaccatcgggattgccctgctttcccagtctacaatccccgaaaccattctggagctcaccgatgccctggctctgggaatgatggtgcttaaaatcgttcggaatatggaaaagtaccagctggccgtgacaatcatggcgattagctgcgtccctaacgctgtgatcctccaaaatgcctggaaggtgtcctgtacgattctggccgctgtcagcgtttctcccctcctgcttacctccagccagcagaaagccgactggatccctctggctctcacaattaagggcctgaaccccaccgccatctttctgacaaccctttctcgcacgtccaaaaagagaagctggccgctgaatgaggcgatcatggccgtggggatggtgtctattctcgcttccagcctgctcaaaaacgacatccctatgacaggacccctggtcgccggcggccttctgaccgtgtgctatgttctgaccgggcggtccgctgatctcgaactggagcgcgccgccgacgtgaagtgggaggatcaggctgaaattagcggatctagccctatcctttccattacaatctctgaggacggcagcatgtccattaaaaatgaagaggaggaacaaaccctgacaatcctcatcagaacggggctgctcgtcatttctggagtgttccccgttagcatcccgattaccgcggccgcttggtacctgtgggaggtgaagaagcagcgggccggcgtcctttgggatgtgccttctccccctcccgtcgggaaagccgaactggaggacggagcttatcgcatcaagcagagaggcattctgggctacagccagatcggggccggagtgtataaagaaggcacatttcacaccatgtggcatgttacaagaggggcggtgctcatgcaccgcggaaagagaatcgagcccagctgggctgatgtcaaaaaggacctgatttcctacggcgggggatggaaacttgagggcgaatggaaagagggcgaagaggtgcaagttctggccctcgaacctgggaagaacccgcgggccgtgcagaccaaacccggactgttcaagacgaataccggcacaatcggggctgtcagcctcgatttttctcctggaacctccggcagccccattgtggacagaaaagggaaggtggttggactgtacggcaacggcgtcgtgacacgctctggggcctatgtgtccgcgatcgctcagaccgaaaagagcattgaggataatcctgaaatcgaggacgatatcttccggaaaaagagacttacaattatggacctgcatcccggagccggcaaaacgaagcgctacctgcctgccatcgtccgggaagctattaaaagagggctccgcaccctgatccttgccccgacacgggtggttgctgccgagatggaagaggcgctgagaggactccccattcgctatcagacccctgccatccgggctgagcacaccggcagagaaattgtggacctgatgtgtcatgccacattcacgatgcggctcctgtcccccgtccgcgtgcctaactacaaccttatcatcatggatgaggctcactttaccgaccccgcctctattgccgctagagggtatatcagcacacgggttgaaatgggcgaggcggccggaattttcatgaccgctacaccgcctggctcccgcgatccctttccccaaagcaatgcccctatcatggacgaggaaagagagattcccgaacggtcttggaactccgggcacgagtgggtgaccgatttcaagggaaagacggtctggtttgtgcctagcatcaaagccggcaatgacatcgctgcctgcctgagaaagaacgggaaaaaggttattcagctgtctcgcaaaacattcgatagcgaatacgtgaagacccgggcgaatgactgggattttgtcgtgaccacagacatctccgagatgggagctaacttcaaggccgagagagtgattgatccgcgccggtgtatgaaacccgtcatcctcaccgacggcgaagagagagttattctggccgggcctatgcccgtgacacattctagcgctgcccagcgccggggcagaatcggacgcaatcctaagaacgaaaatgaccaatatatctacatgggcgagccccttgaaaacgatgaggactgcgcgcactggaaagaggccaagatgctgctcgataatattaacaccccggaagggatcattccttccatgtttgagcccgaaagagagaaagtggacgctatcgatggagaataccggctgcgcggcgaggccagaaagacgttcgtcgacctgatgcggcgcggggatctccctgtgtggcttgcttatagagttgccgctgagggaattaattacgccgaccggagatggtgttttgatggcatcaaaaacaatcagattctggaagagaacgtggaagtcgagatctggacaaaggagggggaacgcaagaaactgaagccccggtggctcgacgcgagaatctattctgatcctctggcccttaaagagttcaaggagttcgctgccggccgcaaaagcctgaccctcaacctgattacagagatgggacggctgcccacctttatgacgcagaaggctagagacgccctcgataatcttgccgtgctgcataccgctgaagcgggcgggcgggcctacaaccacgctctgtccgagctcccggagacactggaaacccttctgctcctgacactgctcgccaccgttacaggaggcatcttcctttttctgatgagcgggaagggaattggcaaaatgaccctgggcatgtgctgcatcattacggcctctatcctcctgtggtatgctcagatccaacctcactggattgccgcgtccatcattcttgagttctttctgatcgtgctcctgattcccgaacccgagaagcagcgcacacctcaggacaatcagctgacctacgtcgtgatcgccatcctcaccgtcgtggctgccacaatggctaacgaaatggggttccttgagaaaaccaagaaagacctgggactgggcagcattacaacgcaagagtccgaatctaatatcctcgatattgacctgagaccggccagcgcgtggaccctttatgccgttgctacaacctttgtgacacccatgctgcggcattccatcgagaactctagcgtgaatgtctccctcaccgccattgctaaccaggccacggttctgatggggctgggaaagggctggcctctcagcaagatggatatcggggtgccccttctggctattggatgttactctcaggtgaatcctatcaccctgacagccgcgctcctgcttctggtcgcccactacgctatcattggccccggcctccaggccaaagctacccgcgaagcccaaaagagagccgcggctgggatcatgaaaaaccctacagtggacggaattaccgttatcgatctggagccgattccctatgaccctaagttcgaaaaacagctgggccaggtgatgctccttatcctgtgcgtcacacaggtgctgatgatgcggacaacctgggccctctgtgaggctctgacacttgccaccgggcccatctccaccctgtgggagggaaatcctggccgcttttggaacacaacgattgccgtcagcatggctaatatcttcagagggtcttacctcgccggagcgggcctgctgttttccattatgaagaacaccacaaatacccggcgcggcacagggaacatcggagaaaccctcggcgagaagtggaaaagcagacttaatgccctggggaagtctgagttccaaatttataaaaagagcggaatccaggaggtggatcggacgctggctaaagagggcatcaagagaggggaaacagaccatcacgccgtttcccgcggatctgctaaactccggtggtttgtggagagaaacatggtcacccccgaaggcaaggtggttgatctgggctgcgggcgcggaggctggagctactattgtgggggacttaagaacgtgcgggaggtcaaaggcctgaccaaagggggaccgggccatgaagaacctattcccatgtccacatacggctggaatctcgtgagactgcagagcggggtggacgttttcttcacaccccctgagaaatgcgatacactgctctgtgacatcggagaatcctctcccaaccctacgattgaggccggccgcacccttcgggtcctgaatctggtggaaaactggctcaataacaatacacaattttgcatcaaggtgctgaacccgtatatgcccagcgtcattgagaaaatggaaacccttcagagaaagtacgggggagcgctggttcgcaatcctctctcccggaactctacacacgagatgtactgggtgagcaatgccaccggcaacatcgtgtcctctgtcaatatgatcagcagaatgctgattaaccgcttcacgatgaagcacaaaaaggctacctatgagcccgatgtggacctggggtccggaacacggaatatcggcattgaaagcgagatccctaacctcgacattatcggcaaaagaattgaaaagatcaaacaggagcatgaaacctcttggcactacgatcaggaccatccctataagacatgggcctaccacgggtcctatgagaccaagcaaacaggaagcgcttcttccatggttaacggcgtggtccgccttctgaccaaaccgtgggatgtggttcctatggtgacgcagatggccatgacagacaccaccccctttgggcagcagagagtcttcaaggagaaagtggatacacggacgcaagaacctaaggagggaaccaaaaagctgatgaagatcacagctgaatggctctggaaagagctgggcaagaaaaagacaccccgcatgtgtacaagagaggaatttacccggaaagtgagaagcaatgccgcgcttggggccattttcacagacgagaacaagtggaaatctgctcgggaagccgtcgaggattcccgcttttgggaactgatcgacagagagcggaatctccacctggagggaaagtgcgaaacctgtgtttacaacatgatgggcaagcgcgagaaaaagctgggcgagttcgggaaagctaagggaagcagagccatttggtatatgtggctcggcgcccggtttctggagttcgaagcgcttgggtttctgaatgaggatcattggttctcccgcggaaacagcctctctggcgtggagggggaaggcctgcacagacttggatacatcctgcgggacgtgagcaaaaaggagggcggggctatgtacgccgatgacacggccggatgggacacccgcattacactcgaagatctgaagaatgaggaaatggtcaccaaccatatgaaaggcgagcacaagaaactggctgaggccatctttaagctcacatatcagaataaagtggttagagtgcagcggcctacaccccgcgggacggtcatggacatcatttccagacgggatcagcgcggatctggccaagtggggacatacggcctgaacaccttcacaaatatggaagctcagcttatcagacagatggagggagaaggcattttcaagagcatccaacatctgaccgttacggaggagattgccgtgcagaactggctcgcgcgggtcgggagagaacgcctgtcccggatggccatctctggagacgattgcgtggttaagccgcttgacgatagatttgctagcgccctgaccgctctcaatgacatgggcaaagtgcgcaaggatatccagcagtgggagccttcccgggggtggaacgactggacacaagtccccttctgctctcaccactttcatgaactggtgatgaaagatggaagagtcctggtggttccctgtcgcaatcaggacgagctcattggccgggccagaatcagccagggggcgggctggtccctgaaggaaaccgcctgccttggaaaaagctatgctcagatgtggacactgatgtacttccaccgccgggatctcagactggccgctaacgccatttgttctgctgtgccttcccattgggtcccgaccagccgcacaacctggtctatccacgccaagcacgagtggatgacgacagaggacatgcttgcggtgtggaaccgggtgtggattcaagaaaatccctggatggaggacaagacccctgttgaatcctgggaggaagtgccctatctgggcaaaagagaggatcagtggtgcgggagcctcatcggactgacctcccgggccacatgggctaagaacattcagaccgccatcaatcaggtcagatctctgatcggcaacgaggaatacacagactatatgcctagcatgaaacgctttcggagagaggaagaggaagccggggtgctctggtga

SEQ ID NO: 19919 - RNA, 9876 nt, synthetic construct
  misc_feature 1..9876: note = derived and/or modified CDS sequence (opt5) from DENV-2__EU482580__SS-prME
  source 1..9876: mol_type = other RNA
accgccggagtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatggatctcggagaactgtgtgaggacacaatcacctacaaatgcccgcttctgcgccaaaatgaacccgaggatattgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggatcctgcgccatcccgggttcacaattatggccgctatcctcgcctacaccattggaaccacacactttcagagagctctgatcttcattcttctgacggccgtggcgcctagcatgaccatgcggtgcatcggcatttccaaccgcgattttgtcgaaggggtgtctggaggcagctgggttgacatcgtgctcgagcacgggtcctgtgtcacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaagggggaatcgtgacatgcgccatgtttacgtgcaaaaagaatatggaaggcaaagtcgttcagcctgagaacctggaatacaccattgtgatcacaccccacagcggggaggagcatgcggtgggaaatgacaccggcaagcacggcaaagaaattaagatcacacctcagtcttccatcaccgaggccgaacttacggggtatggaaccgtcacaatggagtgtagcccccggaccggcctggatttcaacgaaatggtgctcctgcaaatggaggacaaggcttggcttgttcaccgccagtggtttctggatctcccgctgccttggctgcccggggccgacacacagggatctaattggattcagaaggagaccctcgtgacgttcaagaaccctcatgctaaaaagcaagacgtcgtggttctgggctcccaggaaggggccatgcacacagcccttaccggcgctacagagatccagatgagctccggaaatctgctctttaccggccatctgaaatgcagacttcggatggataagctgcaactcaaagggatgtcttacagcatgtgtaccggaaagttcaagattgtgaaagaaatcgcggagacacagcacggcacgattgtcatcagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcattggcgtcgagcccggacagctgaaacttaattggttcaagaagggctccagcatcgggcaaatgtttgagaccacaatgagaggagctaaacgcatggccatcctgggcgacaccgcctgggatttcgggtctctcggaggcgtgtttacgagcattgggaaggctctgcaccaggttttcggcgccatctacggagcggctttttccggcgtgtcttggacaatgaaaattttcatcggggtcattatcacctggatcggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatttttatcaccgataacgttcacacatggacggagcagtacaagttccaacctgaaagcccctccaaactggcttctgccattcagaaggctcatgaggaaggcatctgtggaattagaagcgtgacccgccttgagaatctgatgtggaaacagatcacaccggagctcaaccacatcctgtccgaaaatgaggtcaagctgaccattatgacaggcgacatcaaagggattatgcaggccggaaagcggtctcttagacctcaacccaccgaactcaaatatagctggaagacgtggggcaaggcgaaaatgctgtccaccgagagccataaccagacatttctgatcgatgggcctgaaaccgccgagtgccccaatacaaaccgcgcttggaactctctcgaggtggaagactacggattcggcgtttttaccacaaacatttggctgaaacttcgggagaaacaggacgtgttctgtgattccaagctgatgagcgccgctatcaaagacaatagagccgtccacgcggatatgggctattggatcgaatctgccctcaacgacacctggaagatggagaaggcttccttcattgaggtgaaaagctgccactggcctaagtctcatacgctgtggagcaatggggttctggaatccgagatgatcattcccaaaaactttgccggaccggtgagccagcacaactaccgccctggctatcatacacaaaccgctgggccctggcaccttggaaagctcgaaatggatttcgacttttgtgagggcaccacagtcgtggtgaccgaagattgcgggaatcggggaccctctctgagaacgacaaccgcctccggcaaactgatcacagagtggtgctgtcggagctgcaccctccctccgctgcgctacagaggcgaggacgggtgttggtacggaatggaaattcggccccttaaggagaaggaagagaacctggtcaattccctcgttacagccggccatgggcagatcgataacttctctctgggagtgctgggcatggctctttttctcgaagagatgctgagaacccgcgtggggacgaaacacgcgattctgctcgtcgccgtgagcttcgttaccctgatcacaggaaatatgtcctttcgggaccttggcagagtgatggtcatggtgggcgctaccatgacagatgacatcgggatgggagttacctatctggccctcctggccgctttcaaggtgcgccctacgtttgccgcgggcctgcttctgagaaaactcacatctaaggagctgatgatggctaccattgggatcgccctcctgagccagtccacaattcccgaaaccatccttgagctgaccgatgccctcgctctgggaatgatggtcctgaaaattgtgcggaacatggaaaagtaccaacttgccgttacaatcatggcgatctcttgcgtgcctaatgctgtcattctgcagaacgcctggaaggtgagctgtacgatcctcgccgctgtgtccgtcagccccctgctcctgacctcttcccagcagaaagccgactggattcctcttgctctgacaatcaagggcctcaatcccaccgccattttcctgacaaccctgagccgcacgtctaaaaagagatcctggccgcttaacgaggcgatcatggccgttgggatggtgagcatcctggcttcttccctcctgaaaaatgacattcctatgacaggacccctcgtggccggcggcctgcttaccgtctgctatgtgctgaccgggcggagcgctgatctggaactcgagcgcgccgccgacgttaagtgggaggatcaagctgaaatctccggaagctctcctattctgagcatcacaatttccgaggacggctctatgagcatcaaaaacgaagaggaggaacagacccttacaattctgatcagaacggggctcctggtgatctccggagtctttcccgtgtctattccgatcaccgcggccgcttggtacctctgggaggttaagaagcagcgggccggcgtgctgtgggatgtcccttctccccctcccgtggggaaagccgaacttgaggacggagcttatcgcattaagcagagaggcatcctgggctactcccaaattggggccggagtctataaagaaggcacattccacaccatgtggcatgtgacaagaggggcggttctgatgcaccgcggaaagagaatcgagccctcctgggctgatgtgaaaaaggacctcatcagctacggcgggggatggaagctggagggcgaatggaaagagggcgaagaggtccaggtgcttgccctggaacctgggaagaatccgcgggccgttcagaccaaacccggactctttaagacgaacaccggcacaattggggctgtgtccctggatttcagccctggaacctctggctcccccatcgtcgacagaaaagggaaggtggtgggactctacggcaatggcgttgtcacacgcagcggggcctatgtgtctgcgattgctcagaccgagaagtccatcgaggataaccctgaaattgaggacgatatcttccggaaaaagagactgacaatcatggaccttcatcccggagccggcaaaacgaagcgctacctgcctgccattgtgcgggaagctatcaaaagagggctgcgcaccctcattctggccccgacacgggtcgtggctgccgagatggaagaggcgcttagaggactgcccatccgctatcaaacccctgccattcgggctgagcacaccggcagagaaatcgttgacctcatgtgtcatgccacatttacgatgcggctgctcagccccgtgcgcgtccctaactacaatctgattatcatggatgaggctcacttcaccgaccccgcctccatcgccgctagagggtatatttctacacgggtggaaatgggcgaggcggccggaatctttatgaccgctacaccgcctggcagccgcgatcccttcccccagtccaacgcccctattatggacgaggaaagagagatccccgaacggagctggaactctgggcacgagtgggttaccgattttaagggaaagacggtgtggttcgtcccttccattaaagccggcaacgacatcgctgcctgccttagaaagaatgggaaaaaggtgatccagctgagccgcaaaacatttgattctgaatacgttaagacccgggcgaacgactgggatttcgtggtcaccacagacattagcgagatgggagctaattttaaggccgagagagtgatcgatccgcgccggtgtatgaaacccgtgattctgaccgacggcgaagagagagtcatcctcgccgggcctatgcccgttacacattcctctgctgcccaacgccggggcagaattggacgcaaccctaagaatgaaaacgaccagtatatctacatgggcgagcccctggaaaatgatgaggactgcgcgcactggaaagaggccaagatgcttctggataacatcaataccccggaagggattatccctagcatgttcgagcccgaaagagagaaagtggacgctattgatggagaataccggctccgcggcgaggccagaaagacgtttgtggacctgatgcggcgcggggatctgcctgtctggctcgcttatagagtggccgctgagggaatcaactacgccgaccggagatggtgtttcgatggcattaaaaataaccagatccttgaagagaacgttgaagtggagatttggacaaaggagggggaacgcaagaaactgaagccccggtggctggacgcgagaatctattccgatcctctcgccctgaaagagttcaaggaatttgctgccggccgcaaatctcttaccctgaatctcatcacagagatgggacggctgcccaccttcatgacgcagaaggctagagacgccctggataacctcgccgtccttcataccgctgaagcgggcgggaaggcctacaatcacgctctgagcgagctgccggagacactcgaaaccctgcttctgctcacactgctggccaccgtgacaggaggcatttttctcttccttatgtccgggaaaggaatcggcaagatgaccctgggcatgtgctgcattatcacggccagcattctgctctggtatgctcaaatccagcctcactggatcgccgcgtctattatcctggagtttttccttattgttctgctcatccccgaacccgagaaacagcggacacctcaggacaaccaactgacctacgtggtcattgccatcctgaccgtggtcgctgccacaatggctaatgaaatggggtttctcgagaagaccaaaaaggaccttggactgggctccatcacaacgcaggagagcgaatccaacattctggatatcgacctccgcccggcctctgcgtggaccctgtatgccgtggctacaaccttcgttacacccatgcttagacatagcattgaaaatagctctgtgaacgtgagcctgaccgccatcgctaatcaggccacggtcctcatggggctgggaaagggctggcctctgtccaaaatggatattggggttcccctccttgctatcggatgttacagccaggtgaaccctattaccctgacagccgcgctgctcctgcttgtggcccactacgctatcatcggccccggcctgcaagccaaggctacccgggaagcccagaaacgcgccgcggctgggattatgaagaatcctacagtcgacggaatcaccgtgattgatctcgagccgatcccctatgaccctaaatttgaaaagcagctgggccaggttatgctgctcattctttgcgtgacgcaagtcctgatgatgagaacaacctgggccctgtgtgaggctctcacactggccaccgggcccatctctaccctttgggagggaaaccctggccggttctggaatacaacgatcgccgtgtccatggctaacatttttcgcgggagctacctggccggagcgggcctcctgttctctatcatgaagaataccacaaacaccagacggggcacagggaatattggagaaaccctgggcgagaaatggaagtcccgcctcaacgcccttgggaaaagcgaatttcagatctataagaaatctggcattcaggaggtcgatagaacgctggctaaggagggcatcaaaagaggggaaacagaccatcacgccgtgagcagaggatccgctaagctgcgctggttcgttgagcggaacatggtgacccccgaaggcaaggtcgtggatctcggctgcgggagaggaggctggtcttactattgtgggggactgaaaaatgttcgcgaggtgaagggccttaccaaagggggaccgggccatgaggaacctatccccatgagcacatacggctggaacctggtccggctccaatccggggtggacgtgttctttacaccccctgagaagtgcgataccctgctgtgtgacattggagaaagctcccccaatcctacgatcgaggccggcagaaccctccgcgttcttaacctggtcgaaaattggctgaacaataacacacagttctgcattaaagtgctcaatccgtatatgccctctgtgatcgagaagatggaaaccctgcagcggaagtacgggggagcgcttgtcagaaaccctctgagccgcaattccacacacgagatgtactgggtttctaacgccaccggcaatattgtgagctccgtgaacatgatctctcggatgctcatcaatagatttacgatgaaacacaagaaagctacctatgagcccgatgtcgacctggggagcggaacacgcaacattggcatcgaatccgagattcctaacctggacatcattggcaagcggatcgagaagattaagcaggagcatgaaaccagctggcactacgatcaagaccatccctataagacatgggcctaccacgggtcttatgagaccaaacagacaggatccgctagctctatggtgaatggcgttgtgagactccttaccaagccgtgggatgtcgtgcctatggttacgcagatggccatgacagacaccacccccttcgggcagcaacgcgtgtttaaagagaaggtcgatacaagaacgcaggaacctaaagagggaaccaagaagctgatgaaaatcacagctgaatggctgtggaaggagctcggcaaaaagaaaacaccccggatgtgtacacgcgaggagttcaccagaaaggtgcggtccaacgccgcgctgggggccatctttacagacgagaataaatggaaaagcgctagagaagccgtggaggattctcggttctgggaacttgtcgaccgcgagagaaacctgcacctcgagggaaagtgcgaaacctgtgtttacaatatgatgggcaaacgggagaagaaactgggcgaatttgggaaggctaaaggatcccgcgccatttggtatatgtggctgggcgccagattcctcgagtttgaagcgctggggttccttaacgaggatcattggtttagccggggaaattccctgagcggcgtggagggggaaggcctccaccgcctgggatacatccttagagacgtgtctaagaaggagggcggggctatgtacgccgatgacacggccggatgggacacccggattacactggaagatctcaaaaacgaggaaatggtcaccaatcatatgaagggcgagcacaaaaagctggctgaggccatcttcaaactgacatatcagaacaaggtggttcgcgtgcagagacctacaccccgggggacggtcatggacattatcagccgcagagatcaacggggatccggccaggtggggacatacggcctcaataccttcacaaacatggaagctcagctgatccgccaaatggagggagaaggcatttttaagtctatccagcatcttaccgttacggaggagattgccgtgcagaattggctggcgagagtcgggcgggaaagactcagccgcatggccatctccggagacgattgcgtggttaaaccgctggacgatcggttcgcttctgcccttaccgctctgaacgacatgggcaaggtgagaaaagatattcagcaatgggagcctagccgcgggtggaatgactggacacaggtccccttttgctcccaccacttccatgaactcgtgatgaaggatggacgggtcctggtggttccctgtagaaaccaggacgagctgatcggccgcgcccggatctctcagggggcgggctggagcctcaaagaaaccgcctgcctgggaaagtcctatgctcaaatgtggacacttatgtactttcacagacgcgatctgcggctcgccgctaacgccatttgtagcgctgtgccttctcattgggtcccgacctccagaacaacctggagcatccacgccaagcacgagtggatgacgacagaggacatgctggcggtgtggaatcgcgtgtggattcaggaaaacccctggatggaggacaaaacccctgttgaatcttgggaggaagtgccctatcttggcaagcgggaggatcagtggtgcgggtccctgatcggactcaccagcagagccacatgggctaaaaatattcagaccgccatcaaccaagtccggtccctgattggcaatgaggaatacacagactatatgccttctatgaagagattccgccgggaggaagaggaagccggggtgctgtggtga

SEQ ID NO: 19920 - RNA, 9876 nt, synthetic construct
  misc_feature 1..9876: note = derived and/or modified CDS sequence (opt5) from DENV-2__EU482581__SS-prME
  source 1..9876: mol_type = other RNA
accgcgggagtgatcattatgctgatccccaccgctatggccttccacctcacgaccagaaacggggaacctcatatgattgtcggacggcaggaaaagggcaaaagcctgctttttaagaccgaagacggggttaatatgtgcaccctgatggcgatcgatctcggagaactgtgtgaagacaccattacctacaaatgcccgcttctgcgccaaaacgaacccgaagatatcgactgttggtgcaattccacgtctacctgggtgacgtatggcacctgtacaaccacaggggaacacagacgggaaaagcgctccgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaaggcgggattgtcacatgcgccatgtttacgtgcaaaaagaatatggaagggaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagggaaggacagcccggtcaacattgaagccgagcccccttttggcgattcttacatcattatcggagtggaacccggccagctgaaacttaattggttcaagaaggggtccagcatcggacagatgtttgagaccacaatgagaggcgctaaacgcatggccattctgggggacaccgcctgggatttcggatctctcggcggggtttttacgagcatcggcaaggctctgcaccaagtgttcggagccatttacggcgcggctttttccggggtctcttggacaatgaaaatcctgattggagtgatcatcacctggattggcatgaacagccggtccaccagcctttctgtgtccctcgttctggtcggggtggtgacactgtatctcggagccatggtccaggccgacagcggctgtgtggtttcttggaagtccaaagagctgaagtgcgggagcggcatcttcattaccgataatgtgcacacatggacggaacagtacaagtttcagcctgagtccccctctaaacttgctagcgccatccaaaaggctcatgaagagggaatttgtggcatcagatccgtcacccgcctggaaaacctcatgtggaaacagatcacaccggagctgaatcacattctgtctgagaacgaagtgaaacttaccatcatgacaggggacattaaaggaatcatgcaggccggcaagcggagcctcagacctcagcccaccgagctgaaatattcctggaagacgtgggggaaggcgaaaatgctgagcaccgaatctcataatcaaacattcctcattgatggacctgagaccgccgaatgccccaacacaaatcgcgcttggaactccctggaggttgaggactacggctttggcgtgttcaccacaaatatctggcttaagctgcgggaaaaacaggacgtcttttgtgatagcaagctcatgtctgccgctatcaaagacaacagagccgtgcacgcggatatggggtattggattgagtccgccctgaatgacacctggaagatggaaaaggctagcttcatcgaggttaaatcttgccactggcctaagagccatacgctgtggtccaacggagtgcttgagagcgaaatgattatccccaaaaatttcgccggcccggtctctcagcacaactaccgccctgggtatcatacacagaccgctggaccctggcacctcggcaagctggagatggattttgacttctgtgaagggaccacagtggtggtcaccgaggattgcggaaaccggggcccctccctgagaacgacaaccgccagcggcaaactcattacagaatggtgctgtcggtcctgcaccctgcctccgcttcgctacagaggggaggacggatgttggtacggcatggagatccggcccctgaaggaaaaggaggaaaatctcgttaactctctggtgacagccgggcatggacaaattgataattttagcctgggcgtgcttgggatggctctcttcctggaggaaatgctgagaacccgcgtcggaacgaaacacgcgatcctcctggtggccgtttcctttgtgacccttatcacaggcaacatgtctttccgggacctgggcagagtcatggtgatggttggggctaccatgacagatgacattggaatgggcgtgacctatctcgccctgctggccgcttttaaggtccgccctacgttcgccgcggggcttctgctcagaaaactgacaagcaaggagctcatgatggctaccatcggaattgccctgctttcccagtctacaatccccgagaccattctggaactcaccgatgccctggctctgggcatgatggtgcttaaaatcgttcggaatatggagaagtaccagctggccgtgacaatcatggcgattagctgcgtccctaacgctgtgatcctccaaaatgcctggaaggtgtcctgtacgattctggccgctgtcagcgtttctcccctcctgcttacctccagccagcagaaagccgactggatccctctggctctcacaattaaggggctgaaccccaccgccatctttctgacaaccctttctcgcacgtccaaaaagagaagctggccgctgaatgaagcgatcatggccgtgggaatggtgtctattctcgcttccagcctgctcaaaaacgacatccctatgacaggccccctggtcgccggcgggcttctgaccgtgtgctatgttctgaccggacggtccgctgatctcgagctggaacgcgccgccgacgtgaagtgggaggatcaggctgagattagcggctctagccctatcctttccattacaatctctgaagacgggagcatgtccattaaaaatgaggaagaggagcaaaccctgacaatcctcatcagaacgggactgctcgtcatttctggcgtgttccccgttagcatcccgattaccgcggccgcttggtacctgtgggaagtgaagaagcagcgggccggggtcctttgggatgtgccttctccccctcccgtcggaaaagccgagctggaagacggcgcttatcgcatcaagcagagaggcattctggggtacagccagatcggagccggcgtgtataaagaggggacatttcacaccatgtggcatgttacacggggagcggtgctcatgcaccgcggcaagagaatcgaacccagctgggctgatgtcaaaaaggacctgatttcctacgggggaggctggaaacttgagggcgagtggaaagaaggggaggaagtgcaagttctggccctcgagcctggaaagaacccgcgggccgtgcagaccaaacccggcctgttcaagacgaataccgggacaatcggagctgtcagcctcgatttttctcctggcacctccgggagccccattgtggacagaaaaggaaaggtggttggcctgtacggcaacggggtcgtgacacgctctggagcctatgtgtccgcgatcgctcagaccgaaaagagcattgaggataatcctgagatcgaagacgatatcttccggaaaaagagacttacaattatggacctgcatcccggcgccgggaaaacgaagcgctacctgcctgccatcgtccgggaggctattaaaagaggactccgcaccctgatccttgccccgacacgggtggttgctgccgaaatggaggaagcgctgagaggcctccccattcgctatcagacccctgccatccgggctgagcacaccgggagagagattgtggacctgatgtgtcatgccacattcacgatgcggctcctgtcccccgtccgcgtgcctaactacaaccttatcatcatggatgaagctcactttaccgaccccgcctctattgccgctagaggctatatcagcacacgggttgagatgggagaagcggccggcattttcatgaccgctacaccgcctgggtcccgcgatccctttccccaaagcaatgcccctatcatggacgaggagagagaaattcccgagcggtcttggaactccggacacgaatgggtgaccgatttcaagggcaagacggtctggtttgtgcctagcatcaaagccgggaatgacatcgctgcctgcctgagaaagaacggcaagaaggttattcagctgtctcgcaaaacattcgatagcgagtacgtgaagacccgggcgaatgactgggattttgtcgtgaccacagacatctccgaaatgggcgctaacttcaaggccgagagagtgattgatccgcgccggtgtatgaaacccgtcatcctcaccgacggggaggaaagagttattctggccggccctatgcccgtgacacattctagcgctgcccagcgccggggaagaatcggccgcaatcctaagaacgagaatgaccaatatatctacatgggggaaccccttgagaacgatgaagactgcgcgcactggaaagaggccaagatgctgctcgataatattaacaccccggagggaatcattccttccatgtttgaacccgagagagaaaaagtggacgctatcgatggcgagtaccggctgcgcggggaagccagaaagacgttcgtcgacctgatgcggcgcggagatctccctgtgtggcttgcttatagagttgccgctgagggcattaattacgccgaccggagatggtgttttgatgggatcaaaaacaatcagattctggaggaaaacgtggaggtcgaaatctggacaaaggagggcgagcgcaagaaactgaagccccggtggctcgacgcgagaatctattctgatcctctggcccttaaagagttcaaggagttcgctgccggacgcaaaagcctgaccctcaacctgattacagaaatgggccggctgcccacctttatgacgcagaaggctagagacgccctcgataatcttgccgtgctgcataccgctgaggccgggggacgggcctacaaccacgctctgtccgaactcccggagacactggagacccttctgctcctgacactgctcgccaccgttacaggcgggatcttcctttttctgatgagcggaaagggcattggcaaaatgaccctggggatgtgctgcatcattacggcctctatcctcctgtggtatgctcagatccaacctcactggattgccgcgtccatcattcttgagttctttctgatcgtgctcctgattcccgagcccgaaaagcagcgcacacctcaggacaatcagctgacctacgtcgtgatcgccatcctcaccgtcgtggctgccacaatggctaacgagatgggattccttgagaagaccaagaaagacctgggcctggggagcattacaacgcaagagtccgagtctaatatcctcgatattgacctgagaccggccagcgcgtggaccctttatgccgttgctacaacctttgtgacacccatgctgcggcattccatcgaaaactctagcgtgaatgtctccctcaccgccattgctaaccaggccacggttctgatgggactgggcaaggggtggcctctcagcaagatggatatcggagtgccccttctggctattggctgttactctcaggtgaatcctatcaccctgacagccgcgctcctgcttctggtcgcccactacgctatcattggccccgggctccaggccaaagctacccgcgaggcccaaaagagagccgcggctggaatcatgaaaaaccctacagtggacggcattaccgttatcgatctggaaccgattccctatgaccctaagttcgagaaacagctgggacaggtgatgctccttatcctgtgcgtcacacaggtgctgatgatgcggacaacctgggccctctgtgaagctctgacacttgccaccggacccatctccaccctgtgggagggcaatcctgggcgcttttggaacacaacgattgccgtcagcatggctaatatcttcagaggatcttacctcgccggcgcgggcctgctgttttccattatgaagaacaccacaaatacccggcgcgggacaggaaacatcggcgagaccctcggggaaaagtggaaaagcagacttaatgccctgggaaagtctgagttccaaatttataaaaagagcggcatccaggaagtggatcggacgctggctaaagaggggatcaagagaggagagacagaccatcacgccgtttcccgcggctctgctaaactccggtggtttgtggaaagaaacatggtcacccccgagggcaaggtggttgatctggggtgcggacgcggcgggtggagctactattgtggaggccttaagaacgtgcgggaagtcaaagggctgaccaagggaggcccgggccatgaggaacctattcccatgtccacatacgggtggaatctcgtgagactgcagagcggagtggacgttttcttcacaccccctgagaaatgcgatacactgctctgtgacatcggcgagtcctctcccaaccctacgattgaagccgggcgcacccttcgggtcctgaatctggtggagaactggctcaataacaatacacaattttgcatcaaggtgctgaacccgtatatgcccagcgtcattgagaaaatggagacccttcagagaaagtacggaggcgcgctggttcgcaatcctctctcccggaactctacacacgaaatgtactgggtgagcaatgccaccgggaacatcgtgtcctctgtcaatatgatcagcagaatgctgattaaccgcttcacgatgaagcacaaaaaggctacctatgagcccgatgtggacctgggatccggcacacggaatatcggcattgagagcgaaatccctaacctcgacattatcgggaaaagaattgagaagatcaaacaggaacatgagacctcttggcactacgatcaggaccatccctataagacatgggcctaccacggatcctatgaaaccaagcaaacaggcagcgcttcttccatggttaacggggtggtccgccttctgaccaaaccgtgggatgtggttcctatggtgacgcagatggccatgacagacaccaccccctttggacagcagagagtcttcaaggagaaagtggatacacggacgcaagagcctaaggaaggcaccaaaaagctgatgaagatcacagctgagtggctctggaaagaactggggaagaaaaagacaccccgcatgtgtacaagagaggagtttacccggaaagtgagaagcaatgccgcgcttggagccattttcacagacgaaaacaagtggaaatctgctcgggaggccgtcgaagattcccgcttttgggagctgatcgacagagaacggaatctccacctggagggcaagtgcgagacctgtgtttacaacatgatgggcaagcgcgagaaaaagctgggggagttcggaaaagctaagggcagcagagccatttggtatatgtggctcggggcccggtttctggagttcgaggcgcttggatttctgaatgaagatcattggttctcccgcggcaacagcctctctggggtggagggcgagggactgcacagacttggctacatcctgcgggacgtgagcaaaaaggaagggggagctatgtacgccgatgacacggccggctgggacacccgcattacactcgaggatctgaagaatgaagagatggtcaccaaccatatgaaaggggaacacaagaaactggctgaggccatctttaagctcacatatcagaataaagtggttagagtgcagcggcctacaccccgcggaacggtcatggacatcatttccagacgggatcagcgcggctctgggcaagtgggcacatacggactgaacaccttcacaaatatggaggctcagcttatcagacagatggaaggcgaggggattttcaagagcatccaacatctgaccgttacggaagagattgccgtgcagaactggctcgcgcgggtcggaagagagcgcctgtcccggatggccatctctggcgacgattgcgtggttaagccgcttgacgatagatttgctagcgccctgaccgctctcaatgacatggggaaagtgcgcaaggatatccagcagtgggaaccttcccggggatggaacgactggacacaagtccccttctgctctcaccactttcatgagctggtgatgaaagatggcagagtcctggtggttccctgtcgcaatcaggacgaactcattgggcgggccagaatcagccagggcgcgggatggtccctgaaggagaccgcctgccttggcaaaagctatgctcagatgtggacactgatgtacttccaccgccgggatctcagactggccgctaacgccatttgttctgctgtgccttcccattgggtcccgaccagccgcacaacctggtctatccacgccaagcacgaatggatgacgacagaggacatgcttgcggtgtggaaccgggtgtggattcaagagaatccctggatggaagacaagacccctgttgagtcctgggaagaggtgccctatctggggaaaagagaagatcagtggtgcggaagcctcatcggcctgacctcccgggccacatgggctaagaacattcagaccgccatcaatcaggtcagatctctgatcgggaacgaggagtacacagactatatgcctagcatgaaacgctttcggagagaagaggaagaggccggagtgctctggtga

SEQ ID NO: 19921 - RNA, 9876 nt, synthetic construct
  misc_feature 1..9876: note = derived and/or modified CDS sequence (opt5) from DENV-2__EU482582__SS-prME
  source 1..9876: mol_type = other RNA
accgccggagtgatcattatgctgatccccacagctatggccttccacctcacgacccggaatggggagcctcatatgattgtcggacggcaggaaaagggcaagtccctgctttttaagaccgaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccaaccactttcagagagctctgattttcatccttctgacagccgtggcgcctagcatgacgatgcggtgcattggcatctccaatcgcgattttgtcgaaggggtgtctggaggcagctgggttgacatcgtgctcgagcacgggtcctgtgtcaccacaatggccaagaacaagcccaccctggatttcgaacttattaaaacagaggctaagcagcctgccaccctgagaaaatattgcatcgaagctaagctcacgaatacaaccaccgagagccggtgtccgacacaaggagagccctctctgaacgaggaacaggacaaacgctttgtgtgcaagcattccatggtggatagaggctggggcaatgggtgtggactgttcggcaaagggggaattgtgacatgcgccatgtttacatgcaaaaagaacatggaaggcaaagttgtgctccctgagaatctggaatacacgatcgtgattacaccccacagcggggaggagcatgcggtcggaaacgacacaggcaagcacggcaaagaaatcaagatcacccctcagtcttccattacagaggccgaacttaccgggtatggaacggtgaccatggagtgtagcccccggacaggcctggatttcaatgaaatggttctcctgcagatggaggacaaggcttggcttgtgcaccgccaatggtttctggatctcccgctgccttggctgcccggggccgacacccagggatctaactggatccagaaggagacactcgtcaccttcaagaatcctcatgctaaaaagcaggacgtggttgtgctgggctcccaagaaggggccatgcacacggcccttacaggcgctaccgagattcagatgagctccggaaacctgctctttacaggccatctgaaatgcagacttcggatggataagctgcagctcaaagggatgtcttacagcatgtgtaccggaaagttcaagatcgtcaaagaaattgcggagacccaacacggcacaatcgtgatcagagtccagtatgagggggacggatccccctgcaagattcccttcgaaatcatggatctggagaaacgccatgtgctgggccggctcattacggttaaccctatcgtgaccgaaaaggacagcccggtcaatattgaggccgaacccccttttggggattcttacatcattatcggcgtggagcccggacagctgaaacttaactggttcaagaagggctccagcatcgggcagatgtttgagacaaccatgagaggagctaaacgcatggccattctgggcgacacagcctgggatttcgggtctctcggaggcgtttttaccagcatcgggaaggctctgcaccaagtgttcggcgccatttacggagcggtcttttccggcgtgtcttggacgatgaaaatcctgattggggtgatcatcacatggattggaatgaatagccggtccaccagcctttctgtttccctcgtcctggtgggcgtggtcaccctgtatctcggggctatggtgcaggccgacagcggatgtgttgtgtcttggaagtccaaagaactgaagtgcggcagcgggatcttcattacagataacgtccacacctggacagagcagtacaagtttcagcctgaatccccctctaaacttgccagcgctatccaaaaggcccatgaggaaggcatttgtggaatcagatccgtgacgcgcctggagaatctcatgtggaaacagatcaccccggagctgaaccacattctgtctgaaaatgaggttaaacttacaatcatgaccggcgacattaaagggatcatgcaggctggaaagcggagcctcagacctcagcccacagaactgaaatattcctggaagacctggggcaaggccaaaatgctgagcacggagtctcataaccaaaccttcctcattgatgggcctgaaacagcggagtgccccaataccaaccgcgcctggaactccctggaggtggaagactacggatttggcgtcttcacaaccaacatctggcttaagctgcgggagaaacaggacgtgttttgtgatagcaagctcatgtctgctgccatcaaagacaatagagctgttcacgccgatatgggctattggattgaatccgcgctgaacgacacatggaagatggagaaggccagcttcatcgaggtgaaatcttgccactggcctaagagccataccctgtggtccaatggggtccttgaaagcgagatgattatccccaaaaacttcgctggaccggtgtctcagcacaactaccgccctggctatcatacgcagacagccgggccctggcacctcggaaagctggaaatggattttgacttctgtgagggcaccaccgtggtcgttacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgtcaattctctggtgaccgccggccatgggcaaattgataactttagcctgggagtccttggcatggccctcttcctggaagagatgctgagaacacgcgtggggaccaaacacgctatcctcctggttgcggtgtcctttgtcacgcttatcaccggaaatatgtctttccgggacctgggcagagtgatggttatggtgggcgccacaatgaccgatgacattgggatgggagtcacatatctcgctctgctggccgcctttaaggtgcgccctaccttcgctgccggccttctgctcagaaaactgacgagcaaggagctcatgatggcgacaatcgggattgctctgctttcccagtctaccatccccgaaacaattctggagctcaccgatgccctggccctgggaatgatggttcttaaaatcgtgcggaacatggaaaagtaccagctggctgtcaccatcatggccattagctgcgtgcctaatgcggtgatcctccaaaacgcttggaaggtctcctgtacaattctggccgccgttagcgtgtctcccctcctgcttacgtccagccagcagaaagctgactggatccctctggccctcaccattaagggcctgaatcccacagctatctttctgaccacactttctcgcacctccaaaaagagaagctggccgctgaacgaggccatcatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacaaacactgaccatcctcatcagaacagggctgctcgtgatttctggagttttccccgtgagcatcccgattacggctgcggcctggtacctgtgggaggtcaagaagcagcgggctggcgtgctttgggatgtcccttctccccctcccgtggggaaagccgaactggaggacggagcctatcgcatcaagcagagaggcattctgggctacagccagatcggggctggagtttataaagaaggcacctttcacacaatgtggcatgtgaccagaggggccgtcctcatgcaccgcggaaagagaatcgagcccagctgggcggatgtgaaaaaggacctgatttcctacggcgggggatggaaacttgagggcgaatggaaagagggcgaagaggttcaagtgctggctctcgaacctgggaagaatccgcgggccgtccagacaaaacccggactgttcaagaccaacacgggcaccatcggggccgtgagcctcgatttttctcctggaacatccggcagccccattgtggacagaaaagggaaggttgtcggactgtacggcaatggcgtggtgacccgctctggggcttatgtctccgccatcgcgcagacagaaaagagcattgaggataaccctgaaatcgaggacgatatcttccggaaaaagagacttaccattatggacctgcatcccggagctggcaaaacaaagcgctacctgcctgccatcgtgcgggaagccattaaaagagggctccgcacgctgatccttgctccgacccgggttgtggccgctgagatggaagaggccctgagaggactccccattcgctatcagacccctgcgatccgggccgagcacaccggcagagaaattgtcgacctgatgtgtcatgctaccttcacaatgcggctcctgtcccccgtgcgcgttcctaactacaatcttatcatcatggatgaggcccactttacggaccccgcttctattgccgccagagggtatatcagcacccgggtggaaatgggcgaggctgcgggaattttcatgacagccaccccgcctggctcccgcgatccctttccccaaagcaacgctcctatcatggacgaggaaagagagattcccgaacggtcttggaactccgggcacgagtgggtcacagatttcaagggaaagaccgtgtggtttgttcctagcatcaaagccggcaacgacatcgccgcttgcctgagaaagaatgggaaaaaggtgattcagctgtctcgcaaaacgttcgatagcgaatacgtcaagacacgggccaacgactgggattttgtggtgaccaccgacatctccgagatgggagcgaatttcaaggctgagagagtcattgatccgcgccggtgtatgaaacccgttatcctcacagacggcgaagagagagtgattctggccgggcctatgcccgtgacccattctagcgccgctcagcgccggggcagaatcggacgcaaccctaagaatgaaaacgaccaatatatctacatgggcgagccccttgaaaatgatgaggactgcgcccactggaaagaggcgaagatgctgctcgataacattaatacaccggaagggatcattccttccatgtttgagcccgaaagagagaaagtcgacgccatcgatggagaataccggctgcgcggcgaggctagaaagaccttcgtggacctgatgcggcgcggggatctccctgtttggcttgcctatagagtggctgccgagggaattaactacgctgaccggagatggtgttttgatggcatcaaaaataaccagattctggaagagaacgtcgaagtggagatctggacgaaggagggggaacgcaagaaactgaagccccggtggctcgacgccagaatctattctgatcctctggcgcttaaagagttcaaggagttcgccgctggccgcaaaagcctgacactcaatctgattaccgagatgggacggctgcccacatttatgacccagaaggccagagacgctctcgataaccttgccgttctgcatacggccgaagctggcgggcgggcgtacaatcacgccctgtccgagctcccggagaccctggaaacacttctgctcctgaccctgctcgctacagtgaccggaggcatcttcctttttctgatgagcgggaagggaattggcaaaatgacactgggcatgtgctgcatcattaccgcctctatcctcctgtggtatgcccagatccaacctcactggattgctgcctccatcattcttgagttctttctgatcgtcctcctgattcccgaacccgagaagcagcgcacgcctcaggacaaccagctgacatacgtggtcatcgcgatcctcaccgtggttgccgctaccatggccaatgaaatggggttccttgagaaaacaaagaaagacctgggactgggcagcaccacaacgcaagagtccgaatctaacattctcgatatcgacctgagaccggctagcgcctggaccctttatgcggtggccacaacctttgtgacacccatgctgcggcattccattgaaaattctagcgtcaacgtttccctcaccgctatcgccaatcaggctacggtgctgatggggctgggaaagggctggcctctcagcaagatggatattggggtgccccttctggccatcggatgttactctcaggtcaaccctattaccctgacagctgccctcctgcttctggtggcgcactacgccatcatcggccccggcctccaggctaaagccacccgcgaagctcaaaagagagccgccgcggggattatgaaaaatcctacagttgacggaatcaccgtgattgatctggagccgatcccctatgaccctaagttcgaaaaacagctgggccaggtcatgctccttattctgtgcgtgacgcaggtcctgatgatgcggacaacctgggctctctgtgaggccctgacacttgctaccgggcccatctccaccctgtgggagggaaaccctggccgcttttggaatacaacgatcgccgtgagcatggccaacattttcagagggtcttacctcgctggagccggcctgctgttttccatcatgaagaataccacaaacacccggcgcggcacagggaatattggagaaaccctcggcgagaagtggaaaagcagacttaacgcgctggggaagtctgagttccaaatctataaaaagagcggcattcaggaggttgatcggacgctggccaaagagggcatcaagagaggggaaacagaccatcacgctgtgtcccgcggatctgccaaactccggtggtttgtcgagagaaacatggtgacccccgaaggcaaggttgtggatctgggctgcgggcgcggaggctggagctactattgtgggggacttaagaatgtccgggaggtgaaaggcctgaccaaagggggaccgggccatgaagaacctatccccatgtccacatacggctggaacctcgtgagactgcagagcggggttgacgtcttcttcacaccccctgagaaatgcgatacactgctctgtgacattggagaatcctctcccaatcctacgatcgaggctggccgcacccttcgggtgctgaacctggtggaaaattggctcaacaataacacacaattttgcattaaggtcctgaatccgtatatgcccagcgttatcgagaaaatggaaacccttcagagaaagtacgggggagccctggtgcgcaaccctctctccagaaattctacacacgagatgtactgggtgagcaacgcgaccggcaatattgtctccacggtgaacatgatctctagaatgctgatcaatcgcttcaccatgaagcacaaaaaggccacatatgagcccgatgttgacctggggagcggaacccggaacattggcatcgaatccgagattcctaacctcgacatcattggcaaaagaatcgaaaagattaaacaggagcatgaaacaagctggcactacgatcaggaccatccctataagacctgggcttaccacgggtcttatgagacaaagcaaaccggatccgccagctctatggtgaatggcgtcgtgcgccttctgacgaaaccgtgggatgttgtgcctatggtcacacagatggctatgaccgacaccacaccctttgggcagcagagagtgttcaaggagaaagtggatacgcggacccaagaacctaaggagggaaccaagaagctgatgaagatcaccgccgaatggctctggaaagagctgggcaagaaaaagacaccccgcatgtgtaccagagaggaatttacacggaaagtcagatccaacgctgcccttggggcgatcttcaccgacgagaataagtggaaaagcgcccgggaagctgttgaggattctcgcttttgggaactgattgacagagagcggaacctccacctggagggaaagtgcgaaacgtgtgtgtacaatatgatgggcaagcgcgagaaaaagctgggcgagttcgggaaagccaagggatccagagctatctggtatatgtggctcggcgcccggtttctggagttcgaagcccttgggtttctgaacgaggatcattggttcagccgcggaaattccctcagcggcgtggagggggaaggcctgcacagacttggatacattctgcgggacgtctctaaaaaggagggcggggcgatgtacgctgatgacaccgccggatgggacacacgcatcaccctcgaagatctgaagaacgaggaaatggtgacaaatcatatgaaaggcgagcacaagaaactggccgaggctatttttaagctcacctatcagaacaaagttgtgagagtccagcggcctacgccccgcgggacagtgatggacatcatcagcagacgggatcagcgcggatccggccaagttgggacctacggcctgaatacattcaccaacatggaagcccagcttattagacagatggagggagaaggcatcttcaagtctattcaacatctgacggtgaccgaggagatcgctgtccagaattggctcgcccgggtggggagagaacgcctgagccggatggcgatttccggagacgattgcgttgtgaagccgcttgacgatagatttgcctctgctctgacagccctcaacgacatgggcaaagtccgcaaggatatccagcagtgggagcctagccgggggtggaatgactggacccaagtgcccttctgctcccaccactttcatgaactggtcatgaaagatggaagagtgctggttgtgccctgtcgcaaccaggacgagctcatcggccgggctagaatttctcagggggccggctggagcctgaaggaaacagcgtgccttggaaaatcctatgcccagatgtggaccctgatgtacttccaccgccgggatctcagactggctgccaacgctatctgtagcgccgtcccttctcattgggtgccgacatcccgcaccacgtggagcattcacgctaagcacgagtggatgacaaccgaggacatgcttgccgtgtggaatcgggtttggatccaagaaaacccctggatggaggacaagacccctgtggaatcttgggaggaagtcccctatctgggcaaaagagaggatcagtggtgcgggtccctcattggactgacaagccgggcgacctgggccaagaatatccagacagctattaaccaggtgagatccctgatcggcaatgaggaatacacggactatatgccttctatgaaacgctttcggagagaggaagaggaagccggggttctctggtga

SEQ ID NO: 19922 - RNA, 9876 nt, synthetic construct
  misc_feature 1..9876: note = derived and/or modified CDS sequence (opt5) from DENV-2__EU482583__SS-prME
  source 1..9876: mol_type = other RNA
accgccggcgtgatcattatgctgatccccaccgctatggccttccacctcacgacccggaatggggaacctcatatgattgtcggacggcaggaaaagggcaagagcctgctttttaagaccgaggacggggttaatatgtgcaccctgatggcgatcgatctcggagaactgtgtgaggacaccattacctacaagtgcccgcttctgcgccaaaatgaacccgaggatatcgactgttggtgcaatagcacgtctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagaataaagaactgaagtgcggctccgggatcttcattaccgataacgtgcacacatggacggagcagtacaagtttcagcctgaaagcccctccaaacttgcttctgccatccaaaaggctcatgaggaaggcatttgtggaatcagaagcgtcacccgcctggagaatctcatgtggaaacagatcacaccggagctgaaccacattctgtccgaaaatgaggtgaaacttaccatcatgacaggcgacattaaagggatcatgcaggccggaaagcggtctctcagacctcagcccaccgaactgaaatatagctggaagacgtggggcaaggcgaaaatgctgtccaccgagagccataaccaaacattcctcattgatgggcctgaaaccgccgagtgccccaatacaaaccgcgcttggaactctctggaggttgaagactacggatttggcgtgttcaccacaaacatctggcttaagctgcgggagaaacaggacgtcttttgtgattccaagctcatgagcgccgctatcaaagacaatagagccgtgcacgcggatatgggctattggattgaatctgccctgaacgacacctggaagatggagaaggcttccttcatcgaggttaaaagctgccactggcctaagtctcatacgctgtggagcaatggggtgcttgaatccgagatgattatccccaaaaacttcgccggaccggtcagccagcacaactaccgccctggctatcatacacagaccgctgggccctggcacctcggaaagctggaaatggattttgacttctgtgagggcaccacagtggtggtcaccgaagattgcgggaatcggggaccctctctgagaacgacaaccgcctccggcaaactcattacagagtggtgctgtcggagctgcaccctgcctccgcttcgctacagaggcgaggacgggtgttggtacggaatggaaatccggcccctgaaggagaaggaagagaacctcgttaattccctggtgacagccggccatgggcaaattgataacttttctctgggagtgcttggcatggctctcttcctggaagagatgctgagaacccgcgtcgggacgaaacacgcgatcctcctggtggccgttagctttgtgacccttatcacaggaaatatgtccttccgggacctgggcagagtcatggtgatggttggcgctaccatgacagatgacattgggatgggagtgacctatctcgccctgctggccgcttttaaggtccgccctacgttcgccgcgggccttctgctcagaaaactgacatctaaggagctcatgatggctaccatcgggattgccctgcttagccagtccacaatccccgaaaccattctggagctcaccgatgccctggctctgggaatgatggtgcttaaaatcgttcggaacatggaaaagtaccagctggccgtgacaatcatggcgatttcttgcgtccctaatgctgtgatcctccaaaacgcctggaaggtgagctgtacgattctggccgctgtctccgttagccccctcctgcttacctcttcccagcagaaagccgactggatccctctggctctcacaattaagggcctgaatcccaccgccatctttctgacaacccttagccgcacgtctaaaaagagatcctggccgctgaacgaggcgatcatggccgtggggatggtgagcattctcgcttcttccctgctcaaaaatgacatccctatgacaggacccctggtcgccggcggccttctgaccgtgtgctatgttctgaccgggcggagcgctgatctcgaactggagcgcgccgccgacgtgaagtgggaggatcaggctgaaatttccggaagctctcctatccttagcattacaatctccgaggacggctctatgagcattaaaaacgaagaggaggaacaaaccctgacaatcctcatcagaacggggctgctcgtcatttccggagtgttccccgtttctatcccgattaccgcggccgcttggtacctgtgggaggtgaagaagcagcgggccggcgtcctttgggatgtgccttctccccctcccgtcgggaaagccgaactggaggacggagcttatcgcatcaagcagagaggcattctgggctactcccagatcggggccggagtgtataaagaaggcacatttcacaccatgtggcatgttacaagaggggcggtgctcatgcaccgcggaaagagaatcgagccctcctgggctgatgtcaaaaaggacctgattagctacggcgggggatggaaacttgagggcgaatggaaagagggcgaagaggtgcaagttctggccctcgaacctgggaagaatccgcgggccgtgcagaccaaacccggactgttcaagacgaacaccggcacaatcggggctgtctccctcgattttagccctggaacctctggctcccccattgtggacagaaaagggaaggtggttggactgtacggcaatggcgtcgtgacacgcagcggggcctatgtgtctgcgatcgctcagaccgagaagtccattgaggataaccctgaaatcgaggacgatatcttccggaaaaagagacttacaattatggacctgcatcccggagccggcaaaacgaagcgctacctgcctgccatcgtccgggaagctattaaaagagggctccgcaccctgatccttgccccgacacgggtggttgctgccgagatggaagaggcgctgagaggactccccattcgctatcagacccctgccatccgggctgagcacaccggcagagaaattgtggacctgatgtgtcatgccacattcacgatgcggctcctgagccccgtccgcgtgcctaactacaatcttatcatcatggatgaggctcactttaccgaccccgcctccattgccgctagagggtatatctctacacgggttgaaatgggcgaggcggccggaattttcatgaccgctacaccgcctggcagccgcgatccctttccccaatccaacgcccctatcatggacgaggaaagagagattcccgaacggagctggaactctgggcacgagtgggtgaccgatttcaagggaaagacggtctggtttgtgccttccatcaaagccggcaacgacatcgctgcctgcctgagaaagaatgggaaaaaggttattcagctgagccgcaaaacattcgatgcggaatacgtgaagacccgggctaacgactgggattttgtcgtgaccacagacatctctgagatgggagccaatttcaaggccgagagagtgattgatccgcgccggtgtatgaaacccgtcatcctcaccgacggcgaagagagagttattctggctgggcctatgcccgtgacacatagctccgccgcgcagcgccggggcagaatcggacgcaaccctaagaatgaaaacgaccaatatatctacatgggcgagccccttgaaaatgatgaggactgcgcccactggaaagaggctaagatgctgctcgataacattaataccccggaagggatcattccttctatgtttgagcccgaaagagagaaagtggacgccatcgatggagaataccggctgcgcggcgaggctagaaagacgttcgtcgacctgatgcggcgcggggatctccctgtgtggcttgcctatagagttgctgccgagggaattaactacgcggaccggagatggtgttttgatggcatcaaaaataaccagattctggaagagaacgtggaagtcgagatctggacaaaggagggggaacgcaagaaactgaagccccggtggctcgacgccagaatctatagcgatcctctggctcttaaagagttcaaggagttcgccgctggccgcaaatccctgaccctcaatctgattacagagatgggacggctgcccacctttatgacgcagaaggccagagacgccctcgataaccttgctgtgctgcataccgcggaagccggcgggcgggcttacaatcacgccctgtctgagctcccggagacactggaaacccttctgctcctgacactgctcgccaccgttacaggaggcatcttcctttttctgatgagcgggaagggaattggcaaaatgaccctgggcatgtgctgcatcattacggcttccatcctcctgtggtatgcccagatccaacctcactggattgcggccagcatcattcttgagttctttctgatcgtgctcctgattcccgaacccgagaagcagcgcacacctcaggacaaccagctgacctacgtcgtgatcgctatcctcaccgtcgtggccgctacaatggccaatgaaatggggttccttgagaaaaccaagaaagacctgggactgggctctattacaacgcaagagtccgaaagcaacatcctcgatattgacctgagaccggcgtccgcctggaccctttatgctgttgccacaacctttgtgacacccatgctgcggcattctatcgagaatagctccgtgaacgtctctctcaccgctattgccaatcaggctacggttctgatggggctgggaaagggctggcctctcagcaagatggatatcggggtgccccttctggccattggatgttactcccaggtgaaccctatcaccctgacagcggccctcctgcttctggtcgctcactacgccatcattggccccggcctccaggctaaagccacccgcgaagcccaaaagagagcggctgccgggatcatgaaaaatcctacagtggacggaattaccgttatcgatctggagccgattccctatgaccctaagttcgaaaaacagctgggccaggtgatgctccttatcctgtgcgtcacacaggtgctgatgatgcggacaacctgggctctctgtgaggccctgacacttgccaccgggcccatcagcaccctgtgggagggaaaccctggccgcttttggaatacaacgattgctgtctctatggccaacatcttcagagggtcctacctcgcgggagccggcctgctgtttagcattatgaagaataccacaaacacccggcgcggcacagggaatatcggagaaaccctcggcgagaagtggaaatctagacttaacgctctggggaagtccgagttccaaatttataaaaagagcggaatccaggaggtggatcggacgctggccaaagagggcatcaagagaggggaaacagaccatcacgctgtttctcgcggaagcgccaaactccggtggtttgtggagagaaacatggtcacccccgaaggcaaggtggttgatctgggctgcgggcgcggaggctggtcctactattgtgggggacttaagaatgtgcgggaggtcaaaggcctgaccaaagggggaccgggccatgaagaacctattcccatgtctacatacggctggaacctcgtgagactgcagagcggggtggacgttttcttcacaccccctgagaaatgcgatacactgctctgtgacatcggagaatccagccccaatcctacgattgaggcgggccgcacccttcgggtcctgaacctggtggaaaattggctcaacaataacacacaattttgcatcaaggtgctgaatccgtatatgccctccgtcattgagaaaatggaaacccttcagagaaagtacgggggagccctggttcgcaaccctctctctcggaatagcacacacgagatgtactgggtgtccaacgctaccggcaatatcgtgtctagcgtcaacatgatctccagaatgctgattaatcgcttcacgatgaagcacaaaaaggccacctatgagcccgatgtggacctggggtctggaacacggaacatcggcattgaaagcgagatccctaacctcgacattatcggcaaaagaattgaaaagatcaaacaggagcatgaaacctcctggcactacgatcaggaccatccctataagacatgggcttaccacgggagctatgagaccaagcaaacaggatctgcctccagcatggttaatggcgtggtccgccttctgaccaaaccgtgggatgtggttcctatggtgacgcagatggctatgacagacaccaccccctttgggcagcagagagtcttcaaggagaaagtggatacacggacgcaagaacctaaggagggaaccaaaaagctgatgaagatcacagccgaatggctctggaaagagctgggcaagaaaaagacaccccgcatgtgtacaagagaggaatttacccggaaagtgagatctaacgcggcccttggggctattttcacagacgagaataagtggaaatccgcccgggaagctgtcgaggatagccgcttttgggaactgatcgacagagagcggaacctccacctggagggaaagtgcgaaacctgtgtttacaatatgatgggcaagcgcgagaaaaagctgggcgagttcgggaaagccaagggatctagagccatttggtatatgtggctcggcgcgcggtttctggagttcgaagctcttgggtttctgaacgaggatcattggttctcccgcggaaatagcctctccggcgtggagggggaaggcctgcacagacttggatacatcctgcgggacgtgagcaaaaaggagggcggggccatgtacgccgatgacacggctggatgggacacccgcattacactcgaagatctgaagaacgaggaaatggtcaccaatcatatgaaaggcgagcacaagaaactggccgaggctatctttaagctcacatatcagaacaaagtggttagagtgcagcggcctacaccccgcgggacggtcatggacatcatttctagacgggatcagcgcggaagcggccaagtggggacatacggcctgaataccttcacaaacatggaagcccagcttatcagacagatggagggagaaggcattttcaagtccatccaacatctgaccgttacggaggagattgcggtgcagaattggctcgcccgggtcgggagagaacgcctgtctcggatggctatcagcggagacgattgcgtggttaagccgcttgacgatagatttgcctccgctctgaccgccctcaacgacatgggcaaagtgcgcaaggatatccagcagtgggagccttctcgggggtggaatgactggacacaagtccccttctgcagccaccactttcatgaactggtgatgaaagatggaagagtcctggtggttccctgtcgcaaccaggacgagctcattggccgggcgagaatctcccagggggccggctggtctctgaaggaaaccgcttgccttggaaaaagctatgcccagatgtggacactgatgtacttccaccgccgggatctcagactggctgccaacgctatttgttccgccgtgcctagccattgggtcccgacctctcgcacaacctggtccatccacgcgaagcacgagtggatgacgacagaggacatgcttgccgtgtggaatcgggtgtggattcaagaaaacccctggatggaggacaagacccctgttgaaagctgggaggaagtgccctatctgggcaaaagagaggatcagtggtgcgggtctctcatcggactgacctcccgggctacatgggccaagaatattcagaccgccatcaaccaggtcagaagcctgatcggcaatgaggaatacacagactatatgccttccatgaaacgctttcggagagaggaagaggaagctggggtgctctggtga

SEQ ID NO: 19923 - RNA, 9876 nt, synthetic construct
  misc_feature 1..9876: note = derived and/or modified CDS sequence (opt5) from DENV-2__EU482585__SS-prME
  source 1..9876: mol_type = other RNA
accgcgggagtgatcattatgctgatccccaccgctattgccttccacctcacgaccagaaacggggagcctcatatgatcgtcggacggcaggaaaagggcaagtccctgctttttaagaccgaggacggggttaatatgtgcaccctgatggcgattgatctcggagaactgtgtgaggacaccatcacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggattgagacctggatcctgcgccatcccgggttcacaattatggccgctatcctcgcctacaccattggaaccacacactttcagagagctctgatcttcattcttctgacggccgtggcgcctagcatgaccatgcggtgcatcggcatctccaaccgcgattttgtcgaaggggtgtctggaggcagctgggttgacattgtgctcgagcacgggtcctgtgtcacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttgtgtgcaagcattccatggtggatagaggctggggcaacgggtgtggactgttcggcaaagggggaatcgtcacatgcgccatgtttacgtgcaaaaagaatatggaaggcaaagttgtgctccctgagaacctggaatacaccattgtgatcacaccccacagcggggaggagcatgcggtcggaaatgacaccggcaagcacggcaaagaaatcaagattacacctcagtcttccatcaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggattcagaaggagaccctcgtcacgttcaagaaccctcatgctaaaaagcaggacgtggttgtgctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtcaaagaaatcgcggagacacaacacggcacgatcgtgattagagtccagtatgagggggacggatccccctgcaagatccccttcgaaattatggatctggagaaacgccatgtgctgggccggctcatcaccgttaaccctattgtgacagaaaaggacagcccggtcaacatcgaggccgaacccccttttggggattcttacattatcatcggcgtggagcccggacagctgaaacttaattggttcaagaagggctccagcattgggcagatgtttgagaccacaatgagaggagctaaacgcatggccatcctgggcgacaccgcctgggatttcgggtctctcggaggcgtttttacgagcattgggaaggctctgcaccaagtgttcggcgccatctacggagcggctttttccggcgtctcttggacaatgaaaattctgatcggggtgatcattacctggatcggaatgaacagccggtccaccagcctttctgtgtccctcgttctggtcggcgtggtgacactgtatctcggggccatggtccaggccgacagcggatgtgtggtttcttggaagtccaaagaactgaagtgcggcagcgggattttcatcaccgataatgtgcacacatggacggagcagtacaagtttcagcctgaatccccctctaaacttgctagcgccattcaaaaggctcatgaggaaggcatctgtggaatcagatccgtcacccgcctggagaacctcatgtggaaacagattacaccggagctgaatcacatcctgtctgaaaacgaggtgaaacttaccattatgacaggcgggatcaaaggaattatgcaggccggcaagcggagcctcagacctcagcccaccgaactgaaatattcctggaagacgtgggggaaggcgaaaatgctgagcaccgagtctcataatcaaacattcctcatcgacggacctgaaaccgccgagtgccccaacacaaatcgcgcttggaactccctggaggttgaagattacggctttggcgtgttcaccacaaatatctggcttaagctgcgggagaaacaggacgtcttttgtgacagcaagctcatgtctgccgctattaaagataacagagccgtgcacgcggacatggggtattggatcgaatccgccctgaatgatacctggaagatggagaaggctagcttcattgaggttaaatcttgccactggcctaagagccatacgctgtggtccaacggagtgcttgaaagcgagatggtcatccccaaaaatttcgccggcccggtgtctcagcacaactaccgccctgggtatcatacacagaccgctggaccctggcacctcggcaagctggaaatggactttgatttctgtgaggggaccacagtggtcgttaccgaagactgcggaaaccggggcccctccctgagaacgacaaccgccagcggcaaactcattacagagtggtgctgtcggtcctgcaccctgcctccgcttcgctacagaggggaggatggatgttggtacggcatggaaatccggcccctgaaggagaaggaagagaatctcgtgaactctctggtgacagccgggcatggacaaattgacaattttagcctgggcgtccttgggatggctctcttcctggaagagatgctgagaacccgcgtgggaacgaaacacgcgatcctcctggttgccgtgtcctttgtcacccttatcacaggcaacatgtctttccgggatctgggcagagtgatggttatggtgggggctaccatgacagacgatattggaatgggcgtcacctatctcgccctgctggccgcttttaaggtgcgccctacgttcgccgcggggcttctgctcagaaaactgacaagcaaggagctcatgatggctaccatcggaattgccctgctttcccagtctacaatccccgaaaccattctggagctcaccgacgccctggctctgggcatgatggttcttaaaatcgtgcggaatatggaaaagtaccagctggccgtcacaatcatggcgattagctgcgtgcctaacgctgtgatcctccaaaatgcctggaaggtctcctgtacgattctggccgctgttagcgtgtctcccctcctgcttacctccagccagcagaaagccgattggatccctctggctctcacaattaaggggctgaaccccaccgccatctttctgacaaccctttctcgcacgtccaaaaagagaagctggccgctgaatgaggcgatcatggccgtgggaatggtctctattctcgcttccagcctgctcaaaaacgacatccctatgacaggccccctggtggccggcgggcttctgaccgtttgctatgtgctgaccggacggtccgctgacctcgaactggagcgcgccgccgatgtcaagtgggaggaccaggctgaaattagcggctctagccctatcctttccattacaatctctgaggatgggagcatgtccattaaaaatgaagaggaggaacaaaccctgacaatcctcatcagaacgggactgctcgtgatttctggcgttttccccgtgagcatcccgattaccgcggccgcttggtacctgtgggaggtcaagaagcagcgggccggggtgctttgggacgtcccttctccccctcccgtgggaaaagccgaactggaggatggcgcttatcgcatcaagcagagaggcattctggggtacagccagatcggagccggcgtttataaagaagggacatttcacaccatgtggcatgtgacacggggagcggtcctcatgcaccgcggcaagagaatcgagcccagctgggctgacgtgaaaaaggatctgatttcctacgggggaggctggaaacttgagggcgaatggaaagagggggaagaggttcaagtgctggccctcgaacctggaaagaacccgcgggccgtccagaccaaacccggcctgttcaagacgaataccgggacaatcggagctgtgagcctcgacttttctcctggcacctccgggagccccattgtggatagaaaaggaaaggttgtcggcctgtacggcaacggggtggtgacacgctctggagcctatgtctccgcgatcgctcagaccgaaaagagcattgaggacaatcctgaaatcgaggatgacatcttccggaaaaagagacttacaattatggatctgcatcccggcgccgggaaaacgaagcgctacctgcctgccatcgtgcgggaagctattaaaagaggactccgcaccctgatccttgccccgacacgggttgtggctgccgagatggaagaggcgctgagaggcctccccattcgctatcagacccctgccatccgggctgagcacaccgggagagaaattgtcgacctgatgtgtcatgccacattcacgatgcggctcctgtcccccgtgcgcgttcctaactacaaccttatcatcatggacgaggctcactttaccgatcccgcctctattgccgctagaggctatatcagcacacgggtggaaatgggagaggcggccggcattttcatgaccgctacaccgcctgggtcccgcgacccctttccccaaagcaatgcccctatcatggatgaggaaagagagattcccgaacggtcttggaactccggacacgagtgggtcaccgacttcaagggcaagacggtgtggtttgttcctagcatcaaagccgggaatgatatcgctgcctgcctgagaaagaacggcaagaaggtgattcagctgtctcgcaaaacattcgacagcgaatacgtcaagacccgggcgaatgattgggactttgtggtgaccacagatatctccgagatgggcgctaacttcaaggccgagagagtcattgacccgcgccggtgtatgaaacccgttatcctcaccgatggggaagagagagtgattctggccggccctatgcccgtgacacattctagcgctgcccagcgccggggaagaatcggccgcaatcctaagaacgaaaatgaccaatatatctacatgggggagccccttgaaaacgacgaggattgcgcgcactggaaagaggccaagatgctgctcgacaatattaacaccccggaaggaatcattccttccatgtttgagcccgaaagagagaaagtcgatgctatcgacggcgaataccggctgcgcggggaggccagaaagacgttcgtggatctgatgcggcgcggagacctccctgtttggcttgcttatagagtggccgctgagggcattaattacgccgatcggagatggtgttttgacgggatcaaaaacaatcagattctggaagagaacgtcgaagtggagatctggacaaaggagggcgaacgcaagaaactgaagccccggtggctcgatgcgagaatctattctgaccctctggcccttaaagagttcaaggagttcgctgccggacgcaaaagcctgaccctcaacctgattacagagatgggccggctgcccacctttatgacgcagaaggctagagatgccctcgacaatcttgccgttctgcataccgctgaagccgggggacgggcctacaaccacgctctgtccgagctcccggagacactggaaacccttctgctcctgacactgctcgccaccgtgacaggcgggatcttcctttttctgatgagcggaaagggcattggcaaaatgaccctggggatgtgctgcatcattacggcctctatcctcctgtggtatgctcagatccaacctcactggattgccgcgtccatcattcttgagttctttctgatcgtcctcctgattcccgaacccgagaagcagcgcacacctcaggataatcagctgacctacgtggtcatcgccatcctcaccgtggttgctgccacaatggctaacgaaatgggattccttgagaaaaccaagaaagacctgggcctggggagcattacaacgcaagagtccgaatctaatatcctcgacattgatctgagaccggccagcgcgtggaccctttatgccgtggctacaacctttgtgacacccatgctgcggcattccatcgagaactctagcgtcaatgtttccctcaccgccattgctaaccaggccacggtgctgatgggactgggcaaggggtggcctctcagcaagatggacatcggagtgccccttctggctattggctgttactctcaggtcaatcctatcaccctgacagccgcgctcctgcttctggtggcccactacgctatcattggccccgggctccaggccaaagctacccgcgaagcccaaaagagagccgcggctggaatcatgaaaaaccctacagttgatggcattaccgtgatcgacctggagccgattccctatgatcctaagttcgaaaaacagctggggcaggtcatgctccttatcctgtgcgtgacgcaggtcctgatgatgcggacaacctgggccctctgtgaggctctgacacttgccaccggacccatctccaccctgtgggagggcaatcctgggcgcttttggaacacaacgattgccgtgagcatggctaatatcttcagaggatcttacctcgccggcgcgggcctgctgttttccattatgaagaacaccacaaatacccggcgcgggacaggaaacatcggcgaaaccctcggggagaagtggaaaagcagacttaatgccctgggaaagtctgagttccaaatttataaaaagagcggcatccaggaggttgaccggacgctggctaaagaggggatcaagagaggagaaacagatcatcacgccgtgtcccgcggctctgctaaactccggtggtttgtcgagagaaacatggtgacccccgaaggcaaggttgtggacctggggtgcggacgcggcgggtggagctactattgtggaggccttaagaacgtccgggaggtgaaagggctgaccaagggaggcccgggccatgaagaacctattcccatgtccacatacgggtggaatctcgtgagactgcagagcggagttgatgtcttcttcacaccccctgagaaatgcgacacactgctctgtgatatcggcgaatcctctcccaaccctacgattgaggccgggcgcacccttcgggtgctgaatctggtggaaaactggctcaatagcaacacacaattttgcatcaaggtcctgaatccgtatatgccctccgttattgagaaaatggaaacccttcagagaaagtacggaggcgcgctggtgcgcaaccctctctctcggaatagcacacacgagatgtactgggtgtccaacgccaccgggaatatcgtctctagcgtgaacatgatctccagaatgctgattaatcgcttcacgatgaagcacaaaaaggctacctatgagcccgacgttgatctgggaagcggcacacggaacatcggcattgaatctgagatccctaatctcgacattatcgggaaaagaattgaaaagatcaaacaggagcatgaaacctcctggcactacgaccaggatcatccctataagacatgggcctaccacggaagctatgagaccaagcaaacaggctctgcttccagcatggtgaacggggtcgtgcgccttctgaccaaaccgtgggacgttgtgcctatggtcacgcagatggccatgacagataccaccccctttggacagcagagagtgttcaaggagaaagtggacacacggacgcaagaacctaaggagggcaccaaaaagctgatgaagatcacagctgaatggctctggaaagagctggggaagaaaaagacaccccgcatgtgtacaagagaggaatttacccggaaagtcagatctaacgccgcgcttggagccattttcacagatgagaataagtggaaatccgctcgggaagccgttgaggacagccgcttttgggaactgatcgatagagagcggaacctccacctggagggcaagtgcgaaacctgtgtgtacaatatgatgggcaagcgcgagaaaaagctgggggagttcggaaaagctaagggctccagagccatttggtatatgtggctcggggcccggtttctggagttcgaagcgcttggatttctgaacgaggaccattggttcagccgcggcaattctctcagcggggtggagggcgaaggactgcacagacttggctacatcctgcgggatgtctccaaaaaggaagggggagctatgtacgccgacgatacggccggctgggacacccgcattacactcgaagacctgaagaacgaggaaatggtgaccaatcatatgaaaggggagcacaagaaactggctgaggccatctttaagctcacatatcagaacaaagttgtgagagtccagcggcctacaccccgcggaacggtgatggatatcatttctagacgggaccagcgcggcagcgggcaagttggcacatacggactgaataccttcacaaacatggaagctcagcttatcagacagatggagggcgaagggattttcaagtccatccaacatctgaccgtgacggaggagattgccgtccagaattggctcgcgcgggtgggaagagaacgcctgtctcggatggccatcagcggcgatgactgcgttgtgaagccgcttgatgacagatttgcttccgccctgaccgctctcaacgatatggggaaagtccgcaaggacatccagcagtgggagccttctcggggatggaatgattggacacaagtgcccttctgcagccaccactttcatgaactggtcatgaaagacggcagagtgctggttgtgccctgtcgcaaccaggatgagctcattgggcgggccagaatctcccagggcgcgggatggagcctgaaggaaaccgcctgccttggcaaatcttatgctcagatgtggacactgatgtacttccaccgccgggacctcagactggccgctaatgccatttgttccgctgtccctagccattgggtgccgacctctcgcacaacctggtccatccacgccaagcacgagtggatgacgacagaggatatgcttgcggtgtggaaccgggtttggattcaagaaaacccctggatggaggacaagacccctgtggaaagctgggaggaaatcccctatctggggaaaagagaggaccagtggtgcggatccctcattggcctgacctctcgggccacatgggctaagaatatccagaccgccatcaaccaggtcagaagcctgattgggaatgaggaatacacagattatatgccttccatgaaacgctttcggagagaggaagaggaagccggagtgctctggtga

SEQ ID NO: 19924 - RNA, 9876 nt, synthetic construct
  misc_feature 1..9876: note = derived and/or modified CDS sequence (opt5) from DENV-2__EU482587__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacaccattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggtggaacttacggggtatggaaccgttacaatggagtgtagcccccggaccggcctggatttcaacgaaatggtgctcctgcagatggaggacaaagcctggcttgtccaccgccaatggtttctggatctcccgctgccttggctgcccggggctgacacacagggatctaattggatccagaaggagaccctcgtgacgttcaagaaccctcatgccaaaaagcaggacgttgtggtcctgggctcccaagaaggggctatgcacacagcccttaccggcgccacagagattcagatgagctccggaaatctgctctttaccggccatctgaaatgcagacttcggatggataagctgcagctcaaagggatgtcttacagcatgtgtaccggaaagttcaagatcgtgaaagaaattgctgagacacaacacggcacgatcgtcatcagagtgcagtatgagggggacggatccccctgcaagattcccttcgaaatcatggatctggagaaacgccatgttctgggccggctcattaccgtgaaccctatcgtcacagaaaaggacagcccggtgaacattgaggcggaacccccttttggggattcttacatcattatcggcgttgagcccggacagctgaaacttaattggttcaagaagggctccagcatcgggcagatgtttgagaccacaatgagaggagccaaacgcatggctattctgggcgacaccgcctgggatttcgggtctctcggaggcgtgtttacgagcatcgggaaggccctgcaccaagtcttcggcgctatttacggagccgcgttttccggcgtgtcttggacaatgaaaatcctgattggggtgatcatcacctggattggaatgaacagccggtccaccagcctttctgtttccctcgtcctggtgggcgtggtcacactgtatctcggggctatggtgcaggccgacagcggatgtgttgtgtcttggaagtccagagaactgaaatgcggcagcgggatcttcattaccgataatgtccacacatggacggagcagtacaagtttcagcctgaatccccctctaaacttgccagcgctatccaaaaagcccatgaggaaggcatttgtggaatccgctccgtgacccggctggagaacctcatgtggaagcagatcacaccggagctgaatcacattctgtctgaaaacgaggttaaacttaccatcatgacaggcgacattaaggggatcatgcaggctggaaaaagaagcctccgccctcagcccaccgaactgaagtattcctggaaaacgtggggcaaggccaagatgctgagcaccgagtctcataatcggacattcctcattgatgggcctgaaaccgcggagtgccccaacacaaatagagcctggaactccctggaggtggaagactacggatttggcgtcttcaccacaaatatctggcttaaactgcgcgagaagcaagacgtgttttgtgatagcaaactcatgtctgctgccatcaaggacaaccgggctgttcacgccgatatgggctattggattgaatccgcgctgaatgacacctggaaaatggagaaggccagcttcatcgaggtgaagtcttgccactggcctaaaagccatacgctgtggtccaacggggtccttgaaagcgagatgattatccccaagaatttcgctggaccggtgtctcagcacaactacagacctggctatcatacacagaccgccgggccctggcacctcggaaaactggaaatggattttgacttctgtgagggcaccacagtggtcgttaccgaagattgcgggaaccggggaccctccctgcgcacgacaaccgctagcggcaagctcattacagagtggtgctgtagatcctgcaccctgcctccgcttcggtacagaggcgaggacgggtgttggtacggaatggaaatccgccccctgaaagagaaggaagagaatctcgtgaactctctggtgacagccggccatgggcagattgataattttagcctgggagtccttggcatggccctcttcctggaagagatgctgcggaccagagtggggacgaagcacgctatcctcctggttgcggtgtcctttgtcacccttatcacaggaaacatgtctttccgcgacctgggcagagtgatggttatggtgggcgccaccatgacagatgacattgggatgggagtcacctatctcgctctgctggccgcctttaaagtgcggcctacgttcgctgccggccttctgctccgcaagctgacaagcaaagagctcatgatggcgaccatcgggattgctctgctttcccaatctacaatccccgaaaccattctggagctcaccgatgccctggccctgggaatgatggttcttaagatcgtgagaaatatggaaaaataccagctggctgtcacaatcatggccattagctgcgtgcctaacgcggtgatcctccagaatgcttggaaggtctcctgtacgattctggccgccgttagcgtgtctcccctcctgcttacctccagccaacagaaggctgactggatccctctggccctcacaattaaaggcctgaaccccaccgctatctttctgacaaccctttctcggacgtccaagaaacgcagctggccgctgaatgaggccatcatggcggtggggatggtctctattctcgcctccagcctgctcaagaacgacatccctatgacaggacccctggtggctggcggccttctgaccgtttgctatgtgctgaccgggagatccgccgatctcgaactggagcgggctgccgacgtcaaatgggaggatcaggccgaaattagcggatctagccctatcctttccattacaatctctgaggacggcagcatgtccattaagaatgaagaggaggaacagaccctgacaatcctcatccgcacggggctgctcgtgatttctggagttttccccgtgagcatcccgattaccgctgcggcctggtacctgtgggaggtcaaaaagcaaagagctggcgtgctttgggatgtcccttctccccctcccgtggggaaggccgaactggaggacggagcctatcggatcaaacagcgcggcattctgggctacagccagatcggggctggagtttataaggaaggcacatttcacaccatgtggcatgtgacaagaggggccgtcctcatgcaccggggaaaaagaatcgagcccagctgggcggatgtgaagaaagacctgatttcctacggcgggggatggaaacttgagggcgaatggaaggagggcgaagaggttcaggtgctggctctcgaacctgggaaaaacccgcgcgccgtccaaaccaagcccggactgttcaaaacgaataccggcacaatcggggccgtgagcctcgatttttctcctggaacctccggcagccccattgtggaccggaaggggaaagttgtcggactgtacggcaacggcgtggtgacaagatctggggcttatgtctccgccatcgcgcagaccgaaaagagcattgaggataatcctgaaatcgaggacgatatcttccgcaagaaacggcttacaattatggacctgcatcccggagctggcaagacgaaaagatacctgcctgccatcgtgcgcgaagccattaagcgggggctcagaaccctgatccttgctccgacacgcgttgtggccgctgagatggaagaggccctgcggggactccccattagatatcagacccctgcgatccgggccgagcacaccggccgcgaaattgtcgacctgatgtgtcatgctacattcacgatgagactcctgtcccccgtgcgggttcctaactacaaccttatcatcatggatgaggcccactttaccgaccccgcttctattgccgcccgcgggtatatcagcacaagagtggaaatgggcgaggctgcgggaattttcatgaccgccacaccgcctggctcccgggatccctttccccagagcaatgctcctatcatggacgaggaaagagagattcccgaacgctcttggaactccgggcacgagtgggtcaccgatttcaaaggaaagacggtgtggtttgttcctagcatcaaggccggcaatgacatcgccgcttgcctgcggaaaaacgggaagaaagtgattcaactgtctagaaagacattcgatagcgaatacgtcaaaacccgcgccaatgactgggattttgtggtgaccacagacatctccgagatgggagcgaacttcaaggctgagcgggtcattgatccgagacgctgtatgaagcccgttatcctcaccgacggcgaagaacgggtgattctggccgggcctatgcccgtgacacattctagcgccgctcagagacgcggcagaatcggacggaatcctaaaaacgaaaatgaccagtatatctacatgggcgagccccttgaaaacgatgaggactgcgcccactggaaggaggcgaaaatgctgctcgataatattaacaccccggaagggatcattccttccatgtttgagcccgaacgcgagaaggtcgacgccatcgatggagaatacagactgcggggcgaggctcgcaaaacgttcgtggacctgatgagaagaggggatctccctgtttggcttgcctatagagtggctgccgagggaattaattacgctgaccgccggtggtgttttgatggcatcaagaacaatcaaattctggaagagaacgtcgaagtggagatctggacaaaagagggggaaagaaagaagctgaaaccccgctggctcgacgcccggatctattctgatcctctggcgcttaaggagttcaaagagttcgccgctggcagaaagagcctgaccctcaacctgattacagagatgggacggctgcccacctttatgacgcagaaagcccgcgacgctctcgataatcttgccgttctgcataccgccgaagctggcgggagagcgtacaaccacgccctgtccgagctcccggagacactggaaacccttctgctcctgacactgctcgctaccgtgacaggaggcatcttcctttttctgatgagcgggaagggaattggcaagatgaccctgggcatgtgctgcatcattacggcctctatcctcctgtggtatgcccagatccagcctcactggattgctgcctccatcattcttgagttctttctgatcgtcctcctgattcccgaacccgagaaacaacggacacctcaggacaatcagctgacctacgtggtcatcgcgatcctcaccgtggttgccgctacaatggccaacgaaatggggttccttgagaagaccaaaaaggacctgggactgggcagcattacaacgcaggagtccgaatctaatatcctcgatattgacctgcgcccggctagcgcctggaccctttatgcggtggccacaacctttgtgacacccatgctgagacattccatcgagaactctagcgtcaatgtttccctcaccgctattgccaaccaagctacggtgctgatggggctgggaaaaggctggcctctcagcaagatggatatcggggtgccccttctggccattggatgttactctcaggtcaatcctatcaccctgacagctgccctcctgcttctggtggcgcactacgccatcattggccccggcctccaggctaaggccacccgggaagctcagaaacgcgccgccgcggggatcatgaagaaccctacagttgacggaattaccgtgatcgatctggagccgattccctatgaccctaaattcgaaaagcaactgggccaggtcatgctccttatcctgtgcgtgacgcaggtcctgatgatgagaacaacctgggctctctgtgaggccctgacacttgctaccgggcccatctccaccctgtgggagggaaatcctggccggttttggaacacaacgattgccgtgagcatggccaatatcttccgcgggtcttacctcgctggagccggcctgctgttttccattatgaaaaacaccacaaataccagacggggcacagggaacatcggagaaaccctcggcgagaagtggaagtccagacttaatgcgctggggaaatctgagttccagatttataagaaaagcggaatccaagaggttgatcgcacgctggccaaggagggcatcaaaagaggggaaacagaccatcacgctgtgtccagaggatctgccaagctccgctggtttgtcgagcggaacatggtgacccccgaaggcaaagttgtggatctgggctgcgggagaggaggctggagctactattgtgggggacttaagaacgtccgcgaggtgaagggcctgaccaaagggggaccgggccatgaagaacctattcccatgtccacatacggctggaatctcgtgcggctgcagagcggggttgacgtcttcttcacaccccctgagaagtgcgatacactgctctgtgacatcggagaatcctctcccaaccctacgattgaggctggcagaacccttcgcgtgctgaatctggtggaaaactggctcaataacaatacacagttttgcatcaaagtcctgaacccgtatatgcccagcgttattgagaagatggaaacccttcaacggaaatacgggggagccctggtgagaaatcctctctcccgcaactctacacacgagatgtactgggtgagcaatgcgaccggcaacatcgtctcctctgtgaatatgatcagccggatgctgattaacagattcacgatgaagcacaagaaagccacctatgagcccgatgttgacctggggtccggaacacgcaatatcggcattgaaagcgagatccctaacctcgacattatcggcaagagaattgagaagatcaagcaggagcatgaaacctcttggcactacgatcaggaccatccctataaaacatgggcttaccacgggtcctatgagaccaagcagacaggaagcgcctcttccatggtgaacggcgtcgtgcggcttctgaccaagccgtgggatgttgtgcctatggtcacgcaaatggctatgacagacaccaccccctttgggcagcagcgcgtgttcaaagagaaggtggatacaagaacgcaggaacctaaagagggaaccaagaaactgatgaagatcacagccgaatggctctggaaggagctgggcaaaaagaaaacaccccggatgtgtacaagagaggaatttacccggaaggtccgcagcaatgctgcccttggggcgattttcacagacgagaacaaatggaagtctgccagagaagctgttgaggattcccggttttgggaactgatcgaccgcgagagaaatctccacctggagggaaaatgcgaaacctgtgtgtacaacatgatgggcaagcgggagaagaaactgggcgagttcgggaaggccaaaggaagccgcgctatttggtatatgtggctcggcgccagatttctggagttcgaagcccttgggtttctgaatgaggatcattggttctcccggggaaacagcctctctggcgtggagggggaaggcctgcaccgccttggatacatcctgagagacgtcagcaagaaagagggcggggcgatgtacgctgatgacacggccggatgggacacccggattacactcgaagatctgaagaatgaggaaatggtgaccaaccatatgaagggcgagcacaaaaagctggccgaggctatctttaaactcacatatcaaaataaggttgtgcgcgtccagagacctacaccccgggggacggtgatggacatcatttcccgcagagatcagcggggatctggccaggttgggacatacggcctgaacaccttcacaaatatggaagcccaacttatcagacagatggagggagaaggcattttcaaaagcatccagcatctgaccgtgacggaggagattgctgtccaaaactggctcgcccgcgtggggcgggaaagactgtcccgcatggcgatctctggagacgattgcgttgtgaagccgcttgacgatcggtttgccagcgctctgaccgccctcaatgacatgggcaaggtcagaaaagatatccagcagtgggagccttcccgcgggtggaacgactggacacaggtgcccttctgctctcaccactttcatgaaattgtcatgaaggatggacgggtgctggttgtgccctgtagaaatcaagacgagctgatcggccgcgctcggattagccagggggccggctggtccctcaaagaaaccgcgtgcctgggaaagagctatgcccagatgtggacacttatgtacttccacagacgcgatctgcggctcgctgccaacgctatctgttctgccgtcccttcccattgggtgccgaccagcagaacaacctggtctattcacgctaaacacgagtggatgacgacagaggacatgctggccgtgtggaaccgggtttggatccaggaaaatccctggatggaggacaagacccctgtggaatcctgggaggaagtcccctatcttggcaagagagaggatcaatggtgcgggagcctgattggactcacctcccgcgcgacatgggccaaaaacatccagaccgctatcaatcaggtgcggtctctgattggcaacgaggaatacacagactatatgcctagcatgaagagatttcgcagagaggaagaggaagccggggttctgtggtga

SEQ ID NO: 19925 - RNA, 9876 nt, synthetic construct
  misc_feature 1..9876: note = derived and/or modified CDS sequence (opt5) from DENV-2__EU482588__SS-prME
  source 1..9876: mol_type = other RNA
accgccggcgtgatcattatgctgatccccaccgctatggccttccacctcacgacccggaacggggagcctcatatgattgttggacggcaggaaaagggcaagtccctgctttttaagaccgaggacggggttaatatgtgcaccctgatggcgatcgatctcggagaactgtgtgaggacaccattacctacaagtgcccgcttctgcgccaaaacgaacccgaggatatcgactgttggtgcaattccacgtctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaaggtgcccttcgaaattatggatctggagaaacgccatgttctgggccggctcatcaccgtgaaccctattgtcacagaaaaggacagcccggtgaacatcgaggccgaacccccttttggggattcttacattatcattggcgttgagcccggacagctgaaacttaattggttcaagaagggctccagcatcgggcagatgtttgagaccacaatgagaggagctaaacgcatggccatcctgggcgacaccgcctgggatttcgggtctctcggaggcgtgtttacgagcattgggaaggctctgcaccaagtcttcggcgccatctacggagcggctttttccggcgtgtcttggacaatgaaaattctgatcggggtgattatcacctggatcggaatgaacagccggtccaccagcctttctgtttccctcgtcctggtgggcgtggtcacactgtatctcggggccatggtgcaggccgacagcggatgtgttgtgtcttggaagtccaaagaactgaagtgcggcagcgggattttcgtcaccgataatgtgcacacatggacggagcagtacaagtttcagcctgaatccccctctaaacttgctagcgccatccaaaaggctcatgaggaaggcatttgtggaatcagatccgttacccgcctggagaacctcatgtggaaacagattacaccggagctgaatcacatcctgtctgaaaacgaggtgaaacttaccatcatgacaggcgacattaaagggatcatgcaggccggaaagcggagcctcagacctcagcccaccgaactgaaatattcctggaagacgtggggcaaggcgaaaatgctgagcaccgagtctcataatcaaacattcctcattgatgggcctgaaaccgccgagtgccccaacacaaatcgcgcttggaactccctggaggtcgaagactacggatttggcgtgttcaccacaaatatctggcttaagctgcgggagaaacaggacgtcttttgtgatagcaagctcatgtctgccgctattaaagacaacagagccgtgcacgcggatatgggctattggatcgaatccgccctgaatgacacctggaagatggagaaggctagcttcatcgaggtcaaatcttgccactggcctaagagccatacgctgtggtccaacggggtgcttgaaagcgagatgattatccccaaaaatttcgccggaccggtgtctcagcacaactaccgccctggctatcatacacagaccgctgggccctggcacctcggaaagctggaaatggattttgacttctgtgagggcaccacagtcgttgtgaccgaagattgcgggaaccggggaccctccctgagaacgacaaccgccagcggcaaactcattacagagtggtgctgtcggtcctgcaccctgcctccgcttcgctacagaggcgaggacgggtgttggtacggaatggaaatccggcccctgaaggagaaggaagagaatctcgtgaactctctggtcacagccggccatgggcaaattgataattttagcctgggagtgcttggcatggctctcttcctggaagagatgctgagaacccgcgttgggacgaaacacgcgatcctcctggtggccgtctcctttgtgacccttattacaggaaacatgtctttccgggacctgggcagagttatggtgatggtcggcgctaccatgacagatgacatcgggatgggagtgacctatctcgccctgctggccgcttttaaggttcgccctacgttcgccgcgggccttctgctcagaaaactgacaagcaaggagctcatgatggctaccatcgggattgccctgctttcccagtctacaatccccgaaaccattctggagctcaccgatgccctggctctgggaatgatggtgcttaaaatcgtccggaatatggaaaagtaccagctggccgtgacaattatggcgatcagctgcgtgcctaacgctgtcatcctccaaaatgcctggaaggtttcctgtacgattctggccgctgtgagcgtgtctcccctcctgcttacctccagccagcagaaagccgactggatccctctggctctcacaattaagggcctgaaccccaccgccatctttctgacaaccctttctcgcacgtccaaaaagagaagctggccgctgaatgaggcgattatggccgtcgggatggtgtctatcctcgcttccagcctgctcaaaaacgacatccctatgacaggacccctggttgccggcggccttctgaccgtgtgctatgtcctgaccgggcggtccgctgatctcgaactggagcgcgccgccgacgtgaagtgggaggatcaggctgaaattagcggatctagccctatcctttccattacaatctctgaggacggcagcatgtccattaaaaatgaagaggaggaacaaaccctgacaatcctcattagaacggggctgctcgttatctctggagtgttccccgtcagcatcccgattaccgcggccgcttggtacctgtgggaggtgaagaagcagcgggccggcgtcctttgggatgtgccttctccccctcccgttgggaaagccgaactggaggacggagcttatcgcatcaagcagagaggcattctgggctacagccagatcggggccggagtgtataaagaaggcacatttcacaccatgtggcatgtcacaagaggggcggtgctcatgcaccgcggaaagagaattgagcccagctgggctgatgttaaaaaggacctgatctcctacggcgggggatggaaacttgagggcgaatggaaagagggcgaagaggtgcaagtcctggccctcgaacctgggaagaacccgcgggccgtgcagaccaaacccggactgttcaagacgaataccggcacaatcggggctgtgagcctcgatttttctcctggaacctccggcagccccattgttgacagaaaagggaaggtcgtgggactgtacggcaacggcgtggtcacacgctctggggcctatgtgtccgcgatcgctcagaccgaaaagagcattgaggataatcctgaaatcgaggacgatattttccggaaaaagagacttacaatcatggacctgcatcccggagccggcaaaacgaagcgctacctgcctgccatcgttcgggaagctattaaaagagggctccgcaccctgatccttgccccgacacgggtggtcgctgccgagatggaagaggcgctgagaggactccccattcgctatcagacccctgccatccgggctgagcacaccggcagagaaattgtggacctgatgtgtcatgccacattcacgatgcggctcctgtcccccgttcgcgtgcctaactacaaccttatcattatggatgaggctcactttaccgaccccgcctctatcgccgctagagggtatatcagcacacgggtcgaaatgggcgaggcggccggaattttcatgaccgctacaccgcctggctcccgcgatccctttccccaaagcaatgcccctatcatggacgaggaaagagagattcccgaacggtcttggaactccgggcacgagtgggtgaccgatttcaagggaaagacggtttggtttgtgcctagcatcaaagccggcaatgacattgctgcctgcctgagaaagaacgggaaaaaggtcatccagctgtctcgcaaaacattcgatagcgaatacgtgaagacccgggcgaatgactgggattttgtggtcaccacagacatctccgagatgggagctaacttcaaggccgagagagttattgatccgcgccggtgtatgaaacccgtgatcctcaccgacggcgaagagagagtgattctggccgggcctatgcccgtcacacattctagcgctgcccagcgccggggcagaatcggacgcaatcctaagaacgaaaatgaccaatatatttacatgggcgagccccttgaaaacgatgaggactgcgcgcactggaaagaggccaagatgctgctcgataatatcaacaccccggaagggatcattccttccatgtttgagcccgaaagagagaaagtggacgctatcgatggagaataccggctgcgcggcgaggccagaaagacgttcgttgacctgatgcggcgcggggatctccctgtgtggcttgcttatagagtcgccgctgagggaattaattacgccgaccggagatggtgttttgatggcatcaaaaacaatcagattctggaagagaacgtggaagttgagatctggacaaaggagggggaacgcaagaaactgaagccccggtggctcgacgcgagaatttattctgatcctctggcccttaaagagttcaaggagttcgctgccggccgcaaaagcctgaccctcaacctgatcacagagatgggacggctgcccacctttatgacgcagaaggctagagacgccctcgataatcttgccgtgctgcataccgctgaagcgggcgggcgggcctacaaccacgctctgtccgagctcccggagacactggaaacccttctgctcctgacactgctcgccaccgtcacaggaggcatcttcctttttctgatgagcgggaagggaattggcaaaatgaccctgggcatgtgctgcatcattacggcctctatcctcctgtggtatgctcagattcaacctcactggatcgccgcgtccatcattcttgagttctttctgatcgtgctcctgattcccgaacccgagaagcagcgcacacctcaggacaatcagctgacctacgtcgtgatcgccattctcaccgttgtggctgccacaatggctaacgaaatggggttccttgagaaaaccaagaaagacctgggactgggcagcatcacaacgcaagagtccgaatctaatatcctcgatattgacctgagaccggccagcgcgtggaccctttatgccgtggctacaacctttgtcacacccatgctgcggcattccatcgagaactctagcgttaatgtgtccctcaccgccattgctaaccaggccacggtgctgatggggctgggaaagggctggcctctcagcaagatggatatcggggtcccccttctggctattggatgttactctcaggtgaatcctatcaccctgacagccgcgctcctgcttctggttgcccactacgctattatcggccccggcctccaggccaaagctacccgcgaagcccaaaagagagccgcggctgggatcatgaaaaaccctacagtggacggaattaccgtcatcgatctggagccgattccctatgaccctaagttcgaaaaacagctgggccaggtgatgctccttatcctgtgcgtcacacaggtgctgatgatgcggacaacctgggccctctgtgaggctctgacacttgccaccgggcccatttccaccctgtgggagggaaatcctggccgcttttggaacacaacgatcgccgttagcatggctaatatcttcagagggtcttacctcgccggagcgggcctgctgttttccattatgaagaacaccacaaatacccggcgcggcacagggaacatcggagaaaccctcggcgagaagtggaaaagcagacttaatgccctggggaagtctgagttccaaatttataaaaagagcggaatccaggaggtggatcggacgctggctaaagagggcattaagagaggggaaacagaccatcacgccgtctcccgcggatctgctaaactccggtggtttgtggagagaaacatggttacccccgaaggcaaggtggtcgatctgggctgcgggcgcggaggctggagctactattgtgggggacttaagaacgtgcgggaggtgaaaggcctgaccaaagggggaccgggccatgaagaacctatccccatgtccacatacggctggaatctcgttagactgcagagcggggtcgacgtgttcttcacaccccctgagaaatgcgatacactgctctgtgacatcggagaatcctctcccaaccctacgattgaggccggccgcacccttcgggtgctgaatctggtcgaaaactggctcaataacaatacacaattttgcatcaaggttctgaacccgtatatgcccagcgtgattgagaaaatggaaacccttcagagaaagtacgggggagcgctggtgcgcaatcctctctcccggaactctacacacgagatgtactgggtcagcaatgccaccggcaacatcgtgtcctctgttaatatgattagcagaatgctgatcaaccgcttcacgatgaagcacaaaaaggctacctatgagcccgatgtggacctggggtccggaacacggaatatcggcattgaaagcgagatccctaacctcgacattatcggcaaaagaattgaaaagatcaaacaggagcatgaaacctcttggcactacgatcaggaccatccctataagacatgggcctaccacgggtcctatgagaccaagcaaacaggaagcgcttcttccatggtcaacggcgtggttcgccttctgaccaaaccgtgggatgtggtccctatggtgacgcagatggccatgacagacaccaccccctttgggcagcagagagtgttcaaggagaaagtcgatacacggacgcaagaacctaaggagggaaccaaaaagctgatgaagattacagctgaatggctctggaaagagctgggcaagaaaaagacaccccgcatgtgtacaagagaggaatttacccggaaagttagaagcaatgccgcgcttggggccatcttcacagacgagaacaagtggaaatctgctcgggaagccgtggaggattcccgcttttgggaactgatcgacagagagcggaatctccacctggagggaaagtgcgaaacctgtgtgtacaacatgatgggcaagcgcgagaaaaagctgggcgagttcgggaaagctaagggaagcagagccatttggtatatgtggctcggcgcccggtttctggagttcgaagcgcttgggtttctgaatgaggatcattggttctcccgcggaaacagcctctctggcgtcgagggggaaggcctgcacagacttggatacatcctgcgggacgtgagcaaaaaggagggcggggctatgtacgccgatgacacggccggatgggacacccgcattacactcgaagatctgaagaatgaggaaatggttaccaaccatatgaaaggcgagcacaagaaactggctgaggccatctttaagctcacatatcagaataaagtggtcagagtgcagcggcctacaccccgcgggacggttatggacattatctccagacgggatcagcgcggatctggccaagtggggacatacggcctgaacaccttcacaaatatggaagctcagcttatcagacagatggagggagaaggcattttcaagagcatccaacatctgaccgtcacggaggagattgccgtgcagaactggctcgcgcgggttgggagagaacgcctgtcccggatggccatctctggagacgattgcgtggtcaagccgcttgacgatagatttgctagcgccctgaccgctctcaatgacatgggcaaagtgcgcaaggatattcagcagtgggagccttcccgggggtggaacgactggacacaagtccccttctgctctcaccactttcatgaactggtgatgaaagatggaagagttctggtggtcccctgtcgcaatcaggacgagctcatcggccgggccagaatcagccagggggcgggctggtccctgaaggaaaccgcctgccttggaaaaagctatgctcagatgtggacactgatgtacttccaccgccgggatctcagactggccgctaacgccatttgttctgctgtgccttcccattgggtgccgaccagccgcacaacctggtctatccacgccaagcacgagtggatgacgacagaggacatgcttgcggtttggaaccgggtgtggattcaagaaaatccctggatggaggacaagacccctgtcgaatcctgggaggaagtgccctatctgggcaaaagagaggatcagtggtgcgggagcctcatcggactgacctcccgggccacatgggctaagaacattcagaccgccatcaatcaggttagatctctgattggcaacgaggaatacacagactatatgcctagcatgaaacgctttcggagagaggaagaggaagccggggtgctctggtga

SEQ ID NO: 19926 - RNA, 9876 nt, synthetic construct
  misc_feature 1..9876: note = derived and/or modified CDS sequence (opt5) from DENV-2__EU569705__SS-prME
  source 1..9876: mol_type = other RNA
accgcgggcgtgatcattatgctgatccccaccgctatggccttccacctcacgacccggaacggggagcctcatatgattgtcggacggcaggaaaagggcaagtccctgctttttaagaccgaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggccctcttcctggaagagatgctgagaacacgcgtcgggaccaaacacgccatgctcctggtggctgtttcctttgtgacgcttatcaccggaaacatgtctttccgggacctgggcagagtcatggtgatggttggcgccacaatgaccgatgacatcgggatgggaattacatatctcgccctgctggctgcctttaaggtgcgccctaccttcgcggctggccttctgctcagaaaactgacgagcaaggagctcatgatggccacaatcgggattgccctgctttcccagtctaccatccccgaaacaattctggagctcaccgatgctctggccctgggaatgatggtccttaaaatcgtgcggaatatggaaaagtaccagctggcggttaccatcatggctattagctgcgtgcctaacgccgtcatcctccaaaatgcctggaaggtgtcctgtacaattctggctgccgtgagcgtctctcccctcctgcttacgtccagccagcagaaagctgactggatccctctggccctcaccattaagggcctgaaccccacagcgatctttctgaccacactttctcgcacctccaaaaagagaagctggccgctgaatgaggccatcatggctgttgggatggtgtctattctcgcctccagcctgctcaaaaacgacatccctatgacgggacccctggtggctggcggccttctgacagtctgctatgtgctgaccgggcggtccgccgatctcgaactggagcgcgccgctgacgttaagtgggaggatcaggcggaaattagcggatctagccctatcctttccattaccatctctgaggacggcagcatgtccattaaaaatgaagaggaggaacaaacactgaccatcctcatcagaacagggctgctcgtgatttctggagtcttccccgtgagcatcccgattacggccgctgcctggtacctgtgggaggttaagaagcagcgggccggcgtgctttgggatgtcccttctccccctcccgtggggaaagctgaactggaggacggagcctatcgcatcaagcagagaggcattctgggctacagccagatcggggcgggagtctataaagaaggcacctttcacacaatgtggcatgtgaccagaggggctgttctcatgcaccgcggaaagagaatcgagcccagctgggccgatgtgaaaaaggacctgatttcctacggcgggggatggaaacttgagggcgaatggaaagagggcgaagaggtccaagtgctggccctcgaacctgggaagaacccgcgggctgttcagacaaaacccggactgttcaagaccaatacgggcaccatcggggccgtgagcctcgatttttctcctggaacatccggcagccccattgtcgacagaaaagggaaggtggtgggactgtacggcaacggcgttgtcacccgctctggggcgtatgtgtccgctatcgcccagacagaaaagagcattgaggataatcctgaaatcgaggacgatatcttccggaaaaagagacttaccattatggacctgcatcccggagccggcaaaacaaagcgctacctgcctgctatcgtgcgggaagccattaaaagagggctccgcacgctgatccttgctccgacccgggtcgtggccgcggagatggaagaggccctgagaggactccccattcgctatcagacccctgctatccgggccgagcacaccggcagagaaattgttgacctgatgtgtcatgctaccttcacaatgcggctcctgtcccccgtgcgcgtccctaactacaaccttatcatcatggatgaggcccactttacggaccccgcctctattgctgcgagagggtatatcagcacccgggtggaaatgggcgaggccgctggaattttcatgacagccaccccgcctggctcccgcgatccctttccccaaagcaatgcccctatcatggacgaggaaagagagattcccgaacggtcttggaactccgggcacgagtgggttacagatttcaagggaaagaccgtgtggtttgtccctagcatcaaagctggcaatgacatcgccgcgtgcctgagaaagaacgggaaaaaggtgattcagctgtctcgcaaaacgttcgatagcgaatacgttaagacacgggctaatgactgggattttgtggtcaccaccgacatctccgagatgggagccaacttcaaggccgagagagtgattgatccgcgccggtgtatgaaacccgtgatcctcacagacggcgaagagagagtcattctggctgggcctatgcccgttacccattctagcgccgcgcagcgccggggcagaatcggacgcaatcctaagaacgaaaatgaccaatatatctacatgggcgagccccttgaaaacgatgaggactgcgcccactggaaagaggctaagatgctgctcgataatattaacacaccggaagggatcattccttccatgtttgagcccgaaagagagaaagtggacgccatcgatggagaataccggctgcgcggcgaggctagaaagaccttcgtggacctgatgcggcgcggggatctccctgtctggcttgcctatagagtggctgccgagggaattaattacgcggaccggagatggtgttttgatggcatcaaaaacaatcagattctggaagagaacgttgaagtggagatctggacgaaggagggggaacgcaagaaactgaagccccggtggctcgacgccagaatctattctgatcctctggctcttaaagagttcaaggagttcgccgctggccgcaaaagcctgacactcaacctgattaccgagatgggacggctgcccacatttatgacccagaaggccagagacgccctcgataatcttgctgtcctgcatacggcggaagccggcgggcgggcttacaaccacgccctgtccgagctcccggagaccctggaaacacttctgctcctgaccctgctcgccacagtgaccggaggcatcttcctttttctgatgagcgggaagggaattggcaaaatgacactgggcatgtgctgcatcattaccgcttctatcctcctgtggtatgcccagatccaacctcactggattgcggcctccatcattcttgagttctttctgatcgttctcctgattcccgaacccgagaagcagcgcacgcctcaggacaatcagctgacatacgtggtcatcgctatcctcaccgtggtcgccgctaccatggccaacgaaatggggttccttgagaaaacaaagaaagacctgggactgggcagcattgcgacccaagagtccgaatctaatatcctcgatattgacctgagaccggccagcgcttggacactttatgccgtggctacgacctttgttacacccatgctgcggcattccatcgagaactctagcgtgaatgtgtccctcaccgccattgctaaccaggccacagtcctgatggggctgggaaagggctggcctctcagcaagatggatatcggggttccccttctggcgattggatgttactctcaggtgaatcctatcaccctgacggccgctctcctgcttctggtggcccactacgctatcattggccccggcctccaggccaaagccacccgcgaagcgcaaaagagagctgccgctgggatcatgaaaaaccctacagtcgacggaattaccgtgatcgatctggagccgattccctatgaccctaagttcgaaaaacagctgggccaggttatgctccttatcctgtgcgtgacacaggtcctgatgatgcggaccacgtgggccctctgtgaggccctgacacttgctaccgggcccatctccacactgtgggagggaaatcctggccgcttttggaacaccaccattgccgtgagcatggcgaatatcttcagagggtcttacctcgccggagctggcctgctgttttccattatgaagaacacaacgaatacccggcgcggcacagggaacatcggagaaaccctcggcgagaagtggaaaagcagacttaatgccctggggaagtctgagttccaaatttataaaaagagcggaatccaggaggtcgatcggacactggctaaagagggcatcaagagaggggaaaccgaccatcacgccgtgtcccgcggatctgcgaaactccggtggtttgttgagagaaacatggtgacgcccgaaggcaaggtcgtggatctgggctgcgggcgcggaggctggagctactattgtgggggacttaagaacgttcgggaggtgaaaggcctgacaaaagggggaccgggccatgaagaacctattcccatgtccacctacggctggaatctcgtcagactgcagagcggggtggacgtgttcttcacaccccctgagaaatgcgatacactgctctgtgacatcggagaatcctctcccaaccctaccattgaggccggccgcacacttcgggttctgaatctggtcgaaaactggctcaataacaatacgcaattttgcatcaaggtgctgaacccgtatatgcccagcgtgattgagaaaatggaaacccttcagagaaagtacgggggagctctggtccgcaatcctctctcccggaactctacacacgagatgtactgggttagcaatgccaccggcaacatcgtgtcctctgtgaatatgatcagcagaatgctgattaaccgcttcacaatgaagcacaaaaaggctacctatgagcccgatgtcgacctggggtccggaacgcggaatatcgtgattgaaagcgagatccctaacctcgacattatcggcaaaagaattgaaaagatcaaacaggagcatgaaacctcttggcactacgatcaggaccatccctataagacatgggcctaccacggctcctatgagaccaagcaaacagggagcgcttcttccatggttaacggagtggtccgccttctgaccaaaccgtgggatgtggttcctatggtgacacagatggccatgaccgacacgacaccctttggccagcagagagtcttcaaggagaaagtggatacccggacccaagaacctaaggaggggaccaagaagctgatgaagatcacggcggaatggctctggaaagagctgggaaagaaaaagacaccccgcatgtgtacaagagaggaatttacccggaaagtgagaagcaatgccgctcttggcgccattttcacagacgagaacaagtggaaatctgctcgggaagccgtcgaggattcccgcttttgggaactgatcgacagagagcggaatctccacctggaggggaagtgcgaaacctgtgtttacaacatgatgggaaagcgcgagaaaaagctgggcgagttcggcaaagccaaggggagcagagcgatttggtatatgtggctcggagctcggtttctggagttcgaagcccttggctttctgaatgaggatcattggttctcccgcgggaacagcctctctggagtggagggcgaagggctgcacagacttggctacatcctgcgggacgtgagcaaaaaggagggaggcgccatgtacgctgatgacacagccgggtgggacacccgcattacgctcgaagatctgaagaatgaggaaatggtcaccaaccatatgaaaggagagcacaagaaactggctgaggccatctttaagctcacatatcagaataaagtggttagagtgcagcggcctacaccccgcggcacagtcatggacatcatttccagacgggatcagcgcgggtctggacaagtgggcacctacgggctgaacacgttcacaaatatggaagcgcagcttatcagacagatggagggcgaaggaattttcaagagcatccaacatctgaccgttacagaggagattgccgtgcagaactggctcgctcgggtcggcagagaacgcctgtcccggatggccatctctggggacgattgcgtggttaagccgcttgacgatagatttgctagcgccctgaccgcgctcaatgacatgggaaaagtgcgcaaggatatccagcagtgggagccttcccggggctggaacgactggacgcaagtccccttctgctctcaccactttcatgaactggtgatgaaagatgggagagtcctggtggttccctgtcgcaatcaggacgagctcattggacgggccagaatcagccagggcgctgggtggtccctgaaggaaaccgcctgccttggcaaaagctatgctcagatgtggacactgatgtacttccaccgccgggatctcagactggccgctaacgccatttgttctgcggtgccttcccattgggtcccgaccagccgcacaacctggtctatccacgccaagcacgagtggatgacaaccgaggacatgcttgctgtgtggaaccgggtgtggattcaagaaaatccctggatggaggacaagacgcctgttgaatcctgggaggaagtgccctatctgggaaaaagagaggatcagtggtgcggcagcctcatcgggctgacatcccgggccacctgggccaagaacattcagaccgctatcaatcaggtcagatctctgatcggaaacgaggaatacacagactatatgcctagcatgaaacgctttcggagagaggaagaggaagccggcgtgctctggtga

SEQ ID NO: 19927 - RNA, 9876 nt, synthetic construct
  misc_feature 1..9876: note = derived and/or modified CDS sequence (opt5) from DENV-2__EU482589__SS-prME
  source 1..9876: mol_type = other RNA
acagccggagtgatcattatgctgatccccacagctatggccttccacctcacgacccggaacggggagcctcatatgattgtcggacggcaggaaaagggcaagtccctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggatgggcctggatttcaacgaaatggttctcctgcagatggaggacaaggcttggcttgtgcaccgccaatggtttctggatctcccgctgccttggctgcccggggccgacacccagggatctaattggatccagaaggagacactcgtcaccttcaagaaccctcatgctaaaaagcaggacgtggttgtgctgggctcccaagaaggggccatgcacacggcccttacaggcgctaccgagattcagatgagctccggaaatctgctctttacaggccatctgaaatgcagacttcggatggataagctgcagctcaaagggatgtcttacagcatgtgtaccggaaagttcaagatcgtcaaagaaattgcggagacccaacacggcacaatcgtgatcagagtccagtatgagggggacggatccccctgcaagattcccttcgaaatcatggatctggagaaacgccatgtgctgggccggctcattacggttaaccctatcgtgaccgaaaaggacagcccggtcaacattgaggccgaacccccttttggggattcttacatcattatcggcgtggagcccggacagctgaaacttaattggttcaagaagggctccagcatcgggcagatgtttgagacaaccatgagaggagctaaacgcatggccattctgggcgacacagcctgggatttcgggtctctcggaggcgtttttaccagcatcgggaaggctctgcaccaagtgttcggcgccatttacggagcggctttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggccgacagcggatgtgtggtttcttggaagtccaaagaactgaagtgcggcagcgggatcttcattacagataatgtgcacacctggacagagcagtacaagtttcagcctgaatccccctctaaacttgctagcgccatccaaaaggctcatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggccggaaagcggagcctcagacctcagcccacagaactgaaatattcctggaagacctggggcaaggcgaaaatgctgagcacggagtctcataatcaaaccttcctcattgatgggcctgaaacagccgagtgccccaacaccaatcgcgcttggaactccctggaggttgaagactacggatttggcgtgttcacaaccaatatctggcttaagctgcgggagaaacaggacgtcttttgtgatagcaagctcatgtctgccgctatcaaagacaacagagccgtgcacgcggatatgggctattggattgaatccgccctgaatgacacatggaagatggagaaggctagcttcatcgaggttaaatcttgccactggcctaagagccataccctgtggtccaacggggtgcttgaaagcgagatgattatccccaaaaatctcgccggaccggtctctcagcacaactaccgccctggctatcatacgcagacagctgggccctggcacctgggaaagctggaaatggatttcgacttttgtgagggcaccaccgtggtggtcacagaagattgcgggaaccggggaccctccctcagaaccacgacagccagcggcaaactggttaccgagtggtgctgtcggtcctgcacacttcctccgctgcgctacagaggcgaggacgggtgttggtacggaatggaaattcggcccctcaaggagaaggaagagaatctggtgaactctctggtgaccgccggccatgggcaaatcgataatttcagccttggagtcctcggcatggctctgtttctggaagagatgctcagaacacgcgtggggaccaaacacgcgattctgcttgttgccgtgtccttcgtcacgctgatcaccggaaacatgtcttttcgggacctcggcagagtgatggttatggtgggcgctacaatgaccgatgacatcgggatgggagtcacatatctggccctgcttgccgctttcaaggtgcgccctacctttgccgcgggcctgctcctgagaaaactcacgagcaaggagctgatgatggctacaattgggatcgcccttctgtcccagtctaccattcccgaaacaatcctcgagctgaccgatgccctggctcttggaatgatggttctgaaaattgtgcggaatatggaaaagtaccagctcgccgtcaccatcatggcgatcagctgcgtgcctaacgctgtgattctgcaaaatgcctggaaggtctcctgtacaatcctcgccgctgttagcgtgtctcccctgcttctgacgtccagccagcagaaagccgactggattcctctcgctctgaccatcaagggcctgaaccccacagccattttccttaccacactgtctcgcacctccaaaaagagaagctggccgctcaatgaggcgatcatggccgtggggatggtctctatcctggcttccagcctcctgaaaaacgacattcctatgacgggaccccttgtggccggcggcctgctgacagtttgctatgtgctcaccgggcggtccgctgatctggaacttgagcgcgccgccgacgtcaagtgggaggatcaggctgaaatcagcggatctagccctattctgtccatcaccatttctgaggacggcagcatgtccatcaaaaatgaagaggaggaacaaacactcaccattctgatcagaacagggctcctggtgatctctggagtttttcccgtgagcattccgatcacggcggccgcttggtacctttgggaggtcaagaagcagcgggccggcgtgctgtgggatgtcccttctccccctcccgtggggaaagccgaactggaggacggagcttatcgcattaagcagagaggcatcctcggctacagccagattggggccggagtttataaagaaggcaccttccacacaatgtggcatgtgaccagaggggcggtcctgatgcaccgcggaaagagaatcgagcccagctgggctgatgtgaaaaaggaccttatctcctacggcgggggatggaagctggagggcgaatggaaagagggcgaagaggttcaagtgctcgccctggaacctgggaagaacccgcgggccgtccagacaaaacccggactctttaagaccaatacgggcaccattggggctgtgagcctggatttctctcctggaacatccggcagccccatcgtggacagaaaagggaaggttgtcggactttacggcaacggcgtggtgacccgctctggggcctatgtctccgcgattgctcagacagaaaagagcatcgaggataatcctgaaattgaggacgatatctttcggaaaaagagactgaccatcatggacctgcatcccggagccggcaaaacaaagcgctacctccctgccattgtgcgggaagctatcaaaagagggctgcgcacgcttattctggccccgacccgggttgtggctgccgagatggaagaggcgctcagaggactgcccatccgctatcagacccctgccattcgggctgagcacaccggcagagaaatcgtcgacctcatgtgtcatgccaccttcacaatgcggctgctttcccccgtgcgcgttcctaactacaacctgattatcatggatgaggctcacttcacggaccccgcctctatcgccgctagagggtatattagcacccgggtggaaatgggcgaggcggccggaatctttatgacagctaccccgcctggctcccgcgatcccttcccccaaagcaatgcccctattatggacgaggaaagagagatccccgaacggtcttggaactccgggcacgagtgggtcacagattttaagggaaagaccgtgtggttcgttcctagcattaaagccggcaatgacatcgctgcctgcctgagaaagaacgggaaaaaggtgatccagctctctcgcaaaacgtttgatagcgaatacgtcaagacacgggcgaatgactgggatttcgtggtgaccaccgacatttccgagatgggagctaactttaaggccgagagagtcatcgatccgcgccggtgtatgaaacccgttattctgacagacggcgaagagagagtgatccttgccgggcctatgcccgtgacccattctagcgctgcccagcgccggggcagaattggacgcaatcctaagaacgaaaatgaccaatatatctacatgggcgagcccctggaaaacgatgaggactgcgcgcactggaaagaggccaagatgctcctggataatatcaacacaccggaagggattatcccttccatgttcgagcccgaaagagagaaagtcgacgctattgatggagaataccggctgcgcggcgaggccagaaagacctttgtggacctcatgcggcgcggggatcttcctgtttggctggcttatagagtggccgctgagggaatcaattacgccgaccggagatggtgtttcgatggcattaaaaacaatcagatcctggaagagaacgtcgaagtggagatttggacgaaggagggggaacgcaagaaactcaagccccggtggctggacgcgagaatctattctgatcctcttgccctgaaagagtttaaggagttcgctgccggccgcaaaagcctcacactgaacctgatcaccgagatgggacggctccccacattcatgacccagaaggctagaaatgcccttgacaacctggccgttctgcatacggctgaagcgggcgggcgggcctacaatcacgctctctccgagctgccggagacccttgaaacactgctcctgctgaccctccttgccacagtgaccggaggcatttttctgttcctgatgagcgggaagggaatcggcaaaatgacactcggcatgtgctgcattatcaccgcctctattctgctttggtatgctcagatccaacctcactggatcgccgcgtccattatcctggagtttttcctcattgtcctgctgatccccgaacccgagaagcagcgcacgcctcaggataaccagctcacatacgtggtcattgccatccttaccgtggttgctgccaccatggctaatgaaatggggtttctggagaaaacaaagaaagacctgggactcggcagcatcaccacacaagagtccgaatctaacattctggacatcgatcttagaccggccagcgcgtggacgctgtatgccgtggctaccacattcgtgacccccatgctccggcattccattgaaaattctagcgtcaacgtttccctgacagccatcgctaatcaggccaccgtgctgatggggctcggaaagggctggcctcttagcaagatggacattggggtgcccctgctggctatcggatgttactctcaggtcaaccctattacgctcaccgccgcgctgcttctgctcgtggcccactacgctatcatcggccccggcctgcaggccaaagctacacgcgaagcccaaaagagagccgcggctgggattatgaaaaatcctaccgttgatggaatcacagtgattgacctggagccgatcccctatgatcctaagtttgaaaaacagctcggccaggtcatgcttctgattctgtgcgtgacccaggtcctcatgatgcggacgacatgggccctgtgtgaggctcttaccctggccacagggcccatctccaccctctgggagggaaaccctggccgcttctggaataccacaatcgccgtgagcatggctaacatttttagagggtcttacctggccggagcgggcctcctgttctccatcatgaagaatacgaccaacacacggcgcggcaccgggaatattggagaaacacttggcgagaagtggaaaagcagactgaacgccctggggaagtctgaatttcaaatctataaaaagagcggcattcaggaggttgaccggaccctcgctaaagagggcatcaagagaggggaaacggatcatcacgccgtgtcccgcggatctgctaaactgcggtggttcgtcgagagaaacatggtgacacccgaaggcaaggttgtggaccttggctgcgggcgcggaggctggagctactattgtgggggactgaagaatgtccgggaggtgaaaggcctcaccaaagggggaccgggccatgaggagcctatccccatgtccacctacggctggaacctggtgagactgcagagcggggttgatgtctttttcacaccccctgagaaatgcgacaccctcctttgtgatattggagaatcctctcccaatcctacaatcgaggccggccgcacgctgcgggtgctgaacctcgtggaaaattggctgaacaataacacccaattctgcattaaggtccttaatccgtatatgcccagcgttatcgagaaaatggaaacactgcagagaaagtacgggggagcgctcgtgcgcaaccctctgtccagaaattctacccacgagatgtactgggtgagcaacgccacaggcaatattgtctcctctgtgaacatgatcagcagaatgctgatcaatcgctttaccatgaagcacaaaaaggctacgtatgagcccgacgttgatctcgggtccggaacccggaacattggcatcgaaagcgagattcctaaccttgacatcattggcaaaagaatcgaaaagattaaacaggagcatgaaacatcttggcactacgaccaggatcatccctataagacctgggcctaccacgggtcctatgagacaaagcaaaccggaagcgcttcttccatggtgaatggcgtcgtgcgcctgctgacaaaaccgtgggacgttgtgcctatggtcacccagatggccatgacggatacaacccccttcgggcagcagagagtgtttaaggagaaagtggacacccggacacaagaacctaaggagggaacgaaaaagctcatgaagatcaccgctgaatggctgtggaaagagcttggcaaggagaaaacaccccgcatgtgtaccagagaagagttcacacggaaggtcagaagcaacgccgcgctgggggccatctttaccgatgaaaataaatggaagtctgctcgggaggccgttgaagactcccgcttctgggagctcattgatagagagcggaacctgcacctggaaggaaaatgcgagacatgtgtgtacaatatgatgggcaagcgcgaaaagaaactcggcgagtttgggaaggctaaaggaagcagagccatctggtatatgtggctgggcgcccggttccttgaatttgaggcgctggggttcctcaacgaggaccattggttttcccgcgaaaatagcctgtctggagtggagggcgaagggcttcacagactgggctacattctccgggatgtcagcaagaaagagggaggcgctatgtacgccgacgataccgccgggtgggacacgcgcatcaccctggaagacctgaagaacgaggagatggtgacaaatcatatgaagggagaacacaaaaagctcgctgaggccattttcaaactgacctatcagaacaaggttgtgagagtccagcggcctacaccccgcggcaccgtgatggatatcatctccagacgggaccagcgcgggtctggacaagttggcacgtacgggcttaatacatttaccaacatggaagctcagctgattagacagatggagggcgagggaatcttcaaaagcattcaacatctcacagccaccgaagagatcgcggtgcagaattggctggcccgggtcggcagagaacgcctttcccggatggctatttctggggatgactgcgtggttaagccgctggatgacagattcgccagcgctctcacggccctgaacgatatgggaaaggtgcgcaaagacatccagcagtgggagccttcccggggctggaatgattggacccaagtccccttttgctctcaccacttccatgaactggtgatgaaggacgggagagtcctcgtggttccctgtcgcaaccaggatgagctgatcggacgggcgagaattagccagggcgccgggtggtcccttaaagagacagcttgcctgggcaagagctatgcccagatgtggaccctcatgtactttcaccgccgggacctgagacttgctgccaacgctatctgttctgccgtgccttcccattgggtcccgacaagccgcaccacatggtctattcacgcgaaacacgaatggatgaccacggaggatatgctggccgtgtggaatcgggtgtggatccaagaaaacccctggatggaggacaagacacctgttgaatcctgggaggaggtgccctatctcggaaagagagaagaccagtggtgcggcagcctgattgggctgacctcccgggctacctgggccaaaaatatccagacagccattaaccaggtcagatctctcatcggaaatgaggaatacaccgattatatgcctagcatgaagcgcttccggagagaggaagaggaggctggcgtgctgtggtga

SEQ ID NO: 19928 - RNA, 9876 nt, synthetic construct
  misc_feature 1..9876: note = derived and/or modified CDS sequence (opt5) from DENV-2__EU569706__SS-prME
  source 1..9876: mol_type = other RNA
accgccggagtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaagtattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttgccgaaaaggacagcccggtgaacatcgaggctgaacccccttttggggattcttacattatcatcggcgtcgagcccggacagctgaaacttaattggttcaagaagggctccagcattgggcagatgtttgagacaaccatgagaggagccaaacgcatggccatcctgggcgacacagcttgggatttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggtgatggtccaggccgacagcggatgtgtggtttcttggaagaataaagaactgaagtgcggctccgggattttcatcacagataacgtgcacacctggacagagcagtacaagtttcagcctgaaagcccctccaaacttgcttctgccattcaaaaggctcatgaggaaggcatctgtggaatcagaagcgtcacgcgcctggagaatctcatgtggaaacagattaccccggagctgaaccacatcctgtccgaaaatgaggtgaaacttacaattatgaccggcgacatcaaagggattatgcaggccggaaagcggtctctcagacctcagcccacagaactgaaatatagctggaagacctggggcaaggcgaaaatgctgtccacggagagccataaccaaaccttcctcatcgatgggcctgaaacagccgagtgccccaataccaaccgcgcttggaactctctggaggttgaagactacggatttggcgtgttctccacaaacatctggcttaagctgcgggagaaacaggacgtcttttgtgatagcaagctcatgtctgccgctattaaagacaatagagccgtgcacgcggatatgggctattggatcgaatccgccctgaacgacacctggaagatggagaaggctagcttcattgaggttaaatcttgccactggcctaagagccatacactgtggtccaatggggtgcttgaaagcgagatgatcattcccaaaaacttcgccggaccggtctctcagcacaactaccgccctggctatcatacccagacggctgggccctggcacctcggaaagctggaaatggattttgacttctgtgagggcacaaccgtggtggtcaccgaagattgcgggaatcggggaccctccctgagaacaaccacggccagcggcaaactcatcacagagtggtgctgtcggtcctgcaccctgcctccgcttcgctacagaggcgaggacgggtgttggtacggaatggaaattcggcccctgaaggagaaggaagagaacctcgttaattctctggtgacagccggccatgggcaaatcgataactttagcctgggagtgcttggcatggctctcttcctggaagagatgctgagaacccgcgtcgggacaaaacacgcgatcctcctggtggccgtttcctttgtgacccttattacgggaaatatgtctttccgggacctgggcagagtcatggtgatggttggcgctaccatgacagatgacatcgggatgggagtgacctatctcgccctgctggccgcttttaaggtccgccctacattcgccgcgggccttctgctcagaaaactgaccagcaaggagctcatgatggctacgattgggatcgccctgctttcccagtctacaattcccgaaaccatcctggagctcacagatgccctggctctgggaatgatggtgcttaaaatcgttcggaacctggaaaagtaccagctcgccgtgaccattatggcgatcagctgcgtccctaatgctgtgattctgcaaaacgcctggaaggtgtcctgtaccatcctcgccgctgtcagcgtttctcccctgcttctgacatccagccagcagaaagccgactggattcctctcgctctgacgatcaagggcctgaatcccaccgccatctttcttacaaccctgtctcgcacatccaaaaagagaagctggccgctcaacgaggcggtgatggccgtggggatggtctctattctggcttccagcctcctgaaaaatgacatccctatgaccggaccccttgtggccggcggcctgctgacggtttgctatgtgctcacagggcggtccgctgatctggaacttgagcgcgccgccgacgtcaagtgggaggatcaggctgaaattagcggatctagccctatcctgtccattaccatctctgaggacggcagcatgtccattaaaaacgaagaggaggaacaaaccctcacaatcctgatcagaaccgggctcctggtgatttctggagttttccccgtgagcatcccgattacagcggccgcttggtacctttgggaggtcaagaagcagcgggccggcgtgctgtgggatgtcccttctccccctcccgtggggaaagccgaactggaggacggagcttatcgcatcaagcagagaggcatttttggctacagccagatcggggccggagtttataaagaaggcacgttccacaccatgtggcatgtgacaagaggggcggtcctcatgcaccgcggaaagagaatcgagcccagctgggctgatgtgaaaaaggacctgatttcctacggcgggggatggaaacttgagggcgaatggaaagagggcgaagaggttcaagtgctggccctcgaacctgggaagaatccgcgggccgtccagaccaaacccggactgtttaagacaaacaccggcacgatcggggctgtgagcctcgatttctctcctggaacctccggcagccccattgtggacagaaaagggaaggttgtcggactgtacggcaatggcgtggtgacacgctctggggcctatgtctccgcgatcgctcagaccgaaaagagcattgaggataaccctgaaatcgaggacgatatcttccggaaaaagagacttacaattatggacctgcatcccggagccggcaaaaccaagcgctacctgcctgccatcgtgcgggaagctattaaaagagggctccgcacactgatccttgccccgacgcgggttgtggctgccgagatggaagaggcgctgagaggactccccattcgctatcagacccctgccatccgggctgagcacacaggcagagaaattgtcgacctgatgtgtcatgccacctttaccatgcggctcctgtcccccgtgcgcgttcctaactacaatcttatcatcatggatgaggctcacttcacagaccccgcctctattgccgctagagggtatatcagcacgcgggtggaaatgggcgaggcggccggaatttttatgaccgctacaccgcctggctcccgcgatcccttcccccaaagcaacgcccctatcatggacgaggaaagagagattcccgaacggtcttggaactccgggcacgagtgggtcaccgattttaagggaaagacagtgtggttcgttcctagcatcaaagccggcaacgacatcgctgcctgcctgagaaagaatgggaaaaaggtgattcagctgtctcgcaaaacctttgatagcgaatacgtcaagacgcgggcgaacgactgggatttcgtggtgacaaccgacatctccgagatgggagctaattttagagccgagcgcgtcattgatccgcggagatgtatgaagcccgttatcctcaccgacggcgaggaacgcgtgattctggccgggcctatgcccgtgacacattctagcgctgcccagcggagaggccgcatcggaagaaaccctaaaaatgaaaacgaccaatatatctacatgggcgagccccttgaaaatgatgaggactgcgcgcactggaaggaggccaaaatgctgctcgataacattaataccccggaagggatcattccttccatgttcgagcccgaacgggagaaggtcgacgctatcgatggagaataccgcctgagaggcgaggcccggaaaacatttgtggacctgatgcgcagaggggatctccctgtttggcttgcttatcgggtggccgctgagggaattaactacgccgacagacgctggtgtttcgatggcatcaagaataaccagattctggaagagaacgtcgaagtggagatctggaccaaagagggggaacggaagaagctgaaacccagatggctcgacgcgcgcatctattctgatcctctggcccttaaggagttcaaagaatttgctgccggccggaagtccctgacgctcaatctgattacagagatgggaagactgcccaccttcatgacacagaaagctcgggacgccctcgataaccttgccgttctgcataccgctgaagtgggcgggcgcgcgtacaatcacgccctgtccgagctcccggagacgctggaaacccttctgctcctgacactgctcgctaccgtcacaggaggcatctttcttttcctgatgagcgggaagggaattggcaagatgaccctgggcatgtgctgcatcattacagcctctatcctcctgtggtatgcccagatccaacctcactggattgctgcctccatcattcttgagtttttcctgatcgtgctcctgattcccgaacccgagaaacagagaacccctcaggacaaccagctgacgtacgtcgtgatcgcgatcctcacagttgtggccgctaccatggccaatgaaatggggtttcttgagaagaccaaaaaggacctgggactgggcagcattacaacccaagagtccgaatctaacatcctcgatattgacctgcggccggctagcgcctggacactttatgcggtggccacgaccttcgtcacacccatgctgcgccattccatcgaaaattctagcgttaacgtgtccctcaccgctattgccaatcaggctacagtgctgatggggctgggaagaggctggcctctcagcaaaatggatatcggggtcccccttctggccattggatgttactctcaggtgaaccctatcaccctgacggctgccctcctgcttctggttgcgcactacgccatcattggccccggcctccaggctaaggccacccgggaagctcaaaagcgcgccgccgcggggatcatgaaaaatcctacagtggacggaattaccgtcatcgatctggagccgattccctatgaccctaagtttgaaaaacagctgggccaggtgatgctccttgtcctgtgcgtgacacaggttctgatgatgagaaccacgtgggctctctgtgaggccctgacacttgctaccgggcccatctccacactgtgggagggaaaccctggccggttctggaataccaccatcgccgtgagcatggccaacatttttcgcgggtcttacctcgctggagccggcctgctgttctccatcatgaagaatacaacgaacaccagacggggcacagggaatattggagaaaccctcggcgagaaatggaaaagcagacttaacgcgctggggaagtctgaatttcaaatctataaaaagagcggcattcaggaggtcgatcgcacactggccaaagagggcatcaagagaggggaaaccgaccatcacgctgtgtccagaggatctgccaaactccgctggttcgttgagcggaacatggtgacgcccgaaggcaaggtcgtggatctgggctgcgggagaggaggctggagctactattgtgggggacttaaaaatgtgcgcgaggttaagggcctgacaaaagggggaccgggccatgaggagcctatccccatgtccacctacggctggaacctcgtccggctgcagagcggggtggacgtgttctttacaccccctgagaaatgcgatacactgctctgtgacattggagaatcctctcccaatcctaccatcgaggctggcagaacacttcgcgtcctgaacctggttgaaaattggctcaacaataacacgcaattctgcattaaggtgctgaatccgtatatgcccagcgtgatcgagaaaatggaaacccttcagcggaagtacgggggagccctggtcagaaaccctctctcccgcaattctacacacgagatgtactgggtgagcaacgcgaccggcaatattgtttcctctgtgaacatgatcagccggatgctgatcaatagatttacaatgaaacacaagaaggccacctatgagcccgatgtcgacctggggtccggaacgcgcaacattggcatcgaaaacgagattcctaatctcgacatcattggcaaaagaatcgaaaagattaaacaggagcatgaaaccagctggcactacgatcaggaccatccctataagacatgggcttaccacgggtcttatgagaccaaacaaacaggatccgccagctctatggtgaacggcgttgtgcggcttctgaccaagccgtgggatgtcgtgcctatggtgacacagatggctatgaccgacacgacacccttcgggcagcagcgcgtctttaaggagaaagttgataccagaacccaagaacctaaggagggaaccaagaagctgatgcggatcacggccgaatggctctggaaagagctgggcaagaagaaaacccccagaatgtgtacacgggaggagttcacccgcaaggtgagatccaatgctgcccttggggcgatctttacagacgagaacaaatggaaaagcgcccgggaagctgtggaggattctcgcttctgggaactggtcgacagagagcggaatctccacctggagggaaaatgcgaaacctgtgtgtacaacatgatgggcaagcgcgagaaaaagctgggcgaatttgggaaggccaaaggatccagagctatttggtatatgtggctcggcgcccggttcctggagtttgaagcccttgggttcctgaatgaggatcattggtttagccgcggaaactccctcagcggcgttgagggggaaggcctgcacaaacttggatacatcctgagagacgtgtctaaaaaggagggcggggcgatgtacgctgatgacacagccggatgggacacccggattacgctcgaagatctgaaaaatgaggaaatggtcaccaaccatatgaagggcgagcacaagaaactggccgaggctatcttcaagctcacatatcagaataaagtggttcgcgtgcagagacctacaccccgggggacagtcatggacattatcagccgcaaggatcagagaggatccggccaagtggggacctacggcctgaacacgttcacaaatatggaagcccagcttatccggcagatggagggagaaggcatttttaaatctatccaacatctgaccgttacagaggagattgctgtgcagaactggctcgccagagtcgggcgcgaacggctgagcagaatggcgatctccggagacgattgcgtggtcaagccgcttgacgatcgcttcgcctctgctctgaccgccctcaatgacatgggcaaggtgcggaaagatattcagcagtgggagcctagcagagggtggaacgactggacgcaagttcccttttgctcccaccacttccatgaactggtgatgaaggatggacgcgtcctggtggtgccctgtcggaaccaggacgagctcatcggcagagctcgcatctctcagggggccggctggagcctgaaagaaaccgcgtgccttggaaagtcctatgcccagatgtggacactgatgtactttcaccggagagatctccgcctggctgccaatgctatttgtagcgccgttccttctcattgggtgccgacctcccggacaacctggagcatccacgctaaacacgagtggatgacaaccgaggacatgcttgccgtctggaacagagtgtggattcaagaaaatccctggatggaggacaagacgcctgttgaatcttgggaggaagtgccctatctgggcaagcgggaggatcagtggtgcgggtccctcatcggactgacaagcagagcgacctgggccaaaaacattcagaccgctatcaatcaggtccgctccctgattggcaacgaggaatacacagactatatgccttctatgaagcggttcagaaaagaggaagaggaagccggggtgctctggtga

SEQ ID NO: 19929 - RNA, 9876 nt, synthetic construct
  misc_feature 1..9876: note = derived and/or modified CDS sequence (opt5) from DENV-2__EU569707__SS-prME
  source 1..9876: mol_type = other RNA
accgcgggagtgatcattatgctgatccccacagctatggccttccacctcacgaccagaaacggggagcctcatatgattgtcggacggcaggaaaagggcaagtccctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcgtggaagctaagctcacaaacaccaccacagagagccggtgtccgacccaaggagagccctctctgaatgaagaacaggacaaacgctttgtgtgcaagcattccatggtcgatagaggctggggcaacgggtgtggactgttcggcaaagggggaatcgttacatgcgccatgtttacgtgcaaaaagaatatggaaggcaaagtggtgctccctgagaacctggaatacaccattgtcatcacaccccacagcggggaggagcatgcggtgggaaatgacaccggcaagcacggcaaagaaattaagatcacacctcagtcttccatcaccgaggccgaacttacggggtatggaaccgttacaatggagtgtagcccccggaccggcctggatttcaacgaaatggtgctcctgcgcatggaggacaaggcttggcttgtccacagacagtggtttctggatctcccgctgccttggctgcccggggccgacacacaaggatctaattggattcagaaggagaccctcgtgacgttcaagaaccctcatgctaaaaagcaggacgttgtggtcctgggctcccaggaaggggccatgcacacagcccttaccggcgctacagagatccaaatgagctccggaaatctgctctttaccggccatctgaaatgccggcttagaatggataagctgcagctcaaagggatgtcttacagcatgtgtaccggaaagttcaagattgtgaaagaaatcgcggagacacagcacggcacgattgtcatccgcgtgcaatatgagggggacggatccccctgcaagatccccttcgaaattatggatctggagaaacggcatgttctgggcagactcatcaccgtgaaccctattgtcgccgaaaaggacagcccggtgaacatcgaggctgaacccccttttggggattcttacattatcattggcgttgagcccggacagctgaaacttaattggttcaagaagggctccagcatcgggcagatgtttgagacaaccatgcgcggagccaaacggatggccatcctgggcgacacagcttgggatttcgggtctctcggaggcgtgtttaccagcattgggaaggccctgcaccaggtcttcggcgcgatctacggagctgccttttccggcgtgtcttggacgatgaaaattctgatcggggtgattatcacatggatcggaatgaacagcagatccaccagcctttctgtttccctcgtcctggtgggcgtggtcaccctgtatctcggggccatggtgcaagctgacagcggatgtgttgtgtcttggaagtccaaagaactgaagtgcggcagcgggattttcatcacagataatgtccacacctggacagagcagtacaagtttcagcctgaatccccctctaaacttgccagcgctattcagaaggcccatgaggaaggcatctgtggaattagatccgtgacgcggctggagaacctcatgtggaaacaaatcaccccggagctgaatcacatcctgtctgaaaacgaggttaaacttacaattatgaccggcgacatcaaagggattatgcaggcgggaaagagaagcctccgccctcagcccacagaactgaaatattcctggaagacctggggcaaggccaaaatgctgagcacggagtctcataatcagaccttcctcatcgatgggcctgaaacagctgagtgccccaacaccaatcgggcctggaactccctggaggtggaagactacggatttggcgtcttcacaaccaatatttggcttaagctgagagagaaacaagacgtgttttgtgatagcaagctcatgtctgctgccatcaaagacaaccgcgcggttcacgccgatatgggctattggatcgaatccgctctgaatgacacatggaagatggagaaggccagcttcattgaggtgaaatcttgccactggcctaagagccataccctgtggtccaacggggtccttgaaagcgagatgatcattcccaaaaatttcgctggaccggtgtctcagcacaactaccggcctggctatcatacgcagacagccgggccctggcacctcggaaagctggaaatggattttgacttctgtgagggcaccaccgtggtcgttacagaagattgcgggaacagaggaccctccctgcggaccacgacagccagcggcaaactcatcaccgagtggtgctgtcgctcctgcacactgcctccgcttagataccggggcgaggacgggtgttggtacggaatggaaattagacccctgaaggagaaggaagagaatctcgtgaactctctggtgaccgctggccatgggcagatcgataattttagcctgggagtccttggcatggccctcttcctggaagagatgctgcgcacacgggtggggaccaaacacgccatgctcctggttgctgtgtcctttgtcacgcttattaccggaaacatgtctttcagagacctgggccgcgtgatggttatggtgggcgccacaatgaccgatgacatcgggatgggaatcacatatctcgccctgctggctgcctttaaggtcagacctaccttcgcggctggccttctgctccggaaactgacgagcaaggagctcatgatggccacaattgggatcgccctgctttcccaatctaccattcccgaaacaatcctggagctcaccgatgctctggccctgggaatgatggtgcttaaaattgttcgcaatatggaaaagtaccagctggcggtgaccatcatggctatcagctgcgtccctaacgccgtgattctccagaatgcctggaaggtgtcctgtacaatcctggctgccgtcagcgtttctcccctcctgcttacgtccagccaacagaaagctgactggattcctctggccctcaccatcaagggcctgaaccccacagcgatttttctgaccacactttctagaacctccaaaaagcggagctggccgctgaatgaggccatcatggctgtggggatggtgtctatcctcgcctccagcctgctcaaaaacgacattcctatgacgggacccctggtcgctggcggccttctgacagtgtgctatgttctgaccgggcgctccgccgatctcgaactggagagagccgctgacgtgaagtgggaggatcaggcggaaatcagcggatctagccctattctttccatcaccatttctgaggacggcagcatgtccatcaaaaatgaagaggaggaacagacactgaccattctcatccggacagggctgctcgtcatctctggagtgttccccgttagcattccgatcacggccgctgcctggtacctgtgggaggtgaagaagcaacgcgccggcgtcctttgggatgtgccttctccccctcccgtcgggaaagctgaactggaggacggagcctatagaattaagcagcggggcatcctgggctacagccagattggggcgggagtgtataaagaaggcacctttcacacaatgtggcatgttacccgcggggctgtgctcatgcacagaggaaagcggatcgagcccagctgggccgatgtcaaaaaggacctgatctcctacggcgggggatggaaacttgagggcgaatggaaagagggcgaagaggtgcaggttctggccctcgaacctgggaagaacccgagagctgtgcaaacaaaacccggactgttcaagaccaatacgggcaccattggggccgtcagcctcgatttttctcctggaacatccggcagccccatcgtggaccgcaaagggaaggtggttggactgtacggcaacggcgtcgtgacccggtctggggcgtatgtgtccgctattgcccagacagaaaagagcatcgaggataatcctgaaattgaggacgatatcttccgcaagaagcgccttaccatcatggacctgcatcccggagccggcaaaacaaagcggtacctgcctgctattgtcagagaagccatcaaacgcgggctccggacgctgattcttgctccgaccagagtggttgccgcggagatggaagaggccctgcgcggactccccatccggtatcagacccctgctattagagccgagcacaccggccgggaaatcgtggacctgatgtgtcatgctaccttcacaatgcgcctcctgtcccccgtcagagtgcctaactacaaccttattatcatggatgaggcccactttacggaccccgcctctatcgctgcgcgggggtatattagcacccgcgttgaaatgggcgaggccgctggaatcttcatgacagccaccccgcctggctccagagatccctttccccagagcaatgcccctattatggacgaggaacgggagatccccgaaagatcttggaactccgggcacgagtgggtgacagatttcaagggaaagaccgtctggtttgtgcctagcattaaagctggcaatgacatcgccgcgtgcctgcgcaagaacgggaaaaaggttatccaactgtctcggaaaacgttcgatagcgaatacgtgaagacaagagctaatgactgggattttgtcgtgaccaccgacatttccgagatgggagccaacttcaaggccgagcgcgtgatcgatccgcggagatgtatgaaacccgtcattctcacagacggcgaagaacgcgttatcctggctgggcctatgcccgtgacccattctagcgccgcgcagcggagaggccgcattggaagaaatcctaagaacgaaaatgaccagtatatctacatgggcgagccccttgaaaacgatgaggactgcgcccactggaaagaggctaagatgctgctcgataatatcaacacaccggaagggattatcccttccatgtttgagcccgaacgggagaaagtggacgccattgatggagaataccgcctgagaggcgaggctcggaagaccttcgtcgacctgatgcgcagaggggatctccctgtgtggcttgcctatcgggttgctgccgagggaatcaattacgcggacagacgctggtgttttgatggcattaaaaacaatcaaatcctggaagagaacgtggaagtcgagatttggacgaaggagggggaacggaagaaactgaagcccagatggctcgacgcccgcatctattctgatcctctggctcttaaagagttcaaggagttcgccgctggccggaaaagcctgacactcaacctgatcaccgagatgggaagactgcccacatttatgacccagaaggcccgggacgccctcgataatcttgctgtgctgcatacggcggaagccggcgggcgcgcttacaaccacgccctgtccgagctcccggagaccctggaaacacttctgctcctgaccctgctcgccacagttaccggaggcattttcctttttctgatgagcgggaagggaatcggcaaaatgacactgggcatgtgctgcattatcaccgcttctattctcctgtggtatgcccagatccagcctcactggatcgcggcctccattatccttgagttctttctgattgtgctcctgatccccgaacccgagaagcaaagaacgcctcaggacaatcagctgacatacgtcgtgattgctatcctcaccgtcgtggccgctaccatggccaacgaaatggggttccttgagaaaacaaagaaagacctgggactgggcagcatcgcgacccaggagtccgaatctaatattctcgatatcgacctgcggccggccagcgcttggacactttatgccgttgctacgacctttgtgacacccatgctgcgccattccattgagaactctagcgtgaatgtctccctcaccgccatcgctaaccaagccacagttctgatggggctgggaaagggctggcctctcagcaagatggatattggggtgccccttctggcgatcggatgttactctcaggtgaatcctattaccctgacggccgctctcctgcttctggtcgcccactacgctatcatcggccccggcctccaggccaaagccaccagagaagcgcagaagcgggctgccgctgggattatgaaaaaccctacagtggacggaatcaccgttattgatctggagccgatcccctatgaccctaagttcgaaaaacaactgggccaggtgatgctccttattctgtgcgtcacacaggtgctgatgatgcgcaccacgtgggccctctgtgaggccctgacacttgctaccgggcccatctccacactgtgggagggaaatcctggcagattttggaacaccaccatcgccgtcagcatggcgaatattttccgggggtcttacctcgccggagctggcctgctgttttccatcatgaagaacacaacgaatacccgcagaggcacagggaacattggagaaaccctcggcgagaagtggaaaagccggcttaatgccctggggaagtctgagttccagatctataaaaagagcggcattcaagaggtggatagaacactggctaaagagggcatcaagcgcggggaaaccgaccatcacgccgtttcccggggatctgcgaaactcagatggtttgtggagcgcaacatggtcacgcccgaaggcaaggtggttgatctgggctgcgggcggggaggctggagctactattgtgggggacttaagaacgtgagagaggtcaaaggcctgacaaaagggggaccgggccatgaggaacctatccccatgtccacctacggctggaatctcgtgcgcctgcagagcggggtggacgttttcttcacaccccctgagaaatgcgatacactgctctgtgacattggagaatcctctcccaaccctaccatcgaggccggccggacacttagagtcctgaatctggtggaaaactggctcaataacaatacgcagttttgcattaaggtgctgaacccgtatatgcccagcgtcatcgagaaaatggaaacccttcaacgcaagtacgggggagctctggttcggaatcctctctccagaaactctacacacgagatgtactgggtgagcaatgccaccggcaacattgtgtcctctgtcaatatgatcagccgcatgctgatcaaccggttcacaatgaagcacaaaaaggctacctatgagcccgatgtggacctggggtccggaacgagaaatattggcatcgaaagcgagattcctaacctcgacatcattggcaaacgcatcgaaaagattaaacaggagcatgaaacctcttggcactacgatcaggaccatccctataagacatgggcctaccacgggtcctatgagaccaagcagacaggaagcgcttcttccatggttaacggcgtggtcagacttctgaccaaaccgtgggatgtggttcctatggtgacacaaatggccatgaccgacacgacaccctttgggcagcagcgggtcttcaaggagaaagtggatacccgcacccaggaacctaaggagggaaccaagaagctgatgaagatcacggcggaatggctctggaaagagctgggcaagaaaaagacccccagaatgtgtacacgggaggaatttaccagaaaagtgcggagcaatgccgctcttggggccatcttcacagacgagaacaagtggaaatctgctcgcgaagccgtcgaggattccagattttgggaactgattgaccgggagcgcaatctccacctggagggaaagtgcgaaacctgtgtttacaacatgatgggcaagagagagaaaaagctgggcgagttcgggaaagccaagggaagccgggcgatctggtatatgtggctcggcgctcgctttctggagttcgaagcccttgggtttctgaatgaggatcattggttctccagaggaaacagcctctctggcgtggagggggaaggcctgcaccggcttggatacattctgcgcgacgtgagcaaaaaggagggcggggccatgtacgctgatgacacagccggatgggacaccagaatcacgctcgaagatctgaagaatgaggaaatggtcaccaaccatatgaaaggcgagcacaagaaactggctgaggccatttttaagctcacatatcaaaataaagtggttcgggtgcagcgccctacccccagagggacagtcatggacatcatctcccggcgcgatcagagaggatctggccaggtggggacctacggcctgaacacgttcacaaatatggaagcgcaacttattcggcagatggagggagaaggcatcttcaagagcattcagcatctgaccgttacagaggagatcgccgtgcaaaactggctcgctagagtcgggcgcgaacggctgtccagaatggccatttctggagacgattgcgtggttaagccgcttgacgatcgctttgctagcgccctgaccgcgctcaatgacatgggcaaagtgcggaaggatatccagcagtgggagccttccagagggtggaacgactggacgcaggtccccttctgctctcaccactttcatgaactggtgatgaaagatggacgcgtcctggtggttccctgtcggaatcaagacgagctcatcggcagagcccgcattagccagggggctggctggtccctgaaggaaaccgcctgccttggaaaaagctatgctcagatgtggacactgatgtacttccaccggagagatctccgcctggccgctaacgccatctgttctgcggtgccttcccattgggtcccgaccagccggacaacctggtctattcacgccaagcacgagtggatgacaaccgaggacatgcttgctgtgtggaacagagtgtggatccaggaaaatccctggatggaggacaagacgcctgttgaatcctgggaggaagtgccctatctgggcaaacgggaggatcaatggtgcgggagcctcattggactgacatccagagccacctgggccaagaacatccagaccgctattaatcaggtccgctctctgatcggcaacgaggaatacacagactatatgcctagcatgaaacggtttagacgcgaggaagaggaagccggggtgctctggtga

SEQ ID NO: 19930 - RNA, 9876 nt, synthetic construct
  misc_feature 1..9876: note = derived and/or modified CDS sequence (opt5) from DENV-2__EU660399__SS-prME
  source 1..9876: mol_type = other RNA
accgcgggagtgatcattatgctgatccccaccgctatggccttccacctcacgacccggaacggggagcctcatatgattgtcggacggcaggaaaagggcaagtccctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagacccggacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggccctcttcctggaagagatgctgagaacacgcgtcgggaccaaacacgccatgctcctggtggctgtttcctttgtgacgcttatcaccggaaacatgtctttccgggacctgggcagagtcatggtgatggttggcgccacaatgaccgatgacatcgggatgggaattacatatctcgccctgctggctgcctttaaggtgcgccctaccttcgcggctggccttctgctcagaaaactgacgagcaaggagctcatgatggccacaatcgggattgccctgctttcccagtctaccatccccgaaacaattctggagctcaccgatgctctggccctgggaatgatggtccttaaaatcgtgcggaatatggaaaagtaccagctggcggttaccatcatggctattagctgcgtgcctaacgccgtcatcctccaaaatgcctggaaggtgtcctgtacaattctggctgccgtgagcgtctctcccctcctgcttacgtccagccagcagaaagctgactggatccctctggccctcaccattaagggcctgaaccccacagcgatctttctgaccacactttctcgcacctccaaaaagagaagctggccgctgaatgaggccgttatggctgtggggatggtgtctatcctcgcctccagcctgctcaaaaacgacattcctatgacgggacccctggtcgctggcggccttctgacagtgtgctatgttctgaccgggcggtccgccgatctcgaactggagcgcgccgctgacgtgaagtgggaggatcaggcggaaatcagcggatctagccctattctttccatcaccatttctgaggacggcagcatgtccatcaaaaatgaagaggaggaacaaacactgaccattctcatcagaacagggctgctcgtcatctctggagtgttccccgttagcattccgatcacggccgctgcctggtacctgtgggaggtgaagaagcagcgggccggcgtcctttgggatgtgccttctccccctcccgtcgggaaagctgaactggaggacggagcctatcgcattaagcagagaggcatcctgggctacagccagattggggcgggagtgtataaagaaggcacctttcacacaatgtggcatgttaccagaggggctgtgctcatgcaccgcggaaagagaatcgagcccagctgggccgatgtcaaaaaggacctgatctcctacggcgggggatggaaacttgagggcgaatggaaagagggcgaagaggtgcaagttctggccctcgaacctgggaagaacccgcgggctgtgcagacaaaacccggactgttcaagaccaatacgggcaccattggggccgtcagcctcgatttttctcctggaacatccggcagccccatcgtggacagacaggggaaagtggttggactgtacggcaacggcgtcgtgacccgctctggggcgtatgtgtccgctattgcccagacagaaaagagcatcgaggataatcctgaaattgaggacgatatcttccggaagaaaagacttaccatcatggacctgcatcccggagccggcaagaccaagaagtacctgcctgctattgtccgcgaagccatcaaacgggggctcagaacgctgattcttgctccgacccgcgtggttgccgcggagatggaagaggccctgcggggactccccatcagatatcaaacccctgctattcgcgccgagcacaccggccgggaaatcgtggacctgatgtgtcatgctaccttcacaatgagactcctgtcccccgtccgggtgcctaactacaaccttattatcatggatgaggcccactttacggaccccgcctctatcgctgcgcgcgggtatattagcaccagagttgaaatgggcgaggccgctggaatcttcatgacagccaccccgcctggctcccgggatccctttccccagagcaatgcccctattatggacgaggaacgcgagatccccgaaagatcttggaactccgggcacgagtgggtgacagatttcaagggaaagaccgtctggtttgtgcctagcattaaagctggcaatgacatcgccgcgtgcctgcggaagaacgggaaaaaggttatccagctgtctagaaaaacgttcgatagcgaatacgtgaagacacgcgctaatgactgggattttgtcgtgaccaccgacatttccgagatgggagccaacttcaaggccgagcgggtgatcgatccgagacgctgtatgaaacccgtcattctcacagacggcgaagaacgggttatcctggctgggcctatgcccgtgacccattctagcgccgcgcaaagacgcggccggattggaagaaatcctaagaacgaaaatgaccagtatatctacatgggcgagccccttgaaaacgatgaggactgcgcccactggaaagaggctaagatgctgctcgataatatcaacacaccggaagggattatcccttccatgtttgagcccgaacgcgagaaagtggacgccattgatggagaatacagactgcggggcgaggctcgcaagaccttcgtcgacctgatgagaagaggggatctccctgtgtggcttgcctatcgcgttgctgccgagggaatcaattacgcggacagacggtggtgttttgatggcattaaaaacaatcagatcctggaagagaacgtggaagtcgagatttggacgaaggagggggaaagaaagaaactgaagccccgctggctcgacgcccggatctattctgatcctctggctcttaaagagttcaaggagttcgccgctggcagaaaaagcctgacactcaacctgatcaccgagatgggacgcctgcccacatttatgacccagaaggcccgggacgccctcgataatcttgctgtgctgcatacggcggaagccggcgggagagcttacaaccacgccctgtccgagctcccggagaccctggaaacacttctgctcctgaccctgctcgccacagttaccggaggcattttcctttttctgatgagcgggaagggaatcggcaaaatgacactgggcatgtgctgcattatcaccgcttctattctcctgtggtatgcccaaatccagcctcactggatcgcggcctccattatccttgagttctttctgattgtgctcctgatccccgaacccgagaagcagcggacgcctcaggacaatcaactgacatacgtcgtgattgctatcctcaccgtcgtggccgctaccatggccaacgaaatggggttccttgagaaaacaaagaaagacctgggactgggcagcatcgcgacccaggagtccgaatctaatattctcgatatcgacctgcgcccggccagcgcttggacactttatgccgttgctacgacctttgtgacacccatgctgagacattccattgagaactctagcgtgaatgtctccctcaccgccatcgctaaccaggccacagttctgatggggctgggaaagggctggcctctcagcaagatggatattggggtgccccttctggcgatcggatgttactctcaggtgaatcctattaccctgacggccgctctcctgcttctggtcgcccactacgctatcatcggccccggcctccaagccaaagccacccgggaagcgcagaagcgcgctgccgctgggattatgaaaaaccctacagtggacggaatcaccgttattgatctggagccgatcccctatgaccctaagttcgaaaaacagctgggccaggtgatgctccttattctgtgcgtcacacaagtgctgatgatgagaaccacgtgggccctctgtgaggccctgacacttgctaccgggcccatctccacactgtgggagggaaatcctggccggttttggaacaccaccatcgccgtcagcatggcgaatattttccgcgggtcttacctcgccggagctggcctgctgttttccatcatgaagaacacaacgaataccagacggggcacagggaacattggagaaaccctcggcgagaagtggaaaagccgccttaatgccctggggaagtctgagttccagatctataaaaagagcggcattcaggaggtggatagaacactggctaaagagggcatcaagagaggggaaaccgaccatcacgccgtttccagaggatctgcgaaactccgctggtttgtggagcggaacatggtcacgcccgaaggcaaggtggttgatctgggctgcgggagaggaggctggagctactattgtgggggacttaagaacgtgcgcgaggtcaaaggcctgacaaaagggggaccgggccatgaggaacctatccccatgtccacctacggctggaatctcgtgcggctgcaaagcggggtggacgttttcttcacaccccctgagaaatgcgatacactgctctgtgacattggagaatcctctcccaaccctaccatcgaggccggcagaacacttcgcgtcctgaatctggtggaaaactggctcaataacaatacgcagttttgcattaaggtgctgaacccgtatatgcccagcgtcatcgagaaaatggaaacccttcagcggaagtacgggggagctctggttagaaatcctctctcccgcaactctacacacgagatgtactgggtgagcaatgccaccggcaacattgtgtcctctgtcaatatgatcagccggatgctgatcaacagattcacaatgaagcacaaaaaggctacctatgagcccgatgtggacctggggtccggaacgcgcaatattggcatcgaaagcgagattcctaacctcgacatcattggcaaacggatcgaaaagattaaacaggagcatgaaacctcttggcactacgatcaagaccatccctataagacatgggcctaccacgggtcctatgagaccaagcagacaggaagcgcttcttccatggttaacggcgtggtcagacttctgaccaaaccgtgggatgtggttcctatggtgacacagatggccatgaccgacacgacaccctttgggcagcaacgcgtcttcaaggagaaagtggataccagaacccaggaacctaaggagggaaccaagaagctgatgaagatcacggcggaatggctctggaaagagctgggcaagaaaaagacaccccggatgtgtacacgcgaggaatttaccagaaaagtgcggagcaatgccgctcttggggccatcttcacagacgagaacaagtggaaatctgctagagaagccgtcgaggattcccggttttgggaactgattgaccgcgagagaaatctccacctggagggaaagtgcgaaacctgtgtttacaacatgatgggcaagcgggagaaaaagctgggcgagttcgggaaagccaagggaagccgcgcgatctggtatatgtggctcggcgctagatttctggagttcgaagcccttgggtttctgaatgaggatcattggttctcccggggaaacagcctctctggcgtggagggggaaggcctgcaccgccttggatacattctgagagacgtgagcaaaaaggagggcggggccatgtacgctgatgacacagccggatgggacacccggatcacgctcgaagatctgaagaatgaggaaatggtcaccaaccatatgaaaggcgagcacaagaaactggctgaggccatttttaagctcacatatcagaataaagtggttcgcgtgcagagacctacaccccgggggacagtcatggacatcatctcccgcagagatcaacggggatctggccaggtggggacctacggcctgaacacgttcacaaatatggaagcgcagcttattcgccaaatggagggagaaggcatcttcaagagcattcagcatctgaccgttacagaggagatcgccgtgcagaactggctcgctagagtcgggcgggaaagactgtcccgcatggccatttctggagacgattgcgtggttaagccgcttgacgatcggtttgctagcgccctgaccgcgctcaatgacatgggcaaagtgagaaaggatatccagcaatgggagccttcccgcgggtggaacgactggacgcaggtccccttctgctctcaccactttcatgaactggtgatgaaagatggacgggtcctggtggttccctgtagaaatcaggacgagctcatcggccgcgcccggattagccagggggctggctggtccctgaaggaaaccgcctgccttggaaaaagctatgctcaaatgtggacactgatgtacttccacagacgcgatctccggctggccgctaacgccatctgttctgcggtgccttcccattgggtcccgaccagcagaacaacctggtctattcacgccaagcacgagtggatgacaaccgaggacatgcttgctgtgtggaaccgcgtgtggatccaggaaaatccctggatggaggacaagacgcctgttgaatcctgggaggaagtgccctatctgggcaaacgggaggatcagtggtgcgggagcctcattggactgacatccagagccacctgggccaagaacatccagaccgctattaatcaagtccggtctctgatcggcaacgaggaatacacagactatatgcctagcatgaaaagatttcgccgggaggaagaggaagccggggtgctctggtga

SEQ ID NO: 19931 - RNA, 9876 nt, synthetic construct
  misc_feature 1..9876: note = derived and/or modified CDS sequence (opt5) from DENV-2__EU569708__SS-prME
  source 1..9876: mol_type = other RNA
accgcgggcgtgatcattatgctgatccccaccgctatggccttccacctcacgacccggaatggggaacctcatatgattgtcggacggcaggaaaagggcaagagcctgctttttaagacagaagacggggttaatatgtgcaccctgatggcgatcgatctcggagaactgtgtgaggacaccattacctacaagtgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaagggggaatcgtgacctgcgcgatgtttacatgcaaaaagaatatggaaggcaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctgggccggctcatcacggtgaaccctattgttaccgagaaggatagcccggtgaacatcgaagctgagcccccttttggggactcttacattatcatcggcgtcgagcccggacagctgaaacttaattggttcaagaagggctccagcattgggcagatgtttgaaacaaccatgagaggagccaaacgcatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaagaataaagagctgaagtgcggctccgggattttcatcacagacaacgttcacacctggacagaacagtacaagtttcagcctgagagcccctccaaacttgcctctgctattcaaaaggcccatgaagagggcatctgtggaatcagaagcgtgacgcgcctggagaatctcatgtggaaacagattaccccggaactgaaccacatcctgtccgagaatgaagtcaaacttacaattatcaccggcgatattaaagggatcatgcaggcgggaaagcggtctctcagacctcagcccacagagctgaaatatagctggaagacctggggcaaggccaaaatgctgtccacggaaagccataaccaaaccttcctcatcgacgggcctgagacagctgagtgccccaataccaaccgcgcctggaactctctggaagtggaggattacggatttggcgttttcacaaccaacatttggcttaagctgcgggaaaaacaggacgtgttttgtgactccaagctcatgagcgctgccatcaaagataatagagcggtccacgccgacatgggctattggattgagtctgctctgaacgatacatggaagatggagaaggcctccttcatcgaagtgaaaagctgccactggcctaagtctcataccctgtggagcaatggggttcttgagtccgaaatgattatccccaaaaacttcgctggaccggtgagccagcacaactaccgccctggctatcatacgcagacagccgggccctggcacctcggaaagctggagatggactttgatttctgtgaaggcaccaccgtcgtggtgacagaggactgcgggaatcggggaccctctctgagaaccacgacagcctccggcaaactcattaccgagtggtgctgtcggagctgcacactgcctccgcttcgctacagaggcgaagatgggtgttggtacggaatggagatccggcccctgaaggaaaaggaggaaaacctcgtcaattccctggttaccgctggccatgggcaaatcgacaacttttctctgggagtgcttggcatggccctcttcctggaggagatgctgagaacacgcgtggggaccaaacacgccattctcctggtcgctgtgagctttgttacgcttatcaccggaaatatgtccttccgggatctgggcagagtgatggtcatggtgggcgccacaatgaccgacgatattgggatgggagttacatatctcgccctgctggctgcctttaaggtgcgccctaccttcgcggctggccttctgctcagaaaactgacgtctaaggaactcatgatggccacaatcgggattgccctgcttagccagtccaccatccccgagacaatcctggaactcaccgacgctctggccctgggaatgatggtccttaaaattgtgcggaacatggagaagtaccagctggcggttaccatcatggctatttcttgcgtgcctaatgccgtcatcctcctgaacgcctggaaggtgagctgtacaattctcgctgccgtgtccgtcagccccctgcttctgacgtcttcccaacagaaaaccgattggatccctctcgctctgacaatcaagggcctgaatcccaccgccatttttcttacaaccctgagccgcacgtctaaaaagagatcctggccgctcaacgaagcggttatggccgtggggatggtgagcatcctggcttcttccctcctgaaaaatgacattcctatgacaggaccccttgtcgccggcggcctgctgaccgtgtgctatgttctcaccgggcggagcgctgacctggagcttgagcgcgccgccgatgtgaagtgggaagaccaggctgagatctccggaagctctcctattctgagcgtcacaatctccgaagatggctctatgagcattaaaaacgaggaggaagaacagaccctcacaatcctgatcagaacggggctcctggtgatttccggagttttccccgtgtctatcccgattaccgcggccgcttggtacctttgggaagtcaagaagcaacgggccggcgtgctgtgggacgtcccttctccccctcccgtggggaaagccgagctggaagatggagcttatcgcatcaagcagagaggcattctcggctactcccagatcggggccggagtttataaagagggcacatttcacaccatgtggcatgtgacaagaggggcggtcctgatgcaccgcggaaagagaatcgagccctcctgggctgacgtgaaaaaggatcttattagctacggcgggggatggaagctggaaggcgagtggaaagaaggcgaggaagttcaggtgctcgccctggagcctgggaagaatccgcgggccgtccaaaccaaacccggactcttcaagacgaacaccggcacaatcggggctgtgtccctggactttagccctggaacctctggctcccccattgtggatagaaaagggaaggttgtcggactttacggcaatggcgtggtgacacgcagcggggcctatgtctctgcgatcgctcagaccgagaagtccattgaagacaaccctgagatcgaagatgacatcttccggaaaaagagactgacaattatggatctgcatcccggagccggcaaaacgaagcgctacctccctgccatcgtgcgggaggctattaaaagagggctgcgcacccttatcctggccccgacacgggttgtggctgccgaaatggaggaggcgctcagaggactgcccattcgctatcagacccctgccatccgggctgaacacaccggcagagagattgtcgacctcatgtgtcatgccacattcacgatgcggctgcttagccccgtgcgcgttcctaactacaatctgatcatcatggacgaagctcactttaccgatcccgcctccattgccgctagagggtatatctctacacgggtggagatgggcgaggcggccggaattttcatgaccgctacaccgcctggcagccgcgacccctttccccagtccaacgcccctatcatggatgaagagagagaaattcccgagcggagctggaactctgggcacgaatgggtcaccgacttcaagggaaagacggtgtggtttgttccttccatcaaagccggcaacgatatcgctgcctgcctgagaaagaatgggaaaaaggtgattcaactcagccgcaaaacattcgactctgagtacgtcaagacccgggcgaacgattgggactttgtggtgaccacagatatcagcgagatgggagctaatttcagagccgaacgcgtcattgacccgcggagatgtatgaagcccgttatcctgaccgatggcgaggaacgcgtgattcttgccgggcctatgcccgtgacacattcctctgctgcccagcggagaggccgcatcggaagaaaccctaaaaatgagaacgaccagtatatctacatgggcgaacccctggagaatgacgaggattgcgcgcactggaaggaagccaaaatgctcctggacaacattaataccccggaggggatcattcctagcatgtttgaacccgagcgggaaaaggtcgatgctatcgacggagagtaccgcctgagaggcgaggcccggaaaacgttcgtggatctcatgcgcagaggggaccttcctgtttggctggcttatcgggtggccgctgaaggaattaactacgccgatagacgctggtgttttgacggcatcaagaataaccaaattctggaggaaaacgtcgaggtggagatctggacaaaagaaggggagcggaagaagctcaaacccagatggctggatgcgcgcatctattccgaccctcttgccctgaaggagttcaaagagttcgctgccggccggaagtctctcaccctgaatctgattacagaaatgggaagactccccacctttatgacgcagaaagctcgggatgcccttgacaacctggccgttctgcataccgctgaggcgggcgggcgcgcctacaatcacgctctcagcgagctgccggaaacacttgagaccctgctcctgctgacactccttgccaccgtgacaggaggcatcttcctgtttctgatgtccgggaagggaattggcaagatgaccctcggcatgtgctgcatcattacggccagcatcctgctttggtatgctcagatccagcctcactggattgccgcgtctatcattctggagttctttctcatcgtcctgctgattcccgagcccgaaaaacaaagaacacctcaggataaccagctcacctacgtggtcatcgccatccttaccgtggttgctgccacaatggctaatgagatggggttcctggagaagaccaaaaaggacctgggactcggctccattacaacgcaggaaagcgagtccaacatcctggacattgatcttcggccggcctctgcgtggaccctgtatgccgtggctacaacctttgtgacacccatgctccgccatagcatcgaaaattcctctgtcaacgttagcctgaccgccattgctaatcaagccacggtgctgatggggctcggaaaaggctggcctctttccaagatggacatcggggtgcccctgctggctattggatgttacagccaggtcaaccctatcaccctcacagccgcgctgcttctgctcgtggcccactacgctatcattggccccggcctgcaggccaaggctaccagagaggcccagaaacgggccgcggctgggatcatgaagaatcctacagttgatggaattaccgtgatcgacctggaaccgattccctatgatcctaaattcgagaagcaactcggccaggtcatgcttctgatcctgtgcgtgacgcaggtcctcatgatgcgcacaacctgggccctgtgtgaggctcttacactggccaccgggcccatctctaccctctgggaaggaaaccctggcagattttggaatacaacgattgccgtgtccatggctaacatcttccgggggagctacctggccggagcgggcctgctcttttctattatgaaaaataccacaaacacccgcagaggcacagggaatatcggagagacccttggcgaaaagtggaagtcccggctgaacgccctggggaaaagcgagttccagatttataagaaatctggaatccaagaggttgacagaacgctcgctaaggaaggcatcaaacgcggggagacagatcatcacgccgtgagccggggatccgctaagctgagatggtttgtcgaacgcaacatggtgacccccgagggcaaagttgtggaccttggctgcgggcggggaggctggtcttactattgtgggggactgaagaatgtcagagaagtgaagggcctcaccaaagggggaccgggccatgaggagcctattcccatgagcacatacggctggaacctggtgcgcctgcagtccggggttgatgtcttcttcacaccccctgaaaagtgcgacacactcctttgtgatatcggagagagctcccccaatcctacgattgaagccggccggaccctgagagtgctgaacctcgtggagaattggctgaacaataacacacagttttgcatcaaagtccttaatccgtatatgccctctgttattgaaaagatggagaccctgcaacgcaaatacgggggagcgctcgtgcggaaccctctgagcagaaattccacacacgagatgtactgggtgtctaacgccaccggcaatatcgtcagctccgtgaacatgatctctcgcatgctgattaatcggttcacgatgaagcacaagaaagctacctatgaacccgacgttgatctcgggagcggaacaagaaacatcggcattgagtccgaaatccctaaccttgacattatcggcaagcgcattgagagaatcaaacaggaacatgagaccagctggcactacgaccaggatcatccctataagacatgggcctaccacgggtcttatgagaccaaacagacaggatccgctagctctatggtgaatggcgtcgtgcggctgctgaccaagccgtgggacgttgtgcctatggtcacgcaaatggccatgacagataccaccccctttgggcagcagcgcgtgttcaaggaaaaagtggacacaagaacgcaggagcctaaggaaggaaccaaaaagctcatgcggatcacagctgagtggctgtggaaagagcttggcaagaagaaaacccccagaatgtgtacacgggaagagtttacccgcaaggtcagatccaacgccgcgctgggggccgttttcacagatgaaaataaatggaaaagcgctcgggaggccgtggaagactctcgcttttgggagctcgtggatagagagcggaacctgcacctggaaggaaaatgcgagacctgtgtctacaatatgatgggcaagcgcgagaagaagctcggcgagttcgggaaggctaaaggatccagagccatttggtatatgtggctgggcgcccggtttcttgagttcgaggcgctggggtttctcaacgaggaccattggttcagccgcagaaattccctgagcggagtggaaggcgaggggcttcaccggctgggctacatcctccgcgatgtttctaagaaagaaggaggcgctatgtacgccgacgatacggccgggtgggacaccagaattacactggaggacctgaagaacgaagagatggtgaccaatcatatgaaaggagagcacaagaagctcgctgaagccatctttaaactgacatatcaaaacaaggtcgtgcgggttcagcgccctacccccagaggcacggtgatggatattatcagccggagagaccagcgcgggtccggacaggtcggcacatacgggcttaataccttcacaaacatggaggctcaactgatccggcagatggaaggcgagggaattttcaaatctatccagcatctcaccgtgacggaggaaattgccgttcaaaattggctggcgagagtgggccgcgagcggcttagcagaatggccatctccggggatgactgcgtcgtgaagccgctggatgaccgctttgcttctgccctcaccgctctgaacgatatgggaaaagtccggaaggacattcagcagtgggaacctagcagaggctggaatgattggacacaggtgcccttctgctcccaccactttcatgagctggttatgaaggacgggcgcgtgctcgtcgtgccctgtcggaaccaagatgaactgatcggcagagcccgcatctctcagggagcggggtggagccttaaagagaccgcctgcctgggcaagtcctatgctcagatgtggacactcatgtacttccaccggagagacctgcggcttgccgctaacgccatttgtagcgctgtgccttctcattgggttccgacctccagaacaacctggagcatccacgccaaacacgagtggatgacgacagaagatatgctggcggtgtggaatcgcgtctggattcaggagaacccctggatggaagacaagacccctgtggagtcttgggaagaggttccctatctcggaaaacgggaggaccaatggtgcggctccctgatcgggctgaccagcagagccacatgggctaagaatattcagaccgccatcaaccaggtgcgctccctcattggaaatgaagagtacacagattatatgccttctatgaagagatttcggcgcgaagaggaagaggccggcgtcctgtggtga

SEQ ID NO: 19932 - RNA, 9876 nt, synthetic construct
  misc_feature 1..9876: note = derived and/or modified CDS sequence (opt5) from DENV-2__EU569709__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgctacgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcatcaagttttcggcgccatctatggagcggctttttccggcgtgtcttggacaatgaaaattctgatcggggtcatcattacctggatcggaatgaacagccggtccaccagcctttctgtgtccctcgtgctggttggcgtcgtgacactgtacctcggggtgatggtccaggccgacagcggatgtgtggtttcttggaagaataaagaactgaagtgcggctccgggattttcatcaccgataacgtgcacacatggacggagcagtataagtttcagcctgaaagcccctccaaacttgcctctgctattcaaaaggcccacgaggaaggcatctgtggaatcagaagcgtcacccgcctggagaatctcatgtggaaacagattacaccggagctgaaccatatcctgtccgaaaatgaggtgaaacttaccattatgacaggcgacatcaaagggattatgcaggctggaaagcggtctctcagacctcagcccaccgaactgaaatacagctggaagacgtggggcaaggccaaaatgctgtccaccgagagccacaaccaaacattcctcatcgatgggcctgaaaccgcggagtgccccaatacaaaccgcgcctggaactctctggaggttgaagactatggatttggcgtgttctccaccaacatctggcttaagctgcgggagaaacaggacgtcttttgtgatagcaagctcatgtctgctgccattaaagacaatagagctgtgcatgccgatatgggctactggatcgaatccgcgctgaacgacacatggaagatggagaaggccagcttcattgaggttaaatcttgccactggcctaagagccacaccctgtggtccaatggggtgcttgaaagcgagatgatcattcccaaaaacttcgctggaccggtctctcagcataactatcgccctggctaccacacgcagacagccgggccctggcatctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtatggaatggaaattcggcccctgaaggagaaggaagagaacctcgttaattctctggtgaccgccggccacgggcaaatcgataactttagcctgggagtgcttggcatggccctcttcctggaagagatgctgagaacacgcgtcgggaccaaacatgctatcctcctggtggcggtttcctttgtgacgcttattaccggaaatatgtctttccgggacctgggcagagtcatggtgatggttggcgccacaatgaccgatgacatcgggatgggagtgacatacctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtatcagctggctgtgaccattatggccatcctctgcgtccctaatgcggtgattctgcaaaacgcttggaaggtgagctgtacaatcctcgccgccgtctccgttagccccctgcttctgacgtcttcccagcagaaagctgactggattcctctcgccctgaccatcaagggcctgaatcccacagctatctttcttaccacactgagccgcacctctaaaaagagatcctggccgctcaacgaggccgtgatggcggtggggatggtcagcattctggcctcttccctcctgaaaaatgacatccctatgacgggaccccttgtggctggcggcctgctgacagtttgctacgtgctcaccgggcggagcgccgatctggaacttgagcgcgctgccgacgtcaagtgggaggatcaggccgaaatttccggaagctctcctatcctgagcattaccatctccgaggacggctctatgagcattaaaaacgaagaggaggaacaaacactcaccatcctgatcagaacagggctcctggtgatttccggagttttccccgtgtctatcccgattacggctgcggcctggtatctttgggaggtcaagaagcagcgggctggcgtgctgtgggatgtcccttctccccctcccgtggggaaagccgaactggaggacggagcctaccgcatcaagcagagaggcatttttggctattcccagatcggggctggagtttacaaagaaggcaccttccacacaatgtggcacgtgaccagaggggccgtcctcatgcatcgcggaaagagaatcgagccctcctgggcggatgtgaaaaaggacctgattagctacggcgggggatggaaacttgagggcgaatggaaagagggcgaagaggttcaagtgctggctctcgaacctgggaagaatccgcgggccgtccagacaaaacccggactgtttaagaccaacacgggcaccatcggggccgtgtccctcgatttcagccctggaacatctggctcccccattgtggacagaaaagggaaggttgtcggactgtatggcaatggcgtggtgacccgcagcggggcttacgtctctgccatcgcgcagacagagaagtccattgaggataaccctgaaatcgaggacgatatcttccggaaaaagagacttaccattatggacctgcaccccggagctggcaaaacaaagcgctatctgcctgccatcgtgcgggaagccattaaaagagggctccgcacgctgatccttgctccgacccgggttgtggccgctgagatggaagaggccctgagaggactccccattcgctaccagacccctgcgatccgggccgagcataccggcagagaaattgtcgacctgatgtgtcacgctacctttacaatgcggctcctgagccccgtgcgcgttcctaactataatcttatcatcatggatgaggcccatttcacggaccccgcttccattgccgccagagggtacatctctacccgggtggaaatgggcgaggctgcgggaatttttatgacagccaccccgcctggcagccgcgatcccttcccccaatccaacgctcctatcatggacgaggaaagagagattcccgaacggagctggaactctgggcacgagtgggtcacagattttaagggaaagaccgtgtggttcgttccttccatcaaagccggcaacgacatcgccgcttgcctgagaaagaatgggaaaaaggtgattcagctgagccgcaaaacgtttgattctgaatatgtcaagacacgggccaacgactgggatttcgtggtgaccaccgacatcagcgagatgggagcgaattttagagctgagcgcgtcattgatccgcggagatgtatgaagcccgttatcctcacagacggcgaggaacgcgtgattctggccgggcctatgcccgtgacccactcctctgccgctcagcggagaggccgcatcggaagaaaccctaaaaatgaaaacgaccaatacatctacatgggcgagccccttgaaaatgatgaggactgcgcccattggaaggaggcgaaaatgctgctcgataacattaatacaccggaagggatcattcctagcatgttcgagcccgaacgggagaaggtcgacgccatcgatggagaatatcgcctgagaggcgaggctcggaaaacctttgtggacctgatgcgcagaggggatctccctgtttggcttgcctaccgggtggctgccgagggaattaactatgctgacagacgctggtgtttcgatggcatcaagaataaccagattctggaagagaacgtcgaagtggagatctggacgaaagagggggaacggaagaagctgaaacccagatggctcgacgcccgcatctactccgatcctctggcgcttaaggagttcaaagaatttgccgctggccggaagtctctgacactcaatctgattaccgagatgggaagactgcccacattcatgacccagaaagcccgggacgctctcgataaccttgccgttctgcacacggccgaagtgggcgggcgcgcttataatcatgcgctgagcgagctcccggagaccctggaaacacttctgctcctgaccctgctcgccacagtcaccggaggcatctttcttttcctgatgtccgggaagggaattggcaagatgacactgggcatgtgctgcatcattaccgctagcatcctcctgtggtacgcccagatccaacctcactggattgccgcttctatcattcttgagtttttcctgatcgtgctcctgattcccgaacccgagaaacagagaacgcctcaggacaaccagctgacatatgtcgtgatcgccatcctcaccgttgtggcggccaccatggctaatgaaatggggtttcttgagaagaccaagaaggacctgggactgggctccattatcacccaagagagcgaatccaacattctcgatatcgacctgcggccggcctctgcttggacactttacgccgtggcgacgaccttcgtcacacccatgctgcgccacagcattgaaaatagctctgttaacgtgagcctcaccgccatcgctaatcaggccacagtgctgatggggctgggaagaggctggcctctctccaaaatggatattggggtcccccttctggctatcggatgttacagccaggtgaaccctatcaccctgacggccgctctcctgcttctggttgcccattatgcgattatcggccccggcctccaggccaaggctacccgggaagcccaaaagcgcgctgccgccgggattatgaaaaatcctacagtggacggaatcaccgtcattgatctggagccgatcccctacgaccctaagtttgaaaaacagctgggccaggtgatgctccttgtcctgtgcgtgacacaggttctgatgatgagaaccacgtgggcgctctgtgaggctctgacacttgccaccgggcccatctctacactgtgggagggaaaccctggccggttctggaataccaccattgctgtgtccatggccaacatctttcgcgggagctatctcgccggagctggcctgctgttctctattatgaagaatacaacgaacaccagacggggcacagggaatatcggagaaaccctcggcgagaaatggaagtccagacttaacgccctgggaaagagcgaatttcaaatttacaaaaagtctggaatccaggaggtcgatcgcacactggcgaaagagggcatcaagagaggggaaaccgaccaccatgccgtgagcagaggatccgctaaactccgctggttcgttgagcggaacatggtgacgcccgaaggcaaggtcgtggatctgggctgcgggagaggaggctggtcttattactgtgggggacttaaaaatgtgcgcgaggttaagggcctgacaaaagggggaccgggccacgaggagcctattcccatgagcacctatggctggaacctcgtccggctgcagtccggggtggacgtgttctttacaccccctgagaaatgcgatacactgctctgtgacatcggagaaagctcccccaatcctaccattgaggccggcagaacacttcgcgtcctgaacctggttgaaaattggctcaacaataacacgcaattctgcatcaaggtgctgaatccgtacatgccctctgtgattgagaaaatggaaacccttcagcggaagtacgggggagctctggtcagaaaccctctcagccgcaattccacacatgagatgtattgggtgtctaacgccaccggcaatatcgttagctccgtgaacatgatctctcggatgctgattaatagatttacaatgaaacacaagaaggcgacctacgagcccgatgtcgacctggggagcggaacgcgcaacatcggcattgaaaacgagatccctaatctcgacattatcggcaaaagaattgaaaagatcaaacaggagcacgaaacctcctggcattatgatcaggaccacccctacaagacatgggcctatcatgggagctacgagaccaaacaaacaggatctgcttccagcatggtgaacggcgttgtgcggcttctgaccaagccgtgggatgtcgtgcctatggtgacacagatggccatgaccgacacgacacccttcgggcagcagcgcgtctttaaggagaaagttgataccagaacccaagaacctaaggagggaaccaagaagctgatgcggatcacggctgaatggctctggaaagagctgggcaagaagaaaacccccagaatgtgtacacgggaggagttcacccgcaaggtgagatctaatgccgctcttggggccatttttacagacgagaacaaatggaagtccgcgcgggaagccgtggaggatagccgcttctgggaactggtcgacagagagcggaatctccacctggagggaaaatgcgaaacctgtgtgtataacatgatgggcaagcgcgagaaaaagctgggcgaatttgggaaggctaaaggatctagagccatctggtacatgtggctcggcgctcggttcctggagtttgaagcccttgggttcctgaatgaggatcactggttttcccgcggaaacagcctctccggcgttgagggggaaggcctgcataaacttggatacattctgagagacgtgagcaaaaaggagggcggggccatgtatgcggatgacacagctggatgggacacccggatcacgctcgaagatctgaaaaatgaggaaatggtcaccaaccacatgaagggcgagcataagaaactggccgaggccattttcaagctcacataccagaataaagtggttcgcgtgcagagacctacaccccgggggacagtcatggacatcatctctcgcaaggatcagagaggaagcggccaagtggggacctatggcctgaacacgttcacaaatatggaagctcagcttattcggcagatggagggagaaggcatctttaaatccattcaacacctgaccgttacagaggagatcgccgtgcagaactggctcgctagagtcgggcgcgaacggctgtctagaatggccattagcggagacgattgcgtggtcaagccgcttgacgatcgcttcgcgtccgccctgaccgctctcaatgacatgggcaaggtgcggaaagatatccagcagtgggagccttctagagggtggaacgactggacgcaagttcccttttgcagccatcacttccacgaactggtgatgaaggatggacgcgtcctggtggtgccctgtcggaaccaggacgagctcatcggcagagcccgcatttcccagggggctggctggtctctgaaagaaaccgcctgccttggaaagagctacgcgcagatgtggacactgatgtattttcatcggagagatctccgcctggccgctaatgccatctgttccgctgttcctagccactgggtgccgacctctcggacaacctggtccattcatgccaaacacgagtggatgacaaccgaggacatgcttgctgtctggaacagagtgtggatccaagaaaatccctggatggaggacaagacgcctgttgaaagctgggaggaagtgccctacctgggcaagcgggaggatcagtggtgcgggtctctcattggactgacatccagagccacctgggcgaaaaacatccagaccgccattaatcaggtccgcagcctgatcggcaacgaggaatatacagactacatgccttccatgaagcggttcagaaaagaggaagaggaagctggggtgctctggtga

SEQ ID NO: 19933 - RNA, 9876 nt, synthetic construct
  misc_feature 1..9876: note = derived and/or modified CDS sequence (opt5) from DENV-2__EU596485__SS-prME
  source 1..9876: mol_type = other RNA
accgccggcgtgatcattatgctgatccccaccgctatggccttccacctcacgacccggaatggggaacctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgatagccataaccaaacattcctcatcgacgggcctgagaccgcggaatgccccaatacaaaccgcgcctggaactctctggaggttgaggactacggatttggcgtgttctccaccaacatctggcttaagctgcgggaaaaacaggatgtcttttgtgacagcaagctcatgtctgctgccattaaagataatagagctgtgcacgccgacatgggctattggatcgagtccgcgctgaacgatacatggaagatggaaaaggccagcttcattgaggttaaatcttgccactggcctaagagccataccctgtggtccaatggggtgcttgagagcgaaatgatcattcccaaaaacttcgctggaccggtctctcagcacaactaccgccctggctatcatacgcagacagccgggccctggcacctcggaaagctggagatggactttgatttctgtgaaggcaccaccgtggtggtcacagaggactgcgggaatcggggaccctccctgagaaccacgacagctagcggcaaactcatcaccgaatggtgctgtcggtcctgcacactgcctccgcttcgctacagaggcgaggatgggtgttggtacggaatggagattcggcccctgaaggaaaaggaggaaaacctcgttaattctctggtgaccgccggccatgggcaaatcgacaactttagcctgggagtgcttggcatggccctcttcctggaggaaatgctgagaacacgcgtcgggaccaaacacgctatcctcctggtggcggtttcctttgtgacgcttattaccggaaatatgtctttccgggatctgggcagagtcatggtgatggttggcgccacaatgaccgacgatatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgagacaatcctggaactcaccgacgccctggccctgggaatgatggtgcttaaaatcgttcggaacatggagaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaagccgtgatggcggtggggatggtctctattctcgcctccagcctgctcaaaaatgatatccctatgacgggacccctggtggctggcggccttctgacagtttgctatgtgctgaccgggcggtccgccgacctcgagctggaacgcgctgccgatgtcaagtgggaggaccaggccgagattagcggatctagccctatcctttccattaccatctctgaagatggcagcatgtccattaaaaacgaggaagaggagcaaacactgaccatcctcatcagaacagggctgctcgtgatttctggagttttccccgtgagcatcccgattacggctgcggcctggtacctgtgggaagtcaagaagcagcgggctggcgtgctttgggacgtcccttctccccctcccgtggggaaagccgagctggaagatggagcctatcgcatcaagcagagaggcatttttggctacagccagatcggggctggagtttataaagagggcaccttccacacaatgtggcatgtgaccagaggggccgtcctgatgcaccgcggaaagagaatcgaacccagctgggcggacgtgaaaaaggatctcatttcctacggcgggggatggaagctggagggcgagtggaaagaaggcgaggaagttcaagtgcttgctctggagcctgggaagaatccgcgggccgtccagacaaaacccggactctttaagaccaacacgggcaccatcggggccgtgagcctggacttctctcctggaacatccggcagccccattgtggatagaaaagggaaggttgtcggactctacggcaatggcgtggtgacccgctctggggcttatgtctccgccatcgcgcagacagaaaagagcattgaggacaaccctgagatcgaagatgacatcttccggaaaaagagactgaccattatggaccttcatcccggagctggcaaaacaaagcgctacctgcctgccatcgtgcgggaggccattaaaagagggctgcgcacgctcatcctggctccgacccgggttgtggccgctgaaatggaggaagcccttagaggactgcccattcgctatcagacccctgcgatccgggccgagcacaccggcagagagattgtcgatctcatgtgtcatgctacctttacaatgcggctgctctcccccgtgcgcgttcctaactacaatctgatcatcatggacgaagcccacttcacggatcccgcttctattgccgccagagggtatatcagcacccgggtggagatgggcgaagctgcgggaatttttatgacagccaccccgcctggctcccgcgaccccttcccccaaagcaacgctcctatcatggatgaggagagagaaattcccgagcggtcttggaactccgggcacgaatgggtcacagactttaagggaaagaccgtgtggttcgttcctagcatcaaagccggcaacgatatcgccgcttgccttagaaagaatgggaaaaaggtgattcagctgtctcgcaaaacgtttgacagcgagtacgtcaagacacgggccaacgattgggacttcgtggtgaccaccgatatctccgaaatgggagcgaattttagagctgagcgcgtcattgacccgcggagatgtatgaagcccgttatcctgacagacggcgaggaacgcgtgattctcgccgggcctatgcccgtgacccattctagcgccgctcagcggagaggccgcatcggaagaaaccctaaaaatgagaacgatcaatatatctacatgggcgaacccctggagaatgacgaagattgcgcccactggaaggaggcgaaaatgcttctggacaacattaatacaccggaggggatcattccttccatgttcgaacccgagcgggaaaaggtcgatgccatcgacggagagtaccgcctcagaggcgaagctcggaaaacctttgtggatctgatgcgcagaggggacctgcctgtttggctcgcctatcgggtggctgccgagggaattaactacgctgatagacgctggtgtttcgacggcatcaagaataaccagattcttgaggaaaacgtcgaggtggaaatctggacgaaagagggggagcggaagaagctgaaacccagatggctggatgcccgcatctattctgaccctctcgcgctgaaggagttcaaagagtttgccgctggcagaaagagccttacactgaatctcattaccgaaatgggacggctgcccacattcatgacccagaaagcccgggatgctctggacaacctcgccgttcttcatacggccgaggtgggcgggcgcgcttacaatcacgcgctgtccgaactgccggagaccctcgagacactgcttctgctcaccctgctggccgctgtcacaggaggcatctttctcttccttatgagcgggaagggaattggcaagatgaccctgggcatgtgctgcatcattacagcctctatcctgctctggtatgcccagatccaacctcactggattgctgcctccatcattctggaatttttccttatcgtgctgctcattcccgagcccgaaaaacagagaacccctcaggacaaccagctgacgtacgtcgtgatcgcgatcctgacagttgtggccgctaccatggccaatgagatggggtttctcgaaaagaccaaaaaggatcttggactgggcagcattatcacacaagagtccgagtctaacattctggacatcgatctccggccggctagcgcctggaccctgtatgcggtggccacaacgttcgtcacccccatgcttcgccattccattgaaaattctagcgttaacgtgtccctgacagctatcgccaatcaggctaccgtgctcatggggctgggaagaggctggcctctgagcaaaatggacattggggtccccctccttgccatcggatgttactctcaggtgaaccctatcacactgaccgctgccctgctcctgcttgttgcgcactacgccattatcggccccggcctgcaggctaaggccacgcgggaggctcaaaagcgcgccgccgcggggattatgaaaaatcctaccgtggatggaatcacagtcattgacctcgaaccgatcccctatgatcctaagtttgagaaacagctgggccaggtgatgctgctcgtcctttgcgtgacccaggttctgatgatgagaacaacctgggctctgtgtgaagccctcacgctggctacagggcccatctccaccctttgggagggaaaccctggccggttctggaatacaaccattgccgtgagcatggccaacatctttcgcgggtcttacctggctggagccggcctcctgttctccattatgaagaataccacaaacacgagacggggcaccgggaatatcggagagacactgggcgaaaaatggaagtccagactcaacgcgcttgggaagtctgagtttcaaatttataaaaagagcggaatccaggaagtcgaccgcaccctggccaaagagggcatcaagagaggggaaacagatcatcacgctgtgtcccggggatctgccaaactgcgctggttcgttgaacggaacatggtgacccccgagggcaaggtcgtggacctcggctgcgggagaggaggctggagctactattgtgggggactgaaaaatgtgcgcgaagttaagggccttacgaaagggggaccgggccatgaggaacctattcccatgtccacatacggctggaacctggtccggctccagagcggggtggatgtgttctttacaccccctgagaaatgcgacaccctgctgtgtgatatcggagagtcctctcccaatcctacaattgaagctggcagaaccctccgcgtccttaacctggttgagaattggctgaacaataacacacaattctgcatcaaggtgctcaatccgtatatgcccagcgtgattgagaagatggagacgctgcagcggaagtacgggggagcccttgtcagaaaccctctgtcccgcaattctacccacgaaatgtactgggtgagcaacgcgacaggcaatatcgtttcctctgtgaacatgatcagccggatgctcattaatagatttaccatgaaacacaagaaggccacatatgagcccgacgtcgacctggggtccggaacccgcaacatcggcattgagaacgaaatccctaatctggatattatcggcaaaagaattgagaagatcaaacaggaacatgagacgagctggcactacgaccaggatcatccctataagacctgggcttaccacgggtcttatgaaacaaaacaaaccggatccgccagctctatggtgaacggcgttgtgcggctccttacaaagccgtgggacgtcgtgcctatggtgacccagatggctatgacagataccacgcccttcgggcagcagcgcgtctttaaggagaaagttgacacaagaacccaagagcctaaggaaggaaccaaaaagctgatgcggatcacagccgagtggctgtggaaagaactcggcaagaagaaaacgcccagaatgtgtacccgggaggagttcgctcgcaaggtgagatccaatgccgcgctgggggccatttttacagatgaaaacaaatggaaaagcgctcgggaggccgtggaagactctcgcttctgggagcttgtcgatagagaacggaatctgcacctcgagggaaaatgcgagacctgtgtgtacaacatgatgggcaagcgcgagaagaagctgggcgagtttgggaaggctaaaggatccagagccatctggtatatgtggctgggcgcccggttcctcgaatttgaggcgctggggttccttaatgaagaccattggtttagccgcggaaactccctgagcggcgttgagggggagggcctccacaagctgggatacattcttagagatgtgtctaaaaaggaaggcggggctatgtacgccgacgacacagccggatgggatacccggatcacactggaggacctcaaaaatgaagagatggtcaccaaccatatgaagggcgaacacaagaaactggctgaggccattttcaagctgacgtatcagaataaagtggttcgcgtgcagagacctacaccccgggggacagtcatggatatcatcagccgcaaggaccagagaggatccggccaagtggggacctacggcctcaacacattcaccaatatggaggctcagctgattcggcagatggaaggagagggcatctttaaatctattcaacatcttacggttacagaagagatcgccgtgcagaactggctggcgagagtcgggcgcgagcggctcagcagaatggccatttccggagatgactgcgtggtcaagccgctggatgaccgcttcgcttctgcccttaccgctctgaatgatatgggcaaggtgcggaaagacatccagcagtgggaacctagcagagggtggaacgattggacacaagttcccttttgctcccaccacttccatgagctcgtgatgaaggacggacgcgtcctggtggtgccctgtcggaaccaggatgaactgatcggcagagcccgcatttctcagggggcgggctggagcctcaaagagaccgcctgcctgggaaagtcctatgctcagatgtggacgcttatgtactttcaccggagagacctgcgcctcgccgctaatgccatctgtagcgctgttccttctcattgggtgccgacctcccggacaacctggagcattcacgccaaacacgaatggatgacaaccgaggacatgctggcggtctggaacagagtgtggatccaagagaatccctggatggaagataagacacctgttgagtcttgggaagaggtgccctatcttggcaagcgggaagaccagtggtgcgggtccctgattggactcaccagcagagccacgtgggctaaaaacatccagacagccattaatcaggtccgctccctgatcggcaacgaggagtacaccgattatatgccttctatgaagcggttcagaaaagaagaggaagaggccggggtgctgtggtga

SEQ ID NO: 19934 - RNA, 9876 nt, synthetic construct
  misc_feature 1..9876: note = derived and/or modified CDS sequence (opt5) from DENV-2__EU569710__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgacgttcattcttctgaccgccgtggcgcctagcatgacaatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacggaggctaagcagcctgccattctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgctacgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcatcaagttttcggcgccatctatggagcggctttttccggcgtgtcttggacaatgaaaattctgatcggggtcatcattacctggatcggaatgaacagccggtccaccagcctttctgtgtccctcgtgctggttggcgtcgtgacactgtacctcggggtgatggtccaggccgacagcggatgtgtggtttcttggaagaataaagaactgaagtgcggctccgggattttcatcaccgataacgtgcacacatggacggagcagtataagtttcagcctgaaagcccctccaaacttgcctctgctattcaaaaggcccacgaggaaggcatctgtggaatcagaagcgtcacccgcctggagaatctcatgtggaaacagattacaccggagctgaaccatatcctgtccgaaaatgaggtgaaacttaccattatgacaggcgacatcaaagggattatgcaggctggaaagcggtctctcagacctcagcccaccgaactgaaatacagctggaagacgtggggcaaggccaaaatgctgtccaccgagagccacaaccaaacattcctcatcgatgggcctgaaaccgcggagtgccccaatacaaaccgcgcctggaactctctggaggttgaagactatggatttggcgtgttctccaccaacatctggcttaagctgcgggagaaacaggacgtcttttgtgatagcaagctcatgtctgctgccattaaagacaatagagctgtgcatgccgatatgggctactggatcgaatccgcgctgaacgacacatggaagatggagaaggccagcttcattgaggttaaatcttgccactggcctaagagccacaccctgtggtccaatggggtgcttgaaagcgagatgatcattcccaaaaacttcgctggaccggtctctcagcataactatcgccctggctaccacacgcagacagccgggccctggcatctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtatggaatggaaattcggcccctgaaggagaaggaagagaacctcgttaattctctggtgaccgccggccacgggcaaatcgataactttagcctgggagtgcttggcatggccctcttcctggaagagatgctgagaacacgcgtcgggaccaaacatgctatcctcctggtggcggtttcctttgtgacgcttattaccggaaatatgtctttccgggacctgggcagagtcatggtgatggttggcgccacaatgaccgatgacatcgggatgggagtgacatacctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtatcagctggctgtgaccattatggccatcctctgcgtccctaatgcggtgattctgcaaaacgcttggaaggtgagctgtacaatcctcgccgccgtctccgttagccccctgcttctgacgtcttcccagcagaaagctgactggattcctctcgccctgaccatcaagggcctgaatcccacagctatctttcttaccacactgagccgcacctctaaaaagagatcctggccgctcaacgaggccgtgatggcggtggggatggtcagcattctggcctcttccctcctgaaaaatgacatccctatgacgggaccccttgtggctggcggcctgctgacagtttgctacgtgctcaccgggcggagcgccgatctggaacttgagcgcgctgccgacgtcaagtgggaggatcaggccgaaatttccggaagctctcctatcctgagcattaccatctccgaggacggctctatgagcattaaaaacgaagaggaggaacaaacactcaccatcctgatcagaacagggctcctggtgatttccggagttttccccgtgtctatcccgattacggctgcggcctggtatctttgggaggtcaagaagcagcgggctggcgtgctgtgggatgtcccttctccccctcccgtggggaaagccgaactggaggacggagcctaccgcatcaagcagagaggcatttttggctattcccagatcggggctggagtttacaaagaaggcaccttccacacaatgtggcacgtgaccagaggggccgtcctcatgcatcgcggaaagagaatcgagccctcctgggcggatgtgaaaaaggacctgattagctacggcgggggatggaaacttgagggcgaatggaaagagggcgaagaggttcaagtgctggctctcgaacctgggaagaatccgcgggccgtccagacaaaacccggactgtttaagaccaacacgggcaccatcggggccgtgtccctcgatttcagccctggaacatctggctcccccattgtggacagaaaagggaaggttgtcggactgtatggcaatggcgtggtgacccgcagcggggcttacgtctctgccatcgcgcagacagagaagtccattgaggataaccctgaaatcgaggacgatatcttccggaaaaagagacttaccattatggacctgcaccccggagctggcaaaacaaagcgctatctgcctgccatcgtgcgggaagccattaaaagagggctccgcacgctgatccttgctccgacccgggttgtggccgctgagatggaagaggccctgagaggactccccattcgctaccagacccctgcgatccgggccgagcataccggcagagaaattgtcgacctgatgtgtcacgctacctttacaatgcggctcctgagccccgtgcgcgttcctaactataatcttatcatcatggatgaggcccatttcacggaccccgcttccattgccgccagagggtacatctctacccgggtggaaatgggcgaggctgcgggaatttttatgacagccaccccgcctggcagccgcgatcccttcccccaatccaacgctcctatcatggacgaggaaagagagattcccgaacggagctggaactctgggcacgagtgggtcacagattttaagggaaagaccgtgtggttcgttccttccatcaaagccggcaacgacatcgccgcttgcctgagaaagaatgggaaaaaggtgattcagctgagccgcaaaacgtttgattctgaatatgtcaagacacgggccaacgactgggatttcgtggtgaccaccgacatcagcgagatgggagcgaattttagagctgagcgcgtcattgatccgcggagatgtatgaagcccgttatcctcacagacggcgaggaacgcgtgattctggccgggcctatgcccgtgacccactcctctgccgctcagcggagaggccgcatcggaagaaaccctaaaaatgaaaacgaccaatacatctacatgggcgagccccttgaaaatgatgaggactgcgcccattggaaggaggcgaaaatgctgctcgataacattaatacaccggaagggatcattcctagcatgttcgagcccgaacgggagaaggtcgacgccatcgatggagaatatcgcctgagaggcgaggctcggaaaacctttgtggacctgatgcgcagaggggatctccctgtttggcttgcctaccgggtggctgccgagggaattaactatgctgacagacgctggtgtttcgatggcatcaagaataaccagattctggaagagaacgtcgaagtggagatctggacgaaagagggggaacggaagaagctgaaacccagatggctcgacgcccgcatctactccgatcctctggcgcttaaggagttcaaagaatttgccgctggccggaagtctctgacactcaatctgattaccgagatgggaagactgcccacattcatgacccagaaagcccgggacgctctcgataaccttgccgttctgcacacggccgaagtgggcgggcgcgcttataatcatgcgctgagcgagctcccggagaccctggaaacacttctgctcctgaccctgctcgccacagtcaccggaggcatctttcttttcctgatgtccgggaagggaattggcaagatgacactgggcatgtgctgcatcattaccgctagcatcctcctgtggtacgcccagatccaacctcactggattgccgcttctatcattcttgagtttttcctgatcgtgctcctgattcccgaacccgagaaacagagaacgcctcaggacaaccagctgacatatgtcgtgatcgccatcctcaccgttgtggcggccaccatggctaatgaaatggggtttcttgagaagaccaagaaggacctgggactgggctccattatcacccaagagagcgaatccaacattctcgatatcgacctgcggccggcctctgcttggacactttacgccgtggcgacgaccttcgtcacacccatgctgcgccacagcattgaaaatagctctgttaacgtgagcctcaccgccatcgctaatcaggccacagtgctgatggggctgggaagaggctggcctctctccaaaatggatattggggtcccccttctggctatcggatgttacagccaggtgaaccctatcaccctgacggccgctctcctgcttctggttgcccattatgcgattatcggccccggcctccaggccaaggctacccgggaagcccaaaagcgcgctgccgccgggattatgaaaaatcctacagtggacggaatcaccgtcattgatctggagccgatcccctacgaccctaagtttgaaaaacagctgggccaggtgatgctccttgtcctgtgcgtgacacaggttctgatgatgagaaccacgtgggcgctctgtgaggctctgacacttgccaccgggcccatctctacactgtgggagggaaaccctggccggttctggaataccaccattgctgtgtccatggccaacatctttcgcgggagctatctcgccggagctggcctgctgttctctattatgaagaatacaacgaacaccagacggggcacagggaatatcggagaaaccctcggcgagaaatggaagtccagacttaacgccctgggaaagagcgaatttcaaatttacaaaaagtctggaatccaggaggtcgatcgcacactggcgaaagagggcatcaagagaggggaaaccgaccaccatgccgtgagcagaggatccgctaaactccgctggttcgttgagcggaacatggtgacgcccgaaggcaaggtcgtggatctgggctgcgggagaggaggctggtcttattactgtgggggacttaaaaatgtgcgcgaggttaagggcctgacaaaagggggaccgggccacgaggagcctattcccatgagcacctatggctggaacctcgtccggctgcagtccggggtggacgtgttctttacaccccctgagaaatgcgatacactgctctgtgacatcggagaaagctcccccaatcctaccattgaggccggcagaacacttcgcgtcctgaacctggttgaaaattggctcaacaataacacgcaattctgcatcaaggtgctgaatccgtacatgccctctgtgattgagaaaatggaaacccttcagcggaagtacgggggagctctggtcagaaaccctctcagccgcaattccacacatgagatgtattgggtgtctaacgccaccggcaatatcgttagctccgtgaacatgatctctcggatgctgattaatagatttacaatgaaacacaagaaggcgacctacgagcccgatgtcgacctggggagcggaacgcgcaacatcggcattgaaaacgagatccctaatctcgacattatcggcaaaagaattgaaaagatcaaacaggagcacgaaacctcctggcattatgatcaggaccacccctacaagacatgggcctatcatgggagctacgagaccaaacaaacaggatctgcttccagcatggtgaacggcgttgtgcggcttctgaccaagccgtgggatgtcgtgcctatggtgacacagatggccatgaccgacacgacacccttcgggcagcagcgcgtctttaaggagaaagttgataccagaacccaagaacctaaggagggaaccaagaagctgatgcggatcacggctgaatggctctggaaagagctgggcaagaagaaaacccccagaatgtgtacacgggaggagttcacccgcaaggtgagatctaatgccgctcttggggccatttttacagacgagaacaaatggaagtccgcgcgggaagccgtggaggatagccgcttctgggaactggtcgacagagagcggaatctccacctggagggaaaatgcgaaacctgtgtgtataacatgatgggcaagcgcgagaaaaagctgggcgaatttgggaaggctaaaggatctagagccatctggtacatgtggctcggcgctcggttcctggagtttgaagcccttgggttcctgaatgaggatcactggttttcccgcggaaacagcctctccggcgttgagggggaaggcctgcataaacttggatacattctgagagacgtgagcaaaaaggagggcggggccatgtatgcggatgacacagctggatgggacacccggatcacgctcgaagatctgaaaaatgaggaaatggtcaccaaccacatgaagggcgagcataagaaactggccgaggccattttcaagctcacataccagaataaagtggttcgcgtgcagagacctacaccccgggggacagtcatggacatcatctctcgcaaggatcagagaggaagcggccaagtggggacctatggcctgaacacgttcacaaatatggaagctcagcttattcggcagatggagggagaaggcatctttaaatccattcaacacctgaccgttacagaggagatcgccgtgcagaactggctcgctagagtcgggcgcgaacggctgtctagaatggccattagcggagacgattgcgtggtcaagccgcttgacgatcgcttcgcgtccgccctgaccgctctcaatgacatgggcaaggtgcggaaagatatccagcagtgggagccttctagagggtggaacgactggacgcaagttcccttttgcagccatcacttccacgaactggtgatgaaggatggacgcgtcctggtggtgccctgtcggaaccaggacgagctcatcggcagagcccgcatttcccagggggctggctggtctctgaaagaaaccgcctgccttggaaagagctacgcgcagatgtggacactgatgtattttcatcggagagatctccgcctggccgctaatgccatctgttccgctgttcctagccactgggtgccgacctctcggacaacctggtccattcatgccaaacacgagtggatgacaaccgaggacatgcttgctgtctggaacagagtgtggatccaagaaaatccctggatggaggacaagacgcctgttgaaagctgggaggaagtgccctacctgggcaagcgggaggatcagtggtgcgggtctctcattggactgacatccagagccacctgggcgaaaaacatccagaccgccattaatcaggtccgcagcctgatcggcaacgaggaatatacagactacatgccttccatgaagcggttcagaaaagaggaagaggaagctggggtgctctggtga

SEQ ID NO: 19935 - RNA, 9876 nt, synthetic construct
  misc_feature 1..9876: note = derived and/or modified CDS sequence (opt5) from DENV-2__EU596486__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgctacgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcatcaagttttcggcgccatctatggagcggctttttccggcgtgtcttggacaatgaaaattctgatcggggtcatcattacctggatcggaatgaacagccggtccaccagcctttctgtgtccctcgtgctggttggcgtcgtgacactgtacctcggggtgatggtccaggccgacagcggatgtgtggtttcttggaagaataaagaactgaagtgcggctccgggattttcatcaccgataacgtgcacacatggacggagcagtataagtttcagcctgaaagcccctccaaacttgcctctgctattcaaaaggcccacgaggaaggcatctgtggaatcagaagcgtcacccgcctggagaatctcatgtggaaacagattacaccggagctgaaccatatcctgtccgaaaatgaggtgaaacttaccattatgacaggcgacatcaaagggattatgcaggctggaaagcggtctctcagacctcagcccaccgaactgaaatacagctggaagacgtggggcaaggccaaaatgctgtccaccgagagccacaaccaaacattcctcatcgatgggcctgaaaccgcggagtgccccaatacaaaccgcgcctggaactctctggaggttgaagactatggatttggcgtgttctccaccaacatctggcttaagctgcgggagaaacaggacgtcttttgtgatagcaagctcatgtctgctgccattaaagacaatagagctgtgcatgccgatatgggctactggatcgaatccgcgctgaacgacacatggaagatggagaaggccagcttcattgaggttaaatcttgccactggcctaagagccacaccctgtggtccaatggggtgcttgaaagcgagatgatcattcccaaaaacttcgctggaccggtctctcagcataactatcgccctggctaccacacgcagacagccgggccctggcatctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtatggaatggaaattcggcccctgaaggagaaggaagagaacctcgttaattctctggtgaccgccggccacgggcaaatcgataactttagcctgggagtgcttggcatggccctcttcctggaagagatgctgagaacacgcgtcgggaccaaacatgctatcctcctggtggcggtttcctttgtgacgcttattaccggaaatatgtctttccgggacctgggcagagtcatggtgatggttggcgccacaatgaccgatgacatcgggatgggagtgacatacctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtatcagctggctgtgaccattatggccatcctctgcgtccctaatgcggtgattctgcaaaacgcttggaaggtgagctgtacaatcctcgccgccgtctccgttagccccctgcttctgacgtcttcccagcagaaagctgactggattcctctcgccctgaccatcaagggcctgaatcccacagctatctttcttaccacactgagccgcacctctaaaaagagatcctggccgctcaacgaggccgtgatggcggtggggatggtcagcattctggcctcttccctcctgaaaaatgacatccctatgacgggaccccttgtggctggcggcctgctgacagtttgctacgtgctcaccgggcggagcgccgatctggaacttgagcgcgctgccgacgtcaagtgggaggatcaggccgaaatttccggaagctctcctatcctgagcattaccatctccgaggacggctctatgagcattaaaaacgaagaggaggaacaaacactcaccatcctgatcagaacagggctcctggtgatttccggagttttccccgtgtctatcccgattacggctgcggcctggtatctttgggaggtcaagaagcagcgggctggcgtgctgtgggatgtcccttctccccctcccgtggggaaagccgaactggaggacggagcctaccgcatcaagcagagaggcatttttggctattcccagatcggggctggagtttacaaagaaggcaccttccacacaatgtggcacgtgaccagaggggccgtcctcatgcatcgcggaaagagaatcgagccctcctgggcggatgtgaaaaaggacctgattagctacggcgggggatggaaacttgagggcgaatggaaagagggcgaagaggttcaagtgctggctctcgaacctgggaagaatccgcgggccgtccagacaaaacccggactgtttaagaccaacacgggcaccatcggggccgtgtccctcgatttcagccctggaacatctggctcccccattgtggacagaaaagggaaggttgtcggactgtatggcaatggcgtggtgacccgcagcggggcttacgtctctgccatcgcgcagacagagaagtccattgaggataaccctgaaatcgaggacgatatcttccggaaaaagagacttaccattatggacctgcaccccggagctggcaaaacaaagcgctatctgcctgccatcgtgcgggaagccattaaaagagggctccgcacgctgatccttgctccgacccgggttgtggccgctgagatggaagaggccctgagaggactccccattcgctaccagacccctgcgatccgggccgagcataccggcagagaaattgtcgacctgatgtgtcacgctacctttacaatgcggctcctgagccccgtgcgcgttcctaactataatcttatcatcatggatgaggcccatttcacggaccccgcttccattgccgccagagggtacatctctacccgggtggaaatgggcgaggctgcgggaatttttatgacagccaccccgcctggcagccgcgatcccttcccccaatccaacgctcctatcatggacgaggaaagagagattcccgaacggagctggaactctgggcacgagtgggtcacagattttaagggaaagaccgtgtggttcgttccttccatcaaagccggcaacgacatcgccgcttgcctgagaaagaatgggaaaaaggtgattcagctgagccgcaaaacgtttgattctgaatatgtcaagacacgggccaacgactgggatttcgtggtgaccaccgacatcagcgagatgggagcgaattttagagctgagcgcgtcattgatccgcggagatgtatgaagcccgttatcctcacagacggcgaggaacgcgtgattctggccgggcctatgcccgtgacccactcctctgccgctcagcggagaggccgcatcggaagaaaccctaaaaatgaaaacgaccaatacatctacatgggcgagccccttgaaaatgatgaggactgcgcccattggaaggaggcgaaaatgctgctcgataacattaatacaccggaagggatcattcctagcatgttcgagcccgaacgggagaaggtcgacgccatcgatggagaatatcgcctgagaggcgaggctcggaaaacctttgtggacctgatgcgcagaggggatctccctgtttggcttgcctaccgggtggctgccgagggaattaactatgctgacagacgctggtgtttcgatggcatcaagaataaccagattctggaagagaacgtcgaagtggagatctggacgaaagagggggaacggaagaagctgaaacccagatggctcgacgcccgcatctactccgatcctctggcgcttaaggagttcaaagaatttgccgctggccggaagtctctgacactcaatctgattaccgagatgggaagactgcccacattcatgacccagaaagcccgggacgctctcgataaccttgccgttctgcacacggccgaagtgggcgggcgcgcttataatcatgcgctgagcgagctcccggagaccctggaaacacttctgctcctgaccctgctcgccacagtcaccggaggcatctttcttttcctgatgtccgggaagggaattggcaagatgacactgggcatgtgctgcatcattaccgctagcatcctcctgtggtacgcccagatccaacctcactggattgccgcttctatcattcttgagtttttcctgatcgtgctcctgattcccgaacccgagaaacagagaacgcctcaggacaaccagctgacatatgtcgtgatcgccatcctcaccgttgtggcggccaccatggctaatgaaatggggtttcttgagaagaccaagaaggacctgggactgggctccattatcacccaagagagcgaatccaacattctcgatatcgacctgcggccggcctctgcttggacactttacgccgtggcgacgaccttcgtcacacccatgctgcgccacagcattgaaaatagctctgttaacgtgagcctcaccgccatcgctaatcaggccacagtgctgatggggctgggaagaggctggcctctctccaaaatggatattggggtcccccttctggctatcggatgttacagccaggtgaaccctatcaccctgacggccgctctcctgcttctggttgcccattatgcgattatcggccccggcctccaggccaaggctacccgggaagcccaaaagcgcgctgccgccgggattatgaaaaatcctacagtggacggaatcaccgtcattgatctggagccgatcccctacgaccctaagtttgaaaaacagctgggccaggtgatgctccttgtcctgtgcgtgacacaggttctgatgatgagaaccacgtgggcgctctgtgaggctctgacacttgccaccgggcccatctctacactgtgggagggaaaccctggccggttctggaataccaccattgctgtgtccatggccaacatctttcgcgggagctatctcgccggagctggcctgctgttctctattatgaagaatacaacgaacaccagacggggcacagggaatatcggagaaaccctcggcgagaaatggaagtccagacttaacgccctgggaaagagcgaatttcaaatttacaaaaagtctggaatccaggaggtcgatcgcacactggcgaaagagggcatcaagagaggggaaaccgaccaccatgccgtgagcagaggatccgctaaactccgctggttcgttgagcggaacatggtgacgcccgaaggcaaggtcgtggatctgggctgcgggagaggaggctggtcttattactgtgggggacttaaaaatgtgcgcgaggttaagggcctgacaaaagggggaccgggccacgaggagcctattcccatgagcacctatggctggaacctcgtccggctgcagtccggggtggacgtgttctttacaccccctgagaaatgcgatacactgctctgtgacatcggagaaagctcccccaatcctaccattgaggccggcagaacacttcgcgtcctgaacctggttgaaaattggctcaacaataacacgcaattctgcatcaaggtgctgaatccgtacatgccctctgtgattgagaaaatggaaacccttcagcggaagtacgggggagctctggtcagaaaccctctcagccgcaattccacacatgagatgtattgggtgtctaacgccaccggcaatatcgttagctccgtgaacatgatctctcggatgctgattaatagatttacaatgaaacacaagaaggcgacctacgagcccgatgtcgacctggggagcggaacgcgcaacatcggcattgaaaacgagatccctaatctcgacattatcggcaaaagaattgaaaagatcaaacaggagcacgaaacctcctggcattatgatcaggaccacccctacaagacatgggcctatcatgggagctacgagaccaaacaaacaggatctgcttccagcatggtgaacggcgttgtgcggcttctgaccaagccgtgggatgtcatccctatggtgacacagatggccatgaccgacacgacacccttcgggcagcagcgcgtgtttaaggagaaagtcgataccagaacccaagaacctaaggagggaaccaagaagctgatgcggattacggctgaatggctctggaaagagctgggcaagaagaaaacccccagaatgtgtacacgggaggagttcacccgcaaggttagatctaatgccgctcttggggccatctttacagacgagaacaaatggaagtccgcgcgggaagccgtggaggatagccgcttctgggaactggtggacagagagcggaatctccacctggagggaaaatgcgaaacctgtgtctataacatgatgggcaagcgcgagaaaaagctgggcgaatttgggaaggctaaaggatctagagccatttggtacatgtggctcggcgctcggttcctggagtttgaagcccttgggttcctgaatgaggatcactggttttcccgcggaaacagcctctccggcgtggagggggaaggcctgcataaacttggatacatcctgagagacgttagcaaaaaggagggcggggccatgtatgcggatgacacagctggatgggacacccggattacgctcgaagatctgaaaaatgaggaaatggtgaccaaccacatgaagggcgagcataagaaactggccgaggccatcttcaagctcacataccagaataaagtcgtgcgcgttcagagacctacaccccgggggacagtgatggacatcatttctcgcaaggatcagagaggaagcggccaagtcgggacctatggcctgaacacgttcacaaatatggaagctcagcttatccggcagatggagggagaaggcatttttaaatccatccaacacctgaccgtgacagaggagattgccgttcagaactggctcgctagagtggggcgcgaacggctgtctagaatggccatcagcggagacgattgcgtcgtgaagccgcttgacgatcgcttcgcgtccgccctgaccgctctcaatgacatgggcaaggtccggaaagatatccagcagtgggagccttctagagggtggaacgactggacgcaagtgcccttttgcagccatcacttccacgaactggttatgaaggatggacgcgtgctggtcgtgccctgtcggtcccaggacgagctcattggcagagcccgcatctctcagggggctggctggagcctgaaagaaaccgcctgccttggaaagtcctacgcgcagatgtggacactgatgtattttcatcggagagatctccgcctggccgctaacgccatttgtagcgctgtgccttctcactgggttccgacctcccggacaacctggagcatccatgccaaacacgagtggatgacaaccgaggacatgcttgctgtgtggaatagagtctggattcaagaaaacccctggatggaggacaagacgcctgtggaatcttgggaggaagttccctacctgggcaagcgggaggatcagtggtgcgggtccctcatcggactgacaagcagagccacctgggcgaaaaatattcagaccgccatcaaccaggtgcgctccctgatcggcaatgaggaatatattgactacatgccttctatgaagcggttcagaaaagaggaagaggaagctggggtcctctggtga

SEQ ID NO: 19936 - RNA, 9876 nt, synthetic construct
  misc_feature 1..9876: note = derived and/or modified CDS sequence (opt5) from DENV-2__EU687212__SS-prME
  source 1..9876: mol_type = other RNA
accgccggcgtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcattaccgaaaaggacagcccggtgaacatcgaggccgaacccccttttggggattcttacattatcatcggcgtcgagcccggacagctcaaactgaattggttcaagaagggctccagcattgggcaaatgtttgagacaaccatgagaggagctaaacgcatggccatccttggcgacacggcctgggatttcgggtctctgggaggcgtgtttacaagcattgggaaggctctccaccaggttttcggcgccatctacggagcggctttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggccgacagcggatgtgtcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaagagcttcgccggaccggtgtctcagcacaactaccgccctggctatcatacccaaaccgctgggccctggcaccttggaaagctcgaaatggattttgacttctgtgagggcacaaccgtcgtggtgacggaagattgcgggaaccggggaccctccctgagaacaaccacagccagcggcaaactgatcaccgagtggtgctgtcggtcctgcacactccctccgctgcgctacagaggcgaggacgggtgttggtacggaatggaaattcggccccttaaggagaaggaagagaatctggtcaactctctcgttaccgccggccatgggcagatcgataattttagcctgggagtgctgggcatggctcttttcctcgaagagatgctgagaacgcgcgtggggaccaaacacgcgatcctgctcgtcgccgtgtcctttgttacactgattaccggaaacatgtctttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcaccagcaaggagctgatgatggctacaattgggatcgccctcctgtcccagtctaccatgcccgaaaccattcttgagctgacagatgccctcgctctgggaatgatggtcctgaaaatcgtgcggaatatggaaaagtaccaacttgccgttacgatcatggcgattagctgcgtgcctaacgctgtcatcctgcagaatgcctggaaggtgtcctgtaccattctcgccacagtgagcgtctctcccctgctcctgacctccagccagcagaaagctgactggatccctcttgccctgacaattaagggcctcaaccccaccgctatctttctgacgacactgtctcgcacctccaaaaagagaagctggccgcttaatgaggccatcatggcggttgggatggtgtctattctggcctccagcctcctgaaaaacgacatccctatgaccggacccctcgtggctggcggcctgcttacagtctgctatgtgctgaccgggcggtccgccgatctggaactcgagcgcgctgccgacgttaagtgggaggatcaagccgaaattagcggatctagccctatcctgtccattacaatctctgaggacggcagcatgtccattaaaaatgaagaggaggaacagacgcttaccatcctgatcagaacagggctcctggtgatttctggagtcttccccgtgagcatcccgattaccgctgcggcctggtacctctgggaggttaagaagcagcgggctggcgtgctgtgggatgtcccttctccccctcccgtggaaaaagccgagcttgaagacggggcctatcgcatcaagcagagagggattctgggctacagccaaatcggcgctggggtctataaagagggaacatttcacaccatgtggcatgtgacgcggggcgccgttctgatgcaccgcgggaagagaatcgagcccagctgggcggatgtgaaaaaggacctcatttcctacggaggcgggtggaagctggaaggagagtggaaagaaggcgaggaagtccaggtgcttgctctggagcctggcaagaacccgcgggccgttcagaccaaacccgggatcttcaagacaaataccggaacaattggcgccgtgagcctcgatttttctcctgggacctccggaagccccatcgtcgacagaaaaggcaaggtggtggggctgtacggaaacggcgttgtcacacgctctggcgcttatgtgtccgccattgcgcagacggaaaagtccatcgaagataatcctgagatcgaagacgatattttccggaaaaagagactcaccatcatggacctgcatcccggggctggaaaaacaaagcgctaccttcctgccattgtgcgggaggccatcaaaagaggcctgcgcaccctgattctcgctccgacccgggtcgtggccgctgaaatggaggaggccctgagagggcttcccatccgctatcaaacgcctgcgattcgggccgaacacacgggaagagagatcgttgacctgatgtgtcatgctaccttcacaatgcggctcctgtcccccgtgcgcgtccctaactacaacctcatcattatggatgaagcccactttaccgaccccgcttctatcgccgccagaggctatattagcacacgggtggagatgggggaggctgcgggcatcttcatgaccgccacgccgcctggatcccgcgatccctttccccagagcaatgctcctattatggacgaagagagagaaatccccgagcggtcttggaactccggccacgaatgggttacagatttcaaggggaagaccgtgtggtttgtccctagcatcaaagccggaaatgacattgccgcttgcctgagaaagaacggcaaaaaggtgatccagctttctcgcaaaaccttcgatagcgagtacgttaagacacgggccaatgactgggattttgtggtcaccacagacatttccgagatgggggcgaacttcaaggctgaaagagtgatcgatccgcgccggtgtatgaaacccgtgattctgaccgacggagaggaaagagtcatcctggccggccctatgcccgttacgcattctagcgccgctcaacgccgggggagaatcggccgcaatcctaagaacgagaatgaccagtatatttacatgggagaacccctcgagaacgatgaggactgcgcccactggaaagaagcgaagatgctgcttgataatatcaacacaccggagggcattatcccttccatgtttgaacccgagagagaaaaagtggacgccattgatggggagtaccggctgcgcggagaggctagaaagaccttcgtggacctcatgcggcgcggcgatctgcctgtctggctggcctataaagtggctgccgaagggatcaattacgctgacagaaagtggtgttttgatggaattaagaacaatcagatcctcgaggaaaacgttgaggtggagatctggacaaaagaaggcgagcggaagaaacttaagcccagatggctggacgcccgcatttattctgatcctctggcgctcaaagagttcaaggagttcgccgctgggagaaagagcctgacccttaacctgatcacggaaatgggcagactccccacctttatgacacagaaagcccgcaatgctctggacaacctggccgtcctccataccgccgaggctggaggccgggcgtacaatcacgccctttccgagctgccggaaacactggagaccctcctgcttctgacactcctggctaccgtgacagggggaattttcctgtttctcatgagcggcaaggggatcggaaaaatgacacttggcatgtgctgcattatcaccgcctctatcctgctgtggtatgcccaaattcagcctcactggatcgctgcctccattatcctcgagttctttctgattgttcttctgatccccgagcccgaaaagcagagaacccctcaggataaccaactcacatacgtggtcatcgcgattctgaccgtggtcgccgctacaatggccaatgagatgggcttcctggagaaaacgaagaaggacctcgggcttggaagcatcaccacacaggaatccgagtctaacattctggacatcgatctgcggccggctagcgcctggaccctctatgcggtggccacaacctttgttacgcccatgctgcgccattccattgaaaattctagcgtgaacgtgtcccttaccgctatcgccaatcaggctacagtcctgatgggcctcgggaaaggatggcctctgagcaagatggacattggcgttcccctgctcgccatcgggtgttactctcaggtgaaccctatcacccttacagctgccctgctgctcctggtggcgcactacgccattatcggacccggccttcaagctaaagccaccagagaggctcagaagcgggccgccgcgggcattatgaaaaatcctacggtcgatgggatcacagtgattgacctggaaccgatcccctatgatcctaagttcgagaagcagctcggacaggttatgctgctgatcctctgcgtgacccaagtccttatgatgcgcacaacctgggctctgtgtgaggccctgaccctcgctacaggccccatttccacgctgtgggaagggaaccctggaagattttggaataccacaatcgccgtgagcatggccaacattttccggggctcttaccttgctggggccggactgctcttttccatcatgaaaaataccacaaacacccgcagaggcacgggcaatattggggagacactgggagaaaagtggaaaagccggctgaacgcgctcggcaagtctgagttccagatctataaaaagagcgggatccaggaggtcgaccgcacccttgccaaagaaggaattaagagaggcgagaccgatcatcacgctgtgtcccgggggtctgccaagctgagatggtttgttgaacgcaacatggtgacacccgagggaaaagtcgtggacctgggctgcggccggggaggatggagctactattgtggcgggctcaagaatgttagagaagtgaaaggactgaccaagggcgggccgggacatgaggagcctgtccccatgtccacatacggctggaaccttgtgcgcctgcaaagcggcgtggatgttttcttcacgccccctgaaaaatgcgacaccctcctgtgtgatatcggggagtcctctcccaatcctacaattgaagctggacggaccctgagagtcctcaaccttgtggagaattggctgaacaataacacacagttttgcatcaaggtgctgaatccgtatatgcccagcgtcattgaaaagatggagaccctccagcgcaaatacggcggggccctggttcggaaccctctttccagaaattctacgcacgagatgtactgggtgagcaacgcgaccggaaatatcgtgtcctctgtcaacatgatcagccgcatgctgattaatcggttcacaatgaagcacaaaaaggccacctatgaacccgacgtggatctcggctccgggacaagaaacatcggaattgagagcgaaatccctaacctggacattatcggcaaacgcattgagaagatcaagcaggaacatgagacctcttggcactacgaccaagatcatccctataaaacatgggcttaccacggctcctatgagaccaagcagacggggagcgcctcttccatggttaatggagtggtccggctgctcacaaaaccgtgggacgtggttcctatggtgacccagatggctatgaccgatacaacgccctttggccagcaaagagtcttcaaggaaaaagtggacacccgcacacaggagcctaaggaagggaccaagaaacttatgaagatcacagccgagtggctgtggaaagagctgggaaagaaaaagacccccagaatgtgtacacgggaagagtttaccaaaaaggtgcgcagcaacgctgccctcggcgcgattttcacggatgaaaataagtggaaatctgccagagaggctgtcgaagacgggcggttttgggagctggttgatagagagcggaaccttcacctggaaggaaagtgcgagacctgtgtgtacaatatgatgggcaaacgcgaaaagaaactcggcgagttcgggaaggccaagggatccagagctatctggtatatgtggctgggcgcccggtttctggagttcgaggccctcgggtttctgaacgaggaccattggttcagccgcggaaattcccttagcggcgtggaaggggagggcctgcacagactcggatacattctgcgggaagtcggcaaaaaggaagggggagcgatgtacgctgatgacacagccggctgggatacccgcatcacacttgaagacctgaaaaacgaggagatggtgaccaatcatatgaagggggaacacaaaaagctcgccgaggctatttttaagctgacgtatcagaacaaagttgtgagagtccagcggcctacaccccgcggaaccgtgatggacatcatctctagacgggatcaacgcggcagcgggcaggttggcacatacggactgaataccttcacgaacatggaagcccagctcattagacaaatggagggcgaggggatcttcaagtccattcagcatctgaccgctacagaagagatcgccgtgcagaattggcttgcgcgggtcggacgcgaaagactgtctcggatggccattagcggcgacgattgcgtggttaaaccgatcgacgatagatttgcttccgccctcaccgctctgaacgacatggggaaggtgcgcaaagatatccagcaatgggagccttctcggggatggaatgactggacacaggtccccttctgcagccaccactttcatgaacttgtgatgaaggatggcagagtcctggtggttccctgtcgcaaccaggacgagctcattgggcgggccagaatctcccagggcgcgggatggtctctgaaggagaccgcctgcctgggcaaaagctatgctcaaatgtggacactcatgtacttccaccgccgggatctgagacttgccgctaacgccatttgttccgctgtgcctagccattgggtcccgacctctcgcacgacatggtccatccacgccaagcacgaatggatgaccaccgaggacatgctggcggtgtggaatcgggtgtggattcaggaaaacccctggatggaggataaaacacctgttgaaagctgggaggaggtgccctatctcgggaagagagaagaccagtggtgcggatctctgatcggccttacctcccgcgccacatgggctaaaaatattcagacggccatcaaccaagtccggagcctgatcgggaatgaggaatacaccgactatatgccttccatgaagagatttcggagagaggaagaggaggccggagtgctctggtga

SEQ ID NO: 19937 - RNA, 9876 nt, synthetic construct
  misc_feature 1..9876: note = derived and/or modified CDS sequence (opt5) from DENV-2__EU660400__SS-prME
  source 1..9876: mol_type = other RNA
accgccggagtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatcgatctcggagaactgtgtgaggacaccattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacgaccgtggcccctagcatgacaatgcggtgcattggcatctccaaccgcgattttgtcgaaggggtgtctggaggcagctgggttgacatcgtgctcgagcacgggtcctgtgtcaccacaatggcgaagaataagcccaccctggatttcgaacttattaaaacggaggccaagcagcctgctacactgagaaaatattgcatcgaagccaagctcaccaacaccacaaccgagagccggtgtccgacacaaggagagccctctctgaatgaggaacaggacaaacgctttatttgcaagcattccatggtggatagaggctggggcaacgggtgtggactgttcggcaaagggggaatcgtgacgtgcgctatgtttacctgcaaaaagaatatggaaggcaaagtcgttctccctgagaacctggaatacacaattgtgatcacaccccacagcggggaggagcatgccgtgggaaatgacacaggcaagcacggcaaagaaatcaagattacccctcagtcttccatcacggaggcggaacttaccgggtatggaacagtcaccatggagtgtagcccccggacaggcctggatttcaacgaaatggtgctcctgcagatggaggacaaagcctggcttgttcaccgccaatggtttctggatctcccgctgccttggctgcccggggctgacacccagggatctaattggattcagaaggagacgctcgtgacattcaagaaccctcatgccaaaaagcaggacgtcgtggttctgggctcccaagaaggggctatgcacaccgcccttacaggcgccaccgagatccagatgagctccggaaatctgctctttaccggccatctgaaatgcagacttcggatggataagctgcagctcaaagggatgtcttacagcatgtgtacaggaaagttcaagattgtgaaagaaatcgctgagacgcaacacggcaccatcgtcattagagtgcagtatgagggggacggatccccctgcaagatccccttcgaaattatggatctggagaaacgccatgtcctgggccggctcatcacagtgaaccctattgttaccgaaaaggacagcccggtgaacatcgaggcggaacccccttttggggattcttacattatcatcggcgtcgagcccggacagctgaaacttaattggttcaagaagggctccagcattgggcagatgtttgagacaaccatgagaggagccaaacgcatggctatcctgggcgacacggcctgggatttcgggtctctcggaggcgtgtttacaagcattgggaaggccctgcaccaagttttcggcgctatctacggagccgcgttttccggcgtgtcttggaccatgaaaattctgatcggggtcatcattacctggatcggaatgaacagccggtccacaagcctttctgtgtccctcgtgctggttggcgtcgtgaccctgtatctcggggtgatggtccaggctgacagcggatgtgtggtttcttggaagaataaagaactgaagtgcggctccgggattttcatcacagataacgtgcacacgtggaccgagcagtacaagtttcagcctgaaagcccctccaaacttgcctctgccattcaaaaggctcatgaggaaggcatctgtggaatcagaagcgtcacacgcctggagaatctcatgtggaaacagattaccccggagctgaaccacatcctgtccgaaaatgaggtgaaacttacaattatgaccggcgacatcaaagggattatgcaggccggaaagcggtctctcagacctcagcccacggaactgaaatatagctggaagacctggggcaaggctaaaatgctgtccacagagagccataaccaaaccttcctcatcgatgggcctgaaacagccgagtgccccaataccaaccgcgcgtggaactctctggaggttgaagactacggatttggcgtgttctccacaaacatctggcttaagctgcgggagaaacaggacgtcttttgtgatagcaagctcatgtctgccgctattaaagacaatagagccgtgcacgctgatatgggctattggatcgaatccgccctgaacgacacctggaagatggagaaggcgagcttcattgaggttaaatcttgccactggcctaagagccatacgctgtggtccaatggggtgcttgaaagcgagatgatcattcccaaaaacttcgccggaccggtctctcagcacaactaccgccctggctatcatacacagaccgctgggccctggcacctcggaaagctggaaatggattttgacttctgtgagggcaccacagtggtggtcaccgaagattgcgggaatcggggaccctccctgagaacgacaaccgccagcggcaaactcatcacagagtggtgctgtcggtcctgcaccctgcctccgcttcgctacagaggcgaggacgggtgttggtacggaatggaaattcggcccctgaaggagaaggaagagaacctcgttaattctctggtgacagctggccatgggcaaatcgataactttagcctgggagtgcttggcatggccctcttcctggaagagatgctgagaacccgcgtcgggacgaaacacgccatcctcctggtggctgtttcctttgtgacccttattacaggaaatatgtctttccgggacctgggcagagtcatggtgatggttggcgcgaccatgacagatgacatcgggatgggagtgacctatctcgccctgctggctgcctttaaggtccgccctacgttcgccgctggccttctgctcagaaaactgacaagcaaggagctcatgatggccaccattgggatcgcgctgctttcccagtctacaattcccgaaaccatcctggagctcaccgatgctctggccctgggaatgatggtgcttaaaatcgttcggaacatggaaaagtaccagctggccgtgacaattatggctatcagctgcgtccctaatgccgtgattctccaaaacgcgtggaaggtgtcctgtacgatcctggctgccgtcagcgtttctcccctcctgcttacctccagccgccagaaagccgactggattcctctggctctcacaatcaagggcctgaatcccaccgccatctttctgacaaccctttctagaacgtccaaaaagcggagctggccgctgaacgaggctgtgatggccgtggggatggtctctattctcgcgtccagcctgctcaaaaatgacatccctatgacaggacccctggtggccggcggccttctgaccgtttgctatgtgctgaccgggcgctccgctgatctcgaactggagagagccgctgacgtcaagtgggaggatcaggccgaaattagcggatctagccctatcctttccattacaatctctgaggacggcagcatgtccattaaaaacgaagaggaggaacacaccctgacaatcctcatccggacggggctgctcgtgatttctggagttttccccgtgagcatcccgattaccgccgctgcgtggtacctgtgggaggtcaagaagcagcgcgccggcgtgctttgggatgtcccttctccccctcccgtggggaaagctgaactggaggacggagcctatagaatcaagcaacggggcatttttggctacagccagatcggggccggagtttataaagaaggcacattccataccatgtggcacgtgacacgcggggctgtcctgatgcatagaggaaagcggatcgagcccagctgggccgatgtgaaaaaggacctcatttcctacggcgggggatggaagctggagggcgaatggaaagagggcgaagaggttcaggtgcttgcgctggaacctgggaagaatccgagagctgtccagaccaaacccggactctttaagacgaacaccggcacaatcggggccgtgagcctggatttctctcctggaacctccggcagccccattgtggaccgcaaagggaaggttgtcggactctacggcaatggcgtggtgacacggtctggggcctatgtctccgctatcgcccaaaccgaaaagagcattgaggataaccctgaaatcgaggacgatatcttccgcaagaagcgcctgacaattatggaccttcaccccggagcgggcaaaacgaagcggtacctgcctgctatcgtgagagaagccattaaacgcgggctgcggaccctcatcctggccccgacaagagttgtggctgccgagatggaagaggctcttagaggactgcccattcggtatcagacccctgccatcagagcggagcataccggccgggaaattgtcgacctcatgtgtcacgccacatttacgatgcgcctgctctcccccgtgagagttcctaactacaatctgatcatcatggatgaggctcacttcaccgaccccgcctctattgctgcccgggggtatatcagcacacgcgtggaaatgggcgaggccgctggaatttttatgaccgcgacaccgcctggctccagagatcccttcccccagagcaacgcccctatcatggacgaggaacgggagattcccgaaagatcttggaactccgggcatgagtgggtcaccgattttaagggaaagacggtgtggttcgttcctagcatcaaagctggcaacgacatcgccgcctgccttcgcaagaatgggaaaaaggtgattcagctgtctcggaaaacatttgatagcgaatacgtcaagaccagagctaacgactgggatttcgtggtgaccacagacatctccgagatgggagccaattttcgcgcggagcgggtcattgatccgagacgctgtatgaagcccgttatcctgaccgacggcgaggaacgggtgattctcgctgggcctatgcccgtgacacactctagcgccgcccaaagacgcggcagaatcggacggaaccctaaaaatgaaaacgaccagtatatctacatgggcgagcccctggaaaatgatgaggactgcgctcattggaaggaggccaaaatgcttctggataacattaataccccggaagggatcattccttccatgttcgagcccgaacgcgagaaggtcgacgcgatcgatggagaatacagactccggggcgaggcccgcaaaacgtttgtggacctgatgagaagaggggatctgcctgtttggctcgcttatagagtggccgctgagggaattaactacgccgaccgccggtggtgtttcgatggcatcaagaataaccagattcttgaagagaacgtcgaagtggagatctggacaaaagagggggaaagaaagaagctgaaaccccgctggctggacgctcggatctattctgatcctctcgccctgaaggagttcaaagaatttgcggccggcagaaagagccttaccctgaatctcattacagagatgggacggctgcccaccttcatgacgcaaaaagctcgcgacgccctggataacctcgctgttcttcacaccgccgaagtgggcgggagagcctacaatcacgctctgtccgagctgccggagacactcgaaaccctgcttctgctcacactgctggcgaccgtcacaggaggcatctttctcttccttatgagcgggaagggaattggcaagatgaccctgggcatgtgctgcatcattacggcctctatcctgctctggtatgctcagatccagcctcattggattgccgcctccatcattctggagtttttccttatcgtgctgctcattcccgaacccgagaaacagcggacacctcaagacaaccagctgacctacgtcgtgatcgctatcctgaccgttgtggccgcgacaatggccaatgaaatggggtttctcgagaagaccaaaaaggaccttggactgggcagcattacaacgcaggagtccgaatctaacatcctggatattgacctccgcccggctagcgcctggaccctgtatgctgtggccacaaccttcgtcacacccatgcttagacactccatcgaaaattctagcgttaacgtgtccctgaccgcgattgccaatcaggctacggtgctcatggggctgggacggggctggcctctgagcaaaatggatatcggggtccccctccttgccattggatgttactctcaagtgaaccctatcaccctgacagctgccctgctcctgcttgttgctcattacgccatcattggccccggcctgcaggcgaaggccacccgcgaagctcagaagagagccgctgccgggatcatgaaaaatcctacagtggacggaattaccgtcatcgatctcgagccgattccctatgaccctaagtttgaaaaacagctgggccaagtgatgctgctcgtcctttgcgtgacgcaggttctgatgatgcggacaacctgggccctgtgtgaggcgctcacactggctaccgggcccatctccaccctttgggagggaaaccctggccgcttctggaatacaacgatcgccgtgagcatggctaacatttttagagggtcttacctggccggagccggcctcctgttctccatcatgaagaataccacaaacacccggagaggcacagggaatattggagaaaccctgggcgagaaatggaagtcccgcctcaacgctcttgggaagtctgaatttcagatctataaaaagagcggcattcaggaggtcgatcggacgctggccaaagagggcatcaagagaggggaaacagaccaccatgcggtgtcccgcggatctgccaaactgcggtggttcgttgagagaaacatggtgacccccgaaggcaaggtcgtggatctcggctgcgggcgcggaggctggagctactattgtgggggactgaaaaatgtgcgggaggttaagggccttaccaaagggggaccgggccacgaggagcctatccccatgtccacatacggctggaacctggtcagactccaaagcggggtggacgtgttctttacaccccctgagaaatgcgatacactgctgtgtgacattggagaatcctctcccaatcctacgatcgaggctggccgcaccctccgggtccttaacctggttgaaaattggctgaacaataacacacagttctgcattaaggtgctcaatccgtatatgcccagcgtgatcgagaaaatggaaaccctgcagagaaagtacgggggagcccttgtccgcaaccctctgtccagaaattctacacacgagatgtactgggtgagcaacgctaccggcaatattgtttcctctgtgaacatgatcagcagaatgctcatcaatcgctttacgatgaaacataagaaggccacctatgagcccgatgtcgacctggggtccggaacaagaaacattggcatcgaaaacgagattcctaatctggacatcattggcaaacggatcgaaaagattaaacaagagcacgaaaccagctggcattacgatcaggaccacccctataagacatgggcgtaccacgggtcttatgagaccaaacagacaggatccgccagctctatggtgaacggcgttgtgaagctccttaccaagccgtgggatgtcgtgcctatggtgacgcagatggctatgacagacaccacccccttcgggcaacagcgcgtctttaaagagaaggttgatacaagaacgcaggaacctaaagagggaaccaagaaactgatgcggatcacagccgaatggctgtggaaggagctcggcaagaaaaagacccccagaatgtgtacacgggaggagttcacccgcaaagtgagatccaatgctgccctgggggctatctttacagacgagaacaagtggaaaagcgcccgggaagcggtggaggattctcgcttctgggaacttgtcgacagagagcggaatctgcatctcgagggaaagtgcgaaacctgtgtgtacaacatgatgggcaaacgcgagaagaagctgggcgaatttgggaaagccaagggatccagagctatttggtatatgtggctgggcgcccggttcctcgagtttgaagctctggggttccttaatgaggatcactggtttagccgcggaaactccctgagcggcgttgagggggaaggcctccataaactgggatacatccttagagacgtgtctaagaaagagggcggggccatgtacgccgatgacacggcgggatgggacacccggattacactggaagatctcaagaatgaggaaatggtcaccaaccacatgaagggcgagcataaaaagctggctgaggccatcttcaaactgacatatcagaataaggtggttcgcgtgcaaagacctacaccccgggggacggtcatggacattatcagccgcaaagatcagagaggatccggccaggtggggacatacggcctcaacaccttcacaaatatggaagcccagctgatccggcaaatggagggagaaggcatttttaagtctatccagagacttaccgttacggaggagattgctgtgcagaactggctggcccgcgtcgggcgggaaagactcagccgcatggctatctccggagacgattgcgtggtcaagccgctggacgatcggttcgcctctgcgcttaccgccctgaatgacatgggcaaagtgagaaaggatattcaacagtgggagcctagccgcgggtggaacgactggacacaggttcccttttgctcccaccacttccatgaactcgtgatgaaagatggacgggtcctggtggtgccctgtagaaaccaggacgagctgatcggccgcgctcggatctctcaaggggccggctggagcctcaaggaaaccgcttgcctgggaaaatcctatgcccagatgtggacacttatgtactttcacagacgcgatctgcggctcgcggccaatgctatttgtagcgccgttccttctcattgggtgccgacctccagaacaacctggagcatccacgctaagcacgagtggatgacgacagaggacatgctggccgtctggaaccgggtgtggattcaggaaaatccctggatggaggacaagacccctgttgaatcttgggaggaagtgccctatcttggcaaaagagaggatcagtggtgcgggtccctgatcggactcaccagccgcgctacatgggccaagaacattcaaaccgcgatcaatcaggtccggtccctgattggcaacgaggaatacacagactatatgccttctatgaaaagattccgcaaggaggaagaggaagccggggtgctgtggtga

SEQ ID NO: 19938 - RNA, 9876 nt, synthetic construct
  misc_feature 1..9876: note = derived and/or modified CDS sequence (opt5) from DENV-2__EU569711__SS-prME
  source 1..9876: mol_type = other RNA
acagccggcgtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatatcctgggccggctcattaccgtcaaccctatcgtgacagaaaaggacagcccggttaacattgaggccgaacccccttttggggattcttacatcatcattggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtctttacgagcatcgggaaggctctgcaccaagtgttcggcgccatttacggagcggctttttccggcgtttcttggacaatgaaaatcctgatcggggtgattatcacctggattggaatgaacagccggtccaccagcctttctgtctccctcgtgctggtgggcgttgtcacactgtatctcggggtgatggtgcaggccgacagcggatgtgtcgtgtcttggaagaataaagaactgaagtgcggctccgggatcttcattaccgataacgttcacacatggacggagcagtacaagtttcagcctgaaagcccctccaaacttgcctctgctatccaaaaggcccatgaggaaggcatctgtggaattagaagcgtgacccgcctggagaatctcatgtggaaacagatcacaccggagctgaaccacattctgtccgaaaatgaggtcaaacttaccatcatgacaggcgacattaaagggatcatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggtggaagactacggatttggcgttttctccaccaacatttggcttaagctgcgggagaaacaggacgtgttttgtgatagcaagctcatgtctgctgccatcaaagacaatagagctgtccacgccgatatgggctattggattgaatccgcgctgaacgacacatggaagatggagaaggccagcttcatcgaggtgaaatcttgccactggcctaagagccataccctgtggtccaatggggttcttgaaagcgagatgattatccccaaaaacttcgctggaccggtgtctcagcacaactaccgccctggctatcatacgcagacagccgggccctggcacctcggaaagctggaaatggattttgacttctgtgagggcaccaccgtcgtggtgacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgtcaattctctggttaccgccggccatgggcaaatcgataactttagcctgggagtgcttggcatggccctcttcctggaagagatgctgagaacacgcgtggggaccaaacacgctattctcctggtcgcggtgtcctttgttacgcttatcaccggaaatatgtctttccgggacctgggcagagtgatggtcatggtgggcgccacaatgaccgatgacattgggatgggagttacatatctcgctctgctggccgcctttaaggtgcgccctaccttcgctgccggccttctgctcagaaaactgacgagcaaggagctcatgatggcgacaatcgggattgctctgctttcccagtctaccatccccgaaacaatcctggagctcaccgatgccctggccctgggaatgatggtccttaaaattgtgcggaacatggaaaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaagggcctgaatcccacagctatttttctgaccacactttctcgcacctccaaaaagagaagctggccgctgaacgaggccgttatggcggtggggatggtgtctatcctcgcctccagcctgctcaaaaatgacattcctatgacgggacccctggtcgctggcggccttctgacagtgtgctatgttctgaccgggcggtccgccgatctcgaactggagcgcgctgccgacgtgaagtgggaggatcaggccgaaatcagcggatctagccctattctttccatcaccatttctgaggacggcagcatgtccatcaaaaacgaagaggaggaacacacactgaccatcctcattagaacagggctgctcgtcatctctggagtgttccccgttagcattccgatcacggctgcggcctggtacctgtgggaggtgaagaagcaacgggctggcgtcctttgggatgtgccttctccccctcccgtcgggaaagccgaactggaggacggagcctatcgcattaagcagagaggcatctttggctacagccagatcggggctggagtgtataaagaaggcaccttccatacaatgtggcacgttaccagaggggccgtgctgatgcatcgcggaaagagaattgagcccagctgggcggatgtcaaaaaggacctcatctcctacggcgggggatggaagctggagggcgaatggaaagagggcgaagaggtgcaggttcttgctctggaacctgggaagaatccgcgggccgtgcaaacaaaacccggactctttaagaccaacacgggcaccattggggccgtcagcctggatttctctcctggaacatccggcagccccatcgtggacagaaaagggaaggtggttggactctacggcaatggcgtcgtgacccgctctggggcttatgtgtccgccattgcgcagacagaaaagagcatcgaggataaccctgaaatcgaggacgatattttccggaaaaagagactgaccatcatggaccttcaccccggagctggcaaaacaaagcgctacctgcctgccattgtccgggaagccatcaaaagagggctgcgcacgctcattctggctccgacccgggtggttgccgctgagatggaagaggcccttagaggactgcccatccgctatcagacccctgcgattcgggccgagcataccggcagagaaatcgtggacctcatgtgtcacgctacctttacaatgcggctgctctcccccgtccgcgtgcctaactacaatctgatcattatggatgaggcccacttcacggaccccgcttctatcgccgccagagggtatattagcacccgggttgaaatgggcgaggctgcgggaatctttatgacagccaccccgcctggctcccgcgatcccttcccccagagcaacgctcctattatggacgaggaaagagagatccccgaacggtcttggaactccgggcatgagtgggtgacagattttaagggaaagaccgtctggttcgtgcctagcatcaaagccggcaacgacattgccgcttgccttagaaagaatgggaaaaaggttatccaactgtctcgcaaaacgtttgatagcgaatacgtgaagacacgggccaacgactgggatttcgtcgtgaccaccgacatttccgagatgggagcgaattttagagctgagcgcgtgatcgatccgcggagatgtatgaagcccgtcattctgacagacggcgaggaacgcgttatcctcgccgggcctatgcccgtgacccactctagcgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaatacaccggaagggattatcccttccatgttcgagcccgaacgggagaaggtggacgccattgatggagaataccgcctcagaggcgaggctcggaaaacctttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacgaaagagggggaacggaagaagctgaaacccagatggctggacgcccgcatttattctgatcctctcgcgctgaaggagttcaaagaatttgccgctggccggaagtcccttacactgaatctcatcaccgagatgggaagactgcccacattcatgacccagaaagcccgggacgctctggataacctcgccgtgcttcacacggccgaagttggcgggcgcgcttacaatcacgcgctgtccgagctgccggagaccctcgaaacactgcttctgctcaccctgctggccacagtgaccggaggcatttttctcttccttatgagcgggaagggaatcggcaagatgacactgggcatgtgctgcattatcaccgcttctatcctgctctggtatgcccagattcagcctcattggatcgccgcttccattatcctggagtttttccttattgtcctgctcatccccgaacccgagaaacaaagaacgcctcaggacaaccagctgacatacgtggtcatcgccattctgaccgtggttgcggccaccatggctaatgaaatggggtttctcgagaagaccaagaaggaccttggactgggcagcatcaccacacaggagtccgaatctaacattctggatatcgacctccggccggccagcgcttggacgctgtatgccgtggcgaccacattcgtgacccccatgcttcgccactccattgaaaattctagcgtcaacgtttccctgacagccatcgctaatcaagccaccgtgctcatggggctgggaagaggctggcctctgagcaaaatggatattggggtgcccctccttgctatcggatgttactctcaggtcaaccctatcacgctgaccgccgctctgctcctgcttgtggcccattacgcgattatcggccccggcctgcaggccaaggctacacgggaagcccagaagcgcgctgccgccgggattatgaaaaatcctaccgttgacggaatcacagtgattgatctcgagccgatcccctatgaccctaagtttgaaaaacaactgggccaggtcatgctgctcgtgctttgcgtcacccaggtgctgatgatgagaacgacatgggcgctgtgtgaggctctcaccctggccacagggcccatctccaccctttgggagggaaaccctggccggttctggaataccacaattgctgttagcatggccaacatctttcgcgggtcttacctggccggagctggcctcctgttctccattatgaagaatacgaccaacacaagacggggcaccgggaatatcggagaaacactgggcgagaaatggaaaagcagactcaacgcccttgggaagtctgaatttcagatttataaaaagagcggaatccaagaggtggatcgcaccctggcgaaagagggcatcaagagaggggaaacggaccaccatgccgtctccagaggatctgctaaactgcgctggttcgtggagcggaacatggttacacccgaaggcaaggtggtcgatctcggctgcgggagaggaggctggagctactattgtgggggactgaaaaatgtgcgcgaggtgaagggccttaccaaagggggaccgggccacgaggagcctattcccatgtccacctacggctggaacctggttcggctccagagcggggtcgacgtgttctttacaccccctgagaaatgcgataccctgctgtgtgacatcggagaatcctctcccaatcctacaattgaggccggcagaacgctccgcgtgcttaacctggtcgaaaattggctgaacaataacacccagttctgcatcaaggttctcaatccgtatatgcccagcgtgattgagaaaatggaaacactgcaacggaagtacgggggagctcttgtgagaaaccctctgtcccgcaattctacccacgagatgtactgggtcagcaacgccacaggcaatatcgtgtcctctgttaacatgatcagccggatgctcattaatagatttaccatgaaacataagaaggcgacgtatgagcccgatgtggacctggggtccggaacccgcaacatcggcattgaaaacgagatccctaatctggacattatcggcaaaagaattgaaaagatcaaacaggagcacgaaacaagctggcattacgatcaggaccacccctataagacctgggcctaccacgggtcttatgagacaaaacagaccggatccgctagctctatggtcaacggcgtggttcggctccttacaaagccgtgggatgtggtccctatggtgacccaaatggccatgacggacacaacccccttcgggcagcagcgcgtgtttaaggagaaagtcgataccagaacacaggaacctaaggagggaacgaaaaagctgatgcggatcaccgctgaatggctgtggaaagagctcggcaagaagaaaacacccagaatgtgtacccgggaggagttcacacgcaaggttagatccaatgccgctctgggggccatttttaccgacgagaacaaatggaaaagcgcgcgggaagccgtggaggattctcgcttctgggaacttgtggacagagagcggaatctgcatctcgagggaaaatgcgaaacatgtgtctacaacatgatgggcaagcgcgagaaaaagctgggcgaatttgggaaggctaaaggatccagagccatctggtatatgtggctgggcgctcggttcctcgagtttgaagccctggggttccttaatgaggatcactggtttagccgcggaaactccctgagcggcgtggagggggaaggcctccataagctgggatacattcttagagacgtttctaaaaaggagggcggggccatgtacgcggatgacaccgctggatgggacacgcggatcaccctggaagatctcaaaaatgaggaaatggtgacaaaccacatgaagggcgagcataagaaactggccgaggccattttcaagctgacctatcaaaataaagtcgtgcgcgttcagagacctacaccccgggggaccgtgatggacatcatcagccgcaaggatcagagaggatccggccaggtcgggacgtacggcctcaacacattcaccaatatggaagctcaactgattcggcagatggagggagaaggcatctttaaatctattcagagacttacagtgaccgaggagatcgccgttcaaaactggctggctcgcgtggggcgggaaagactcagccgcatggccatttccggagacgattgcgtcgtgaagccgctggacgatcggttcgcgtctgcccttacggctctgaatgacatgggcaaggtcagaaaagatatccagcagtgggagcctagccgcgggtggaacgactggacccaggtgcccttttgctcccaccacttccatgaactcgttatgaaggatggacgggtgctggtcgtgccctgtagaaaccaagacgagctgatcggccgcgcccggatttctcagggggctggctggagcctcaaagaaacagcctgcctgggaaagtcctatgcgcagatgtggacccttatgtactttcacagacgcgatctgcggctcgccgctaatgccatctgtagcgctgtgccttctcattgggttccgacatccagaaccacatggagcattcacgccaaacacgagtggatgaccacggaggacatgctggctgtgtggaaccgggtctggatccaggaaaatccctggatggaggacaagacacctgtggaatcttgggaggaagttccctatcttggcaagagagaggatcaatggtgcgggtccctgattggactcaccagccgcgccacctgggcgaaaaacatccagacagccattaatcaggtgcggtccctgatcggcaacgaggaatacaccgactatatgccttctatgaagagattccgcaaagaggaagaggaagctggggtcctgtggtga

SEQ ID NO: 19939 - RNA, 9876 nt, synthetic construct
  misc_feature 1..9876: note = derived and/or modified CDS sequence (opt5) from DENV-2__EU569712__SS-prME
  source 1..9876: mol_type = other RNA
accgccggcatgatcattatgctgatccccacggctatggccttccacctcacgaccagaaatggggaacctcatatgattgtgggacggcaggaaaagggcaaaagcctgctttttaagacagaagacggggtcaatatgtgcaccctgatggcgatcgatctcggagaactgtgtgaggacacaattacctacaaatgcccgcttctgcgccaaaatgaacccgaggatatcgactgttggtgcaatagcacatctacctgggttacgtatggcacctgtacaaccacaggggagcacagacgggaaaagcgcagcgtggctctcgtgcctcatgtcggaatgggcctggagaccagaacggaaacatggatgtcctctgagggcgcctggaaacacgtgcagcggatcgagacctggattctgcgccatcccgggttcacaatcatggccgctattctcgcctacaccatcggaaccacacactttcagagagctctgattttcatccttctgacggccgttgcgcctagcatgaccatgcggtgcattggcatctccaaccgcgattttgtggaaggggtctctggaggcagctgggtggacatcgttctcgagcacgggtcctgtgtgacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtcgatagaggctggggcaacgggtgtggactgttcggcaaagggggaatcgtgacatgcgccatgtttacgtgcaaaaagaatatggaaggcaaagtggtcctccctgagaacctggaatacaccattgttatcacaccccacagcggggaggagcatgcggtgggaaatgacaccggcaagcacggcaaagaaatcaagattacacctcagtcttccatcaccgaggccgaacttacggggtatggaaccgtgacaatggagtgtagcccccggaccggcctggatttcaacgaaatggtcctcctgcagatggaggacaaggcttggcttgtgcaccgccaatggtttctggatctcccgctgccttggctgcccggggccgacacacagggatctaattggattcagaaggagaccctcgttacgttcaagaaccctcatgctaaaaagcaggacgtggtcgtgctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgttaaagaaatcgcggagacacaacacggcacgatcgtgattagagtccagtatgagggggacggatccccctgcaagatccccttcgaaattatggatctggagaaacgctacgtgctgggccggctcatcaccgtcaaccctattgtgacagaaaaggacagcccggttaacatcgaggccgaacccccttttggggattcttacattatcatcggcgtggagcccggacagctgaaacttaattggttcaagaagggctccagcattgggcagatgtttgagaccacaatgagaggagctaaacgcatggccatcctgggcgacaccgcctgggatttcgggtctctcggaggcgtctttacgagcattgggaaggctctgcatcaagtgttcggcgccatctatggagcggctttttccggcgtttcttggacaatgaaaattctgatcggggtgatcattacctggatcggaatgaacagccggtccaccagcctttctgtctccctcgtgctggtgggcgttgtcacactgtacctcggggtgatggtgcaggccgacagcggatgtgtcgtgtcttggaagaataaagaactgaagtgcggctccgggattttcatcaccgataacgttcacacatggacggagcagtataagtttcagcctgaaagcccctccaaacttgcctctgctattcaaaaggcccacgaggaaggcatctgtggaatcagaagcgtgacccgcctggagaatctcatgtggaaacagattacaccggagctgaaccatatcctgtccgaaaatgaggtcaaacttaccattatgacaggcgacatcaaagggattatgcaggctggaaagcggtctctcagacctcagcccaccgaactgaaatacagctggaagacgtggggcaaggccaaaatgctgtccaccgagagccacaaccaaacattcctcatcgatgggcctgaaaccgcggagtgccccaatacaaaccgcgcctggaactctctggaggtggaagactatggatttggcgttttctccaccaacatctggcttaagctgcgggagaaacaggacgtgttttgtgatagcaagctcatgtctgctgccattaaagacaatagagctgtccatgccgatatgggctactggatcgaatccgcgctgaacgacacatggaagatggagaaggccagcttcattgaggtgaaatcttgccactggcctaagagccacaccctgtggtccaatggggttcttgaaagcgagatgatcattcccaaaaacttcgctggaccggtgtctcagcataactatcgccctggctaccacacgcagacagccgggccctggcatctcggaaagctggaaatggattttgacttctgtgagggcaccaccgtcgtggtgacagaagattgcgggaatcggggaccctccctgagaaccacgacagctagcggcaaactcatcaccgagtggtgctgtcggtcctgcacactgcctccgcttcgctacagaggcgaggacgggtgttggtatggaatggaaattcggcccctgaaggagaaggaagagaacctcgtcaattctctggttaccgccggccacgggcaaatcgataactttagcctgggagtgcttggcatggccctcttcctggaagagatgctgagaacacgcgtggggaccaaacatgctatcctcctggtcgcggtgtcctttgttacgcttattaccggaaatatgtctttccgggacctgggcagagtgatggtcatggtgggcgccacaatgaccgatgacatcgggatgggagttacatacctcgctctgctggccgcctttaaggtgcgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtccttaaaatcgtgcggaacatggaaaagtatcagctggctgttaccattatggccatcctctgcgtgcctaatgcggtcattctgcaaaacgcttggaaggtgagctgtacaatcctcgccgccgtgtccgtcagccccctgcttctgacgtcttcccagcagaaagctgactggattcctctcgccctgaccatcaagggcctgaatcccacagctatctttcttaccacactgagccgcacctctaaaaagagatcctggccgctcaacgaggccgttatggcggtggggatggtgagcattctggcctcttccctcctgaaaaatgacatccctatgacgggaccccttgtcgctggcggcctgctgacagtgtgctacgttctcaccgggcggagcgccgatctggaacttgagcgcgctgccgacgtgaagtgggaggatcaggccgaaatttccggaagctctcctatcctgagcattaccatctccgaggacggctctatgagcattaaaaacgaagaggaggaacaaacactcaccatcctgatcagaacagggctcctggtcatttccggagtgttccccgtttctatcccgattacggctgcggcctggtatctttgggaggtgaagaagcagcgggctggcgtcctgtgggatgtgccttctccccctcccgtcgaaaaagccgagctggaagacggggcctaccgcatcaagcagagaggaatttttggctattcccagatcggcgctggggtgtacaaagagggaaccttccacacaatgtggcacgttacccggggcgccgtgctcatgcatcgcgggaagagaatcgagccctcctgggcggatgtcaaaaaggacctgattagctacggaggcgggtggaaacttgaaggagagtggaaagaaggcgaggaagtgcaagttctggctctcgagcctggcaagaatccgcgggccgtgcagacaaaacccgggctgtttaagaccaacacgggaaccatcggcgccgtctccctcgatttcagccctgggacatctggatcccccattgtggacagaaaaggcaaggtggttgggctgtatggaaatggcgtcgtgacccgcagcggcgcttacgtgtctgccatcgcgcagacagagaagtccattgaagataaccctgagatcgaagacgatatcttccggaaaaagagacttaccattatggacctgcaccccggggctggaaaaacaaagcgctatctgcctgccatcgtccgggaggccattaaaagaggcctccgcacgctgatccttgctccgacccgggtggttgccgctgaaatggaggaggccctgagagggctccccattcgctaccagacccctgcgatccgggccgaacataccggaagagagattgtggacctgatgtgtcacgctacctttacaatgcggctcctgagccccgtccgcgtgcctaactataatcttatcatcatggatgaagcccatttcacggaccccgcttccattgccgccagaggctacatctctacccgggttgagatgggggaggctgcgggcatttttatgacagccaccccgcctggaagccgcgatcccttcccccaatccaacgctcctatcatggacgaagagagagaaattcccgagcggagctggaactctggccacgaatgggtgacagattttaaggggaagaccgtctggttcgtgccttccatcaaagccggaaacgacatcgccgcttgcctgagaaagaatggcaaaaaggttattcagctgagccgcaaaacgtttgattctgagtatgtgaagacacgggccaacgactgggatttcgtcgtgaccaccgacatcagcgagatgggggcgaattttagagctgaacgcgtgattgatccgcggagatgtatgaagcccgtcatcctcacagacggagaggaacgcgttattctggccggccctatgcccgtgacccactcctctgccgctcagcggagagggcgcatcggcagaaaccctaaaaatgagaacgaccaatacatctacatgggagaaccccttgagaatgatgaggactgcgcccattggaaggaagcgaaaatgctgctcgataacattaatacaccggagggcatcattcctagcatgttcgaacccgagcgggaaaaggtggacgccatcgatggggagtatcgcctgagaggagaggctcggaaaacctttgtcgacctgatgcgcagaggcgatctccctgtgtggcttgcctaccgggttgctgccgaagggattaactatgctgacagacgctggtgtttcgatggaatcaagaataaccagattctggaggaaaacgtggaggtcgagatctggacgaaagaaggcgagcggaagaagctgaaacccagatggctcgacgcccgcatctactccgatcctctggcgcttaaggagttcaaagagtttgccgctgggcggaagtctctgacactcaatctgattaccgaaatgggcagactgcccacattcatgacccagaaagcccgggacgctctcgataaccttgccgtgctgcacacggccgaggttggaggccgcgcttataatcatgcgctgagcgagctcccggaaaccctggagacacttctgctcctgaccctgctcgccacagtgaccgggggaatctttcttttcctgatgtccggcaaggggattggaaagatgacactgggcatgtgctgcatcattaccgctagcatcctcctgtggtacgcccagatccaacctcactggattgccgcttctatcattcttgaatttttcctgatcgtcctcctgattcccgagcccgaaaaacagagaacgcctcaggacaaccagctgacatatgtggtcatcgccatcctcaccgtggttgcggccaccatggctaatgagatgggctttcttgagaagaccaagaaggacctggggctgggatccattatcacccaagaaagcgagtccaacattctcgatatcgacctgcggccggcctctgcttggacactttacgccgtggcgacgaccttcgtgacacccatgctgcgccacagcattgaaaattcctctgtcaacgttagcctcaccgccatcgctaatcaggccacagtgctgatgggcctggggagaggatggcctctctccaaaatggatattggcgtgccccttctggctatcgggtgttacagccaggtcaaccctatcaccctgacggccgctctcctgcttctggtggcccattatgcgattatcggacccggcctccaggccaaggctacccgggaggcccaaaagcgcgctgccgccggcattatgaaaaatcctacagttgacgggatcaccgtgattgatctggaaccgatcccctacgaccctaagtttgagaaacagctgggacaggtcatgctccttgtgctgtgcgtcacacaggtgctgatgatgagaaccacgtgggcgctctgtgaggctctgacacttgccaccggccccatctctacactgtgggaagggaaccctggacggttctggaataccaccattgctgtttccatggccaacatctttcgcggcagctatctcgccggggctggactgctgttctctattatgaagaatacaacgaacaccagacggggcacaggcaatatcggggagaccctcggagaaaaatggaagtccagacttaacgccctgggcaagagcgagtttcaaatttacaaaaagtctgggatccaggaggtggatcgcacactggcgaaagaaggaatcaagcggggcgagaccgaccaccatgccgtcagcagagggtccgctaaactccgctggttcgtggaacggaacatggttacgcccgagggaaaggtggtcgatctgggctgcggcagagggggatggtcttattactgtggcgggcttaaaaatgtgcgcgaagtgaagggactgacaaagggcgggccgggacacgaggagcctattcccatgagcacctatggctggaacctcgttcggctgcagtccggcgtcgacgtgttctttacaccccctgaaaaatgcgatacactgctctgtgacatcggggagagctcccccaatcctaccattgaagccggaagaacacttcgcgtgctgaacctggtcgagaattggctcaacaataacacgcaattctgcatcaaggttctgaatccgtacatgccctctgtgattgagaagatggagacccttcagcggaagtacggcggggctctggtgagaaaccctctcagccgcaattccacacatgagatgtattgggtctctaacgccaccggaaatatcgtgagctccgttaacatgatctctcggatgctgattaatagatttacaatgaaacacaagaaggcgacctacgaacccgatgtggacctgggcagcgggacgcgcaacatcggaattgagaacgaaatccctaatctcgacattatcggcaaaagaattgagaagatcaaacaggaacacgagacctcctggcattatgatcaggaccacccctacaagacatgggcctatcatggcagctacgagaccaaacaaacagggtctgcttccagcatggtcaacggagtggttcggcttctgaccaagccgtgggatgtggtccctatggtgacacagatggccatgaccgacacgacacccttcggccagcagcgcgtgtttaaggaaaaagtcgataccagaacccaagagcctaaggaagggaccaagaagctgatgcggatcacggctgagtggctctggaaagagctgggaaagaagaaaacccccagaatgtgtacacgggaagagttcacccgcaaggttagatctaatgccgctcttggcgccatttttacagacgaaaacaaatggaagtccgcgcgggaggccgtggaagatagccgcttctgggagctggtggacagagagcggaatctccacctggaagggaaatgcgagacctgtgtctataacatgatgggaaagcgcgagaaaaagctgggcgagtttggcaaggctaaagggtctagagccatctggtacatgtggctcggagctcggttcctggaatttgaggcccttggcttcctgaatgaggatcactggttttcccgcgggaacagcctctccggagtggaaggcgaggggctgcataaacttggctacattctgagagacgttagcaaaaaggaaggaggcgccatgtatgcggatgacacagctgggtgggacacccggatcacgctcgaggatctgaaaaatgaagagatggtgaccaaccacatgaagggagagcataagaaactggccgaagccattttcaagctcacataccagaataaagtcgtgcgcgttcagagacctacaccccggggcacagtgatggacatcatctctcgcaaggatcagagagggagcggacaagtcggcacctatgggctgaacacgttcacaaatatggaggctcagcttattcggcagatggaaggcgagggaatctttaaatccattcaacacctgaccgtgacagaggaaatcgccgttagaaactggctcgctcgcgtgggccgggagagactgtctcgcatggccattagcggggacgattgcgtcgtgaagccgcttgacgatcggttcgcgtccgccctgaccgctctcaatgacatgggaaaggtcagaaaagatatccagcagtgggaaccttctcgcggctggaacgactggacacaggtgcccttttgcagccatcacttccacgagctggttatgaaggatgggcgggtgctggtcgtgccctgtagaaaccaagacgaactcatcggacgcgcccggatttcccagggcgctgggtggtctctgaaagagaccgcctgccttggcaagagctacgcgcagatgtggacactgatgtattttcatagacgcgatctccggctggccgctaatgccatctgttccgctgtgcctagccactgggttccgacctctagaacaacctggtccattcatgccaaacacgagtggatgacaaccgaagacatgcttgctgtgtggaaccgggtctggatccaggagaatccctggatggaagacaagacgcctgtggagagctgggaagaggttccctacctgggaaagagagaggatcaatggtgcggctctctcattgggctgacatcccgcgccacctgggcgaaaaacatccagaccgccattaatcaggtgcggagcctgatcggaaacgaagagtatacagactacatgccttccatgaagagattccgcaaagaagaggaagaggctggcgtcctctggtga

SEQ ID NO: 19940 - RNA, 9876 nt, synthetic construct
  misc_feature 1..9876: note = derived and/or modified CDS sequence (opt5) from DENV-2__EU596487__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccgtgagcatcccgattacggctgcggcctggtacctgtgggaggtcaagaagcaacgggctggcgtgctttgggatgtcccttctccccctcccgtggggaaagccgaactggaggacggagcctatcgcatcaagcagagaggcatttttggctacagccagatcggggctggagtttataaagaaggcaccttccatacaatgtggcacgtgaccagaggggccgtcctgatgcatcgcggaaagagaatcgagcccagctgggcggatgtgaaaaaggacctcatttcctacggcgggggatggaagctggagggcgaatggaaagagggcgaagaggttcaggtgcttgctctggaacctgggaagaatccgcgggccgtccaaacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcaccccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcataccggcagagaaattgtcgacctcatgtgtcacgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccagagcaacgctcctatcatggacgaggaaagagagattcccgaacggtcttggaactccgggcatgagtgggtcacagattttaagggaaagaccgtgtggttcgttcctagcatcaaagccggcaacgacatcgccgcttgccttagaaagaatgggaaaaaggtgattcaactgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccactctagcgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccaaattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccagcctcattggattgccgcttccatcattctggagtttttccttatcgtgctgctcattcccgaacccgagaaacaaagaacgcctcaggacaaccagctgacatacgtcgtgatcgccatcctgaccgttgtggcggccaccatggctaatgaaatggggtttctcgagaagaccaagaaggaccttggactgggcagcattaccacacaggagtccgaatctaacatcctggatattgacctccggccggccagcgcttggacgctgtatgccgtggcgaccacattcgtcacccccatgcttcgccactccatcgaaaattctagcgttaacgtgtccctgacagccattgctaatcaagccaccgtgctcatggggctgggaagaggctggcctctgagcaaaatggatatcggggtccccctccttgctattggatgttactctcaggtgaaccctatcacgctgaccgccgctctgctcctgcttgttgcccattacgcgatcattggccccggcctgcaggccaaggctacacgggaagcccagaagcgcgctgccgccgggatcatgaaaaatcctaccgtggacggaattacagtcatcgatctcgagccgattccctatgaccctaagtttgaaaaacaactgggccaggtgatgctgctcgtcctttgcgtgacccaggttctgatgatgagaacgacatgggcgctgtgtgaggctctcaccctggccacagggcccatctccaccctttgggagggaaaccctggccggttctggaataccacaatcgctgtgagcatggccaacatttttcgcgggtcttacctggccggagctggcctcctgttctccatcatgaagaatacgaccaacacaagacggggcaccgggaatattggagaaacactgggcgagaaatggaaaagcagactcaacgcccttgggaagtctgaatttcagatctataaaaagagcggcattcaagaggtcgatcgcaccctggcgaaagagggcatcaagagaggggaaacggaccaccatgccgtgtccagaggatctgctaaactgcgctggttcgttgagcggaacatggtgacacccgaaggcaaggtcgtggatctcggctgcgggagaggaggctggagctactattgtgggggactgaaaaatgtgcgcgaggttaagggccttaccaaagggggaccgggccacgaggagcctatccccatgtccacctacggctggaacctggtccggctccagagcggggtggacgtgttctttacaccccctgagaaatgcgataccctgctgtgtgacattggagaatcctctcccaatcctacaatcgaggccggcagaacgctccgcgtccttaacctggttgaaaattggctgaacaataacacccagttctgcattaaggtgctcaatccgtatatgcccagcgtgatcgagaaaatggaaacactgcaacggaagtacgggggagctcttgtcagaaaccctctgtcccgcaattctacccacgagatgtactgggtgagcaacgccacaggcaatattgtttcctctgtgaacatgatcagccggatgctcatcaatagatttaccatgaaacataagaaggcgacgtatgagcccgatgtcgacctggggtccggaacccgcaacattggcatcgaaaacgagattcctaatctggacatcattggcaaaagaatcgaaaagattaaacaggagcacgaaacaagctggcattacgatcaggaccacccctataagacctgggcctaccacgggtcttatgagacaaaacagaccggatccgctagctctatggtgaacggcgttgtgaagctccttacaaagccgtgggatgtcgtgcctatggtgacccaaatggccatgacggacacaacccccttcgggcagcagcgggtctttaaagagaaggttgatacccgcacacaggaacctaaagagggaacgaagaaactgatgagaatcaccgctgaatggctgtggaaggagctcggcaagaaaaagacaccccggatgtgtaccagagaggagttcacacggaaagtgcgctccaatgccgctctgggggccatctttaccgacgagaacaagtggaaaagcgcgagagaagccgtggaggattctcggttctgggaacttgtcgaccgcgagagaaatctgcatctcgagggaaagtgcgaaacatgtgtgtacaacatgatgggcaaacgggagaagaagctgggcgaatttgggaaagctaagggatcccgcgccatttggtatatgtggctgggcgctagattcctcgagtttgaagccctggggttccttaatgaggatcactggtttagccggggaaactccctgagcggcgttgagggggaaggcctccataaactgggatacatccttcgcgacgtgtctaagaaagagggcggggccatgtacgcggatgacaccgctggatgggacacgagaattaccctggaagatctcaagaatgaggaaatggtcacaaaccacatgaagggcgagcataaaaagctggccgaggccatcttcaaactgacctatcaaaataaggtggttcgggtgcagcgccctacacccagagggaccgtcatggacattatcagccggaaagatcagcgcggatccggccaggtggggacgtacggcctcaacacattcaccaatatggaagctcaactgatcagacagatggagggagaaggcatttttaagtctatccagcggcttacagttaccgaggagattgccgtgcaaaactggctggctagagtcgggcgcgaacggctcagcagaatggccatctccggagacgattgcgtggtcaagccgctggacgatcgcttcgcgtctgcccttacggctctgaatgacatgggcaaagtgcggaaggatattcagcagtgggagcctagcagagggtggaacgactggacccaggttcccttttgctcccaccacttccatgaactcgtgatgaaagatggacgcgtcctggtggtgccctgtcggaaccaagacgagctgatcggcagagcccgcatctctcagggggctggctggagcctcaaggaaacagcctgcctgggaaaatcctatgcgcagatgtggacccttatgtactttcaccggagagatctgcgcctcgccgctaatgccatttgtagcgctgttccttctcattgggtgccgacatcccggaccacatggagcatccacgccaagcacgagtggatgaccacggaggacatgctggctgtctggaacagagtgtggattcaggaaaatccctggatggaggacaagacacctgttgaatcttgggaggaagtgccctatcttggcaaacgggaggatcaatggtgcgggtccctgatcggactcaccagcagagccacctgggcgaagaacattcagacagccatcaatcaggtccgctccctgattggcaacgaggaatacaccgactatatgccttctatgaaacggttcagaaaggaggaagaggaagctggggtgctgtggtga

SEQ ID NO: 19941 - RNA, 9876 nt, synthetic construct
  misc_feature 1..9876: note = derived and/or modified CDS sequence (opt5) from DENV-2__EU569713__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggatctgacaccggcaagcacggcaaagaaatcaagattacacctcagtccagcatcaccgaggccgaacttacggggtatggaaccgtcacaatggagtgttctccccggaccggcctggatttcaatgaaatggtgctcctgcagatggaggacaaggcttggcttgttcaccgccaatggtttctggatctcccgctgccttggctgcccggggccgacacacagggatccaactggattcagaaggagaccctcgtgacgttcaagaatcctcatgctaaaaagcaggacgtcgtggttctgggcagccaagaaggggccatgcacacagcccttaccggcgctacagagatccagatgtcctctggaaacctgctctttaccggccatctgaaatgcagacttcggatggataagctgcagctcaaagggatgagctactccatgtgtaccggaaagttcaagattgtgaaagaaatcgcggagacacaacacggcacgatcgtcattagagtgcagtatgagggggacggaagcccctgcaagatccccttcgaaattatggatctggagaaacgctacgtcctgggccggctcatcaccgtgaatcctattgttacagaaaaggactctccggtgaacatcgaggccgaacccccttttggggattcctacattatcatcggcgtcgagcccggacagctgaaacttaactggttcaagaagggcagctctattgggcagatgtttgagaccacaatgagaggagctaaacgcatggccatcctgggcgacaccgcctgggatttcgggagcctcggaggcgtgtttacgtccattgggaaggctctgcatcaagttttcggcgccatctatggagcggctttttctggcgtgagctggacaatgaaaattctgatcggggtcatcattacctggatcggaatgaactcccggagcacctctctttccgtgagcctcgtgctggttggcgtcgtgacactgtacctcggggtgatggtccaggccgactctggatgtgtggtttcctggaagaacaaagaactgaagtgcggcagcgggattttcatcaccgataatgtgcacacatggacggagcagtataagtttcagcctgaatccccctctaaacttgccagcgctattcaaaaggcccacgaggaaggcatctgtggaatcagatccgtcacccgcctggagaacctcatgtggaaacagattacaccggagctgaatcatatcctgtctgaaaacgaggctaaacttaccattatgacaggcgacatcaaagggattatgcaggccggaaagcggagcctcagacctcagcccaccgaactgaaatactcctggaagacgtggggcaaggcgaaaatgctgagcaccgagtctcacaatcaaacattcctcatcgatgggcctgaaaccgccgagtgccccaacacaaatcgcgcttggaactccctggaggtggaagactatggatttggcgttttcagcaccaatatctggcttaagctgcgggagaaacaggacgtgttttgtgattctaagctcatgtccgccgctattaaagacaacagagccgtccatgcggatatgggctactggatcgaaagcgccctgaatgacacatggaagatggagaaggcttctttcattgaggtgaaaagctgccactggcctaagtcccacaccctgtggagcaacggggttcttgaatctgagatgatcattcccaaaaatttcgccggaccggtgtcccagcataactatcgccctggctaccacacgcagacagctgggccctggcatctcggaaagctggaaatggattttgacttctgtgagggcaccaccgtcgtggtgacagaagattgcgggaaccggggacccagcctgagaaccacgacagcctccggcaaactcatcaccgagtggtgctgtcggtcttgcacactgcctccgcttcgctacagaggcgaggacgggtgttggtatggaatggaaattcggcccctgaaggagaaggaagagaatctcgtcaacagcctggttaccgccggccacgggcaaatcgataatttttccctgggagtgcttggcatggctctcttcctggaagagatgctgagaacacgcgtggggaccaaacatgcgatcctcctggtcgccgtgtcttttgttacgcttattaccggaaacatgagcttccgggacctgggcagagtgatggtcatggtgggcgctacaatgaccgatgacatcgggatgggagttacatacctcgccctgctggccgcttttaaggtgcgccctaccttcgccgcgggccttctgctcagaaaactgacgtccaaggagctcatgatggctacaattgggatcgccctgctttctcagagcaccattcccgaaacaatcctggagctcaccgatgccctggctctgggaatgatggtccttaaaatcgtgcggaatatggaaaagtatcagctggccgttaccattatggcgatcctctgcgtgcctaacgctgtcattctgcaaaatgcctggaaggtgtcctgtacaatcctcgccgctgtgagcgtctctcccctgcttctgacgtccagccagcagaaagccgactggattcctctcgctctgaccatcaagggcctgaaccccacagccatctttcttaccacactgtctcgcacctccaaaaagagaagctggccgctcaatgaggcggttatggccgtggggatggtgtctattctggcttccagcctcctgaaaaacgacatccctatgacgggaccccttgtcgccggcggcctgctgacagtgtgctacgttctcaccgggcggtccgctgatctggaacttgagcgcgccgccgacgtgaagtgggaggatcaggctgaaattagcggatctagccctatcctgtccattaccatctctgaggacggcagcatgtccattaaaaatgaagaggaggaacaaacactcaccatcctgatcagaacagggctcctggtcatttctggagtgttccccgttagcatcccgattacggcggccgcttggtatctttgggaggtgaagaagcagcgggccggcgtcctgtgggatgtgccttctccccctcccgtcgggaaagccgaactggaggacggagcttaccgcatcaagcagagaggcatttttggctatagccagatcggggccggagtgtacaaagaaggcaccttccacacaatgtggcacgttaccagaggggcggtgctcatgcatcgcggaaagagaatcgagcccagctgggctgatgtcaaaaaggacctgatttcctacggcgggggatggaaacttgagggcgaatggaaagagggcgaagaggtgcaagttctggccctcgaacctgggaagaacccgcgggccgtgcagacaaaacccggactgtttaagaccaatacgggcaccatcggggctgtcagcctcgatttctctcctggaacatccggcagccccattgtggacagaaaagggaaggtggttggactgtatggcaacggcgtcgtgacccgctctggggcctacgtgtccgcgatcgctcagacagaaaagagcattgaggataatcctgaaatcgaggacgatatcttccggaaaaagagacttaccattatggacctgcaccccggagccggcaaaacaaagcgctatctgcctgccatcgtccgggaagctattaaaagagggctccgcacgctgatccttgccccgacccgggtggttgctgccgagatggaagaggcgctgagaggactccccattcgctaccagacccctgccatccgggctgagcataccggcagagaaattgtggacctgatgtgtcacgccacctttacaatgcggctcctgtcccccgtccgcgtgcctaactataaccttatcatcatggatgaggctcatttcacggaccccgcctctattgccgctagagggtacatcagcacccgggttgaaatgggcgaggcggccggaatttttatgacagctaccccgcctggctcccgcgatcccttcccccaaagcaatgcccctatcatggacgaggaaagagagattcccgaacggtcttggaactccgggcacgagtgggtgacagattttaagggaaagaccgtctggttcgtgcctagcatcaaagccggcaatgacatcgctgcctgcctgagaaagaacgggaaaaaggttattcagctgtctcgcaaaacgtttgatagcgaatatgtgaagacacgggcgaatgactgggatttcgtcgtgaccaccgacatctccgagatgggagctaactttagagccgagcgcgtgattgatccgcggagatgtatgaagcccgtcatcctcacagacggcgaggaacgcgttattctggccgggcctatgcccgtgacccactctagcgctgcccagcggagaggccgcatcggaagaaatcctaaaaacgaaaatgaccaatacatctacatgggcgagccccttgaaaacgatgaggactgcgcgcattggaaggaggccaaaatgctgctcgataatattaacacaccggaagggatcattccttccatgttcgagcccgaacgggagaaggtggacgctatcgatggagaatatcgcctgagaggcgaggcccggaaaacctttgtcgacctgatgcgcagaggggatctccctgtgtggcttgcttaccgggttgccgctgagggaattaattatgccgacagacgctggtgtttcgatggcatcaagaacaatcagattctggaagagaacgtggaagtcgagatctggacgaaagagggggaacggaagaagctgaaacccagatggctcgacgcgcgcatctactctgatcctctggcccttaaggagttcaaagaatttgctgccggccggaagtccctgacactcaacctgattaccgagatgggaagactgcccacattcatgacccagaaagctcgggacgccctcgataatcttgccgtgctgcacacggctgaagttggcgggcgcgcgtataaccatgccctgtccgagctcccggagaccctggaaacacttctgctcctgaccctgctcgctacagtgaccggaggcatctttcttttcctgatgagcgggaagggaattggcaagatgacactgggcatgtgctgcatcattaccgcctctatcctcctgtggtacgcccagatccaacctcactggattgctgcctccatcattcttgagtttttcctgatcgtcctcctgattcccgaacccgagaaacagagaacgcctcaggacaatcagctgacatatgtggtcatcgcgatcctcaccgtggttgccgctaccatggccaacgaaatggggtttcttgagaagaccaagaaggacctgggactgggcagcattatcacccaagagtccgaatctaatattctcgatatcgacctgcggccggctagcgcctggacactttacgcggtggccacgaccttcgtgacacccatgctgcgccactccattgagaactctagcgtcaatgtttccctcaccgctatcgccaaccaggctacagtgctgatggggctgggaagaggctggcctctcagcaaaatggatattggggtgccccttctggccatcggatgttactctcaggtcaatcctatcaccctgacggctgccctcctgcttctggtggcgcattatgccattatcggccccggcctccaggctaaggccacccgggaagctcaaaagcgcgccgccgcggggattatgaaaaaccctacagttgacggaatcaccgtgattgatctggagccgatcccctacgaccctaagtttgaaaaacagctgggccaggtcatgctccttgtgctgtgcgtcacacaggtgctgatgatgagaaccacgtgggctctctgtgaggccctgacacttgctaccgggcccatctccacactgtgggagggaaatcctggccggttctggaacaccaccattgccgttagcatggccaatatctttcgcgggtcttatctcgctggagccggcctgctgttctccattatgaagaacacaacgaataccagacggggcacagggaacatcggagaaaccctcggcgagaaatggaaaagcagacttaatgcgctggggaagtctgaatttcaaatttacaaaaagagcggaatccaggaggtggatcgcacactggccaaagagggcatcaagagaggggaaaccgaccaccatgctgtctccagaggatctgccaaactccgctggttcgtggagcggaacatggttacgcccgaaggcaaggtggtcgatctgggctgcgggagaggaggctggagctattactgtgggggacttaaaaacgtgcgcgaggtgaagggcctgacaaaagggggaccgggccacgaggagcctattcccatgtccacctatggctggaatctcgttcggctgcagagcggggtcgacgtgttctacacaccccctgagaaatgcgatacactgctctgtgacatcggagaatcctctcccaaccctaccattgaggctggcagaacacttcgcgtgctgaatctggtcgaaaactggctcaataacaatacgcaattttgcatcaaggttctgaacccgtacatgcccagcgtgattgagaaaatggaaacccttcagcggaagtatgggggagccctggtgagaaatcctctctcccgcaactctacacatgagatgtactgggtcagcaatgcgaccggcaacatcgtgtcctctgttaatatgatcagccggatgctgattaacagattcacaatgaaacacaagaaggccacctatgagcccgatgtggacctggggtccggaacgcgcaatatcggcattgaaaacgagatccctaacctcgacattatcggcaaaagaattgaaaagatcaaacaggagcacgaaaccagctggcattacgatcaggaccacccctataagacatgggcttaccatgggtcttatgagaccaaacaaacaggatccgccagctctatggtcaatggcgtggttcggcttctgaccaagccgtgggatgtggtccctatggtgacacagatggctatgaccgacacgacaccctttgggcagcagcgcgtgttcaaggagaaagtcgataccagaacccaagaacctaaggagggaaccaagaagctgatgcggatcacggccgaatggctctggaaagagctgggcaagaagaaaacccccagaatgtgtacacgggaggaatttacccgcaaggttagatccaacgctgcccttggggcgattttcacagacgagaataaatggaaaagcgcccgggaagctgtggaggattctcgcttttgggaactggtggacagagagcggaacctccacctggagggaaaatgcgaaacctgtgtctacaatatgatgggcaagcgcgagaaaaagctgggcgagttcgggaaggccaaaggatccagagctatctggtacatgtggctcggcgcccggtttctggagttcgaagcccttgggtttctgaacgaggatcactggttcagccgcggaaattccctcagcggcgtggagggggaaggcctgcataaacttggatatattctgagagacgtttctaaaaaggagggcggggcgatgtacgctgatgacacagccggatgggacacccggatcacgctcgaagatctgaaaaacgaggaaatggtgaccaatcacatgaagggcgagcataagaaactggccgaggctatttttaagctcacatatcagaacaaagtcgtgcgcgttcagagacctacaccccgggggacagtgatggacatcatcagccgcaaggatcagagaggatccggccaagtcgggacctacggcctgaatacgttcacaaacatggaagcccagcttattcggcagatggagggagaaggcatcttcaaatctattcaacacctgaccgtgacagaggagatcgctgttcagaattggctcgccagagtggggcgcgaacggctgagcagaatggcgatttccggagacgattgcgtcgtgaagccgcttgacgatcgctttgcctctgctctgaccgccctcaacgacatgggcaaggtccggaaagatatccagcagtgggagcctagcagagggtggaatgactggacgcaagtgcccttctgctcccatcactttcacgaactggttatgaaggatggacgcgtgctggtcgtgccctgtcggaaccaggacgagctcatcggcagagctcgcatttctcagggggccggctggagcctgaaagaaaccgcgtgccttggaaagtcctatgcccagatgtggacactgatgtacttccatcggagagatctccgcctggctgccaacgctatctgtagcgccgtgccttctcactgggttccgacctcccggacaacctggagcattcatgctaaacacgagtggatgacaaccgaggacatgcttgccgtgtggaatagagtctggatccaagaaaacccctggatggaggacaagacgcctgtggaatcttgggaggaagttccctatctgggcaagcgggaggatcagtggtgcgggtccctcattggactgacaagcagagcgacctgggccaaaaatatccagaccgctattaaccaggtgcgctccctgatcggcaatgaggaatacacagactacatgccttctatgaagcggtttagaaaagaggaagagaaggccggggtcctctggtga

SEQ ID NO: 19942 - RNA, 9876 nt, synthetic construct
  misc_feature 1..9876: note = derived and/or modified CDS sequence (opt5) from DENV-2__EU569714__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgtgatcctcctggttgctgtgtcctttgtcacgcttattaccggaaatatgtctttccgggacctgggcagagtgatggttatggtgggcgcgacaatgaccgatgacatcgggatgggagtcacatatctcgccctgctggctgcctttaaggtgcgccctaccttcgccgctggccttctgctcagaaaactgacgagcaaggagctcatgatggccacaattgggatcgcgctgctttcccagtctaccattcccgaaacaatcctggagctcaccgatgctctggccctgggaatgatggttcttaaaatcgtgcggaacatggaaaagtaccagctggccgtcaccattatggctatcagctgcgtgcctaatgccgtgattctccaaaacgcgtggaaggtctcctgtacaatcctggctgttgtgagcgtgtctcccctcctgcttacgtccagccagcagaaagccgactggattcctctggccctcaccatcaagggcctgaatcccacagctatctttctgaccacactttctcgcacctccaaaaagagaagctggccgctgaacgaggccgtcatggctgtggggatggtttctattctcgcctccagcctgctcaaaaatgacatccctatgacgggacccctggtggcgggcggccttctgacagtctgctatgtgctgaccgggcggtccgccgatctcgaactggagcgcgctgccgacgttaagtgggaggatcaggctgaaattagcggatctagccctatcctttccattaccatctctgaggacggcagcatgtccattaaaaacgaagaggaggaacaaacactgaccatcctcatcagaacagggctgctcgtgatttctggagtcttccccgtgagcatcccgattacggccgccgcttggtacctgtgggaggtcaagaagcagcgggcgggcgtgctttgggatgttcctagccctcctcccgtggggaaagccgaactggaggacggagcttatcgcatcaagcagagaggcatttttggctactctcagatcggggccggagtctataaagaaggcaccttccacacaatgtggcatgtgaccagaggggccgttctgatgcaccgcggaaagagaatcgagcccagctgggctgatgtgaaaaaggacctcatttcctacggcgggggatggaagctggagggcgaatggaaagagggcgaagaggtccaagtgcttgccctggaacctgggaagaatccgcgggcggtgcagacaaaacccggactctttaagaccaacacgggcaccatcggggctgttagcctggatttctctcctggaacatccggcagccccattgtcgacagaaaagggaaggtggtgggactctacggcaatggcgtcgtgacccgctctggggcctatgtttccgccatcgctcagacagaaaagagcattgaggataaccctgaaatcgaggacgatatcttccggaaaaagagactgaccattatggaccttcatcccggagccggcaaaacaaagcgctacctgcctgcgatcgtgcgggaagctattaaaagagggctgcgcacgctcatcctggccccgacccgggtcgtggccgctgagatggaagaggcccttagaggactgcccattcgctatcagacacccgctatccgggccgagcacaccggcagagaaattgttgacctcatgtgtcatgcgacctttacaatgcggctgctctcccccgtgcgcgtccctaactacaatctgatcatcatggatgaggcccacttcacggaccccgcttctattgccgctagagggtatatcagcacccgggtggaaatgggcgaggccgccggaatttttatgacagctaccccgcctggctcccgcgatcccttcccccaaagcaacgcgcctatcatggacgaggaaagagagattcccgaacggtcttggaactccgggcacgagtgggttacagattttaagggaaagaccgtgtggttcgtccctagcatcaaagccggcaacgacatcgctgcctgccttagaaagaatgggaaaaaggtgattcagctgtctcgcaaaacgtttgatagcgaatacgtgaagacacgggccaacgactgggatttcgtcgttaccaccgacatctccgagatgggagctaattttagagccgagcgcgtgattgatccgcggagatgtatgaagcccgtgatcctgacagacggcgaggaacgcgtcattctcgcggggcctatgcccgtgacccattctagcgctgcccagcggagaggccgcatcggaagaaaccctaaaaatgaaaacgaccaatatatctacatgggcgagcccctggaaaatgatgaggactgcgcccactggaaggaggctaaaatgcttctggataacattaatacaccggaagggatcattccttccatgttcgagcccgaacgggagaaggttgacgccatcgatggagaataccgcctcagaggcgaggcgcggaaaacctttgtggacctgatgcgcagaggggatctgcctgtctggctcgcctatcgggtggctgccgagggaattaactacgctgacagacgctggtgtttcgatggcatcaagaataaccagattcttgaagagaacgttgaagtggagatctggacgaaagagggggaacggaagaagctgaaacccagatggctggacgcccgcatctattctgatcctctcgctctgaaggagttcaaagaatttgccgcgggccggaagtcccttacactgaatctcattaccgagatgggaagactgcccacattcatgacccagaaagcccgggacgctctggataacctcgccgtccttcatacggctgaagtgggcgggcgcgcctacaatcacgccctgtccgagctgccggagaccctcgaaacactgcttctgctcaccctgctggctgcggtcacaggaggcatctttctcttccttatgagcgggaagggaattggcaagatgaccctgggcatgtgctgcatcattacagcctctatcctgctctggtatgctcagatccaacctcactggattgccgcctccatcattctggagtttttccttatcgtgctgctcattcccgaacccgagaaacagagaacccctcaggacaaccagctgacgtacgttgtgatcgctatcctgacagtggtcgccgcgaccatggccaatgaaatggggtttctcgagaagaccaaaaaggaccttggactgggcagcattatcacacaagagtccgaatctaacattctggatatcgacctccggccggctagcgcctggaccctgtatgctgttgccacaacgttcgtgacccccatgcttcgccattccattgaaaattctagcgtgaacgtctccctgacagcgatcgccaatcaggctaccgtgctcatggggctgggaagaggctggcctctgagcaaaatggatattggggttcccctccttgccatcggatgttactctcaggtgaaccctatcacactgaccgctgccctgctcctgcttgtcgctcactacgccattatcggccccggcctgcaggcgaaggccacgcgggaagctcaaaagcgcgccgctgccgggattatgaaaaatcctaccgtggacggaatcacagtcattgatctcgagccgatcccctatgaccctaagtttgaaaaacagctgggccaggtgatgctgctcgttctttgcgtgacccaggtcctgatgatgagaacaacctgggccctgtgtgaggcgctcacgctggctacagggcccatctccaccctttgggagggaaaccctggccggttctggaatacaaccattgccgtgagcatggctaacatctttcgcgggtcttacctggccggagccggcctcctgttctccattatgaagaataccacaaacacgagacggggcaccgggaatatcggagaaacactgggcgagaaatggaaaagcagactcaacgctcttgggaagtctgaatttcaaatttataaaaagagcggaatccaggaggttgatcgcaccctggccaaagagggcatcaagagaggggaaacagaccatcacgcggtgtccagaggatctgccaaactgcgctggttcgtcgagcggaacatggtgacccccgaaggcaaggtggttgatctcggctgcgggagaggaggctggagctactattgtgggggactgaaaaatgtccgcgaggtgaagggccttacgaaagggggaccgggccatgaggagcctattcccatgtccacatacggctggaacctggtgcggctccagagcggggtcgacgttttctttacaccccctgagaaatgcgataccctgctgtgtgacatcggagaatcctctcccaatcctacaattgaggctggcagaaccctccgcgtgcttaacctggtggaaaattggctgaacaataacacacaattctgcatcaaggtcctcaatccgtatatgcccagcgtgattgagaaaatggaaacgctgcagcggaagtacgggggagcccttgttagaaaccctctgtcccgcaattctacccacgagatgtactgggtgagcaacgctacaggcaatatcgtctcctctgtgaacatgatcagccggatgctcattaatagatttaccatgaaacacaagaaggccacatatgagcccgatgttgacctggggtccggaacccgcaacatcggcattgaaaacgagatccctaatctggacattatcggcaaaagaattgaaaagatcaaacaggagcatgaaacgagctggcactacgatcaggaccatccctataagacctgggcgtaccacgggtcttatgagacaaaacaaaccggatccgccagctctatggtgaacggcgtcgtgcggctccttacaaagccgtgggatgtggtccctatggttacccagatggctatgacagacaccacgcccttcgggcagcagcgcgtgtttaaggagaaagtggatacaagaacccaagaacctaaggagggaaccaaaaagctgatgcggatcacagccgaatggctgtggaaagagctcggcaagaagaaaacgcccagaatgtgtacccgggaggagttcacacgcaaggtcagatccaatgctgccctgggggctatttttaccgacgagaacaaatggaaaagcgcccgggaagcggtggaggattctcgcttctgggaacttgttgacagagagcggaatctgcacctcgagggaaaatgcgaaacatgtgtgtacaacatgatgggcaagcgcgagaaaaagctgggcgaatttgggaaggccaaaggatccagagctatctggtatatgtggctgggcgcccggttcctcgagtttgaagctctggggttccttaatgaggatcattggtttagccgcggaaactccctgagcggcgtcgagggggaaggcctccacaagctgggatacattcttagagacgtgtctaaaaaggagggcggggccatgtacgccgatgacaccgcgggatgggacacacggatcaccctggaagatctcaaaaatgaggaaatggttacgaaccatatgaagggcgagcacaagaaactggctgaggccattttcaagctgacctatcagaataaagtggtccgcgtgcagagacctacaccccgggggaccgttatggacatcatcagccgcaaggatcagagaggatccggccaagtggggacatacggcctcaacaccttcacgaatatggaagcccagctgattcggcagatggagggagaaggcatctttaaatctattcaacatcttacagtcaccgaggagatcgctgtgcagaactggctggccagagtcgggcgcgaacggctcagcagaatggctatttccggagacgattgcgtggttaagccgctggacgatcgcttcgcctctgcgcttacagccctgaatgacatgggcaaggtgcggaaagatatccagcagtgggagcctagcagagggtggaacgactggacccaagtccccttttgctcccaccacttccatgaactcgtgatgaaggatggacgcgtgctggttgtgccctgtcggaaccaggacgagctgatcggcagagctcgcatttctcagggggccggctggagcctcaaagaaacggcttgcctgggaaagtcctatgcccagatgtggacccttatgtactttcaccggagagatctgcgcctcgcggccaatgctatctgtagcgccgtcccttctcattgggtgccgacatcccggaccacatggagcattcacgctaaacacgagtggatgaccacagaggacatgctggccgtttggaacagagtgtggatccaagaaaatccctggatggaggacaagacccctgtcgaatcttgggaggaagtgccctatcttggcaagcgggaggatcagtggtgcgggtccctgattggactcacgagcagagctacatgggccaaaaacatccagaccgcgattaatcaggtccgctccctgatcggcaacgaggaatacaccgactatatgccttctatgaagcggttcagaaaagaggaagaggaagccggggtgctgtggtga

SEQ ID NO: 19943 - RNA, 9876 nt, synthetic construct
  misc_feature 1..9876: note = derived and/or modified CDS sequence (opt5) from DENV-2__EU569715__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccgtgagcatcccgattacggctgcggcctggtacctgtgggaggtcaagaagcaacgggctggcgtgctttgggatgtcccttctccccctcccgtggggaaagccgaactggaggacggagcctatcgcatcaagcagagaggcatttttggctacagccagatcggggctggagtttataaagaaggcaccttccatacaatgtggcacgtgaccagaggggccgtcctgatgcatcgcggaaagagaatcgagcccagctgggcggatgtgaaaaaggacctcatttcctacggcgggggatggaagctggagggcgaatggaaagagggcgaagaggttcaggtgcttgctctggaacctgggaagaatccgcgggccgtccaaacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcaccccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcataccggcagagaaattgtcgacctcatgtgtcacgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccagagcaacgctcctatcatggacgaggaaagagagattcccgaacggtcttggaactccgggcatgagtgggtcacagattttaagggaaagaccgtgtggttcgttcctagcatcaaagccggcaacgacatcgccgcttgccttagaaagaatgggaaaaaggtgattcaactgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccactctagcgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccaaattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccagcctcattggattgccgcttccatcattctggagtttttccttatcgtgctgctcattcccgaacccgagaaacaaagaacgcctcaggacaaccagctgacatacgtcgtgatcgccatcctgaccgttgtggcggccaccatggctaatgaaatggggtttctcgagaagaccaagaaggaccttggactgggcagcattaccacacaggagtccgaatctaacatcctggatattgacctccggccggccagcgcttggacgctgtatgccgtggcgaccacattcgtcacccccatgcttcgccactccatcgaaaattctagcgttaacgtgtccctgacagccattgctaatcaagccaccgtgctcatggggctgggaagaggctggcctctgagcaaaatggatatcggggtccccctccttgctattggatgttactctcaggtgaaccctatcacgctgaccgccgctctgctcctgcttgttgcccattacgcgatcattggccccggcctgcaggccaaggctacacgggaagcccagaagcgcgctgccgccgggatcatgaaaaatcctaccgtggacggaattacagtcatcgatctcgagccgattccctatgaccctaagtttgaaaaacaactgggccaggtgatgctgctcgtcctttgcgtgacccaggttctgatgatgagaacgacatgggcgctgtgtgaggctctcaccctggccacagggcccatctccaccctttgggagggaaaccctggccggttctggaataccacaatcgctgtgagcatggccaacatttttcgcgggtcttacctggccggagctggcctcctgttctccatcatgaagaatacgaccaacacaagacggggcaccgggaatattggagaaacactgggcgagaaatggaaaagcagactcaacgcccttgggaagtctgaatttcagatctataaaaagagcggcattcaagaggtcgatcgcaccctggcgaaagagggcatcaagagaggggaaacggaccaccatgccgtgtccagaggatctgctaaactgcgctggttcgttgagcggaacatggtgacacccgaaggcaaggtcgtggatctcggctgcgggagaggaggctggagctactattgtgggggactgaaaaatgtgcgcgaggttaagggccttaccaaagggggaccgggccacgaggagcctatccccatgtccacctacggctggaacctggtccggctccagagcggggtggacgtgttctttacaccccctgagaaatgcgataccctgctgtgtgacattggagaatcctctcccaatcctacaatcgaggccggcagaacgctccgcgtccttaacctggttgaaaattggctgaacaataacacccagttctgcattaaggtgctcaatccgtatatgcccagcgtgatcgagaaaatggaaacactgcaacggaagtacgggggagctcttgtcagaaaccctctgtcccgcaattctacccacgagatgtactgggtgagcaacgccacaggcaatattgtttcctctgtgaacatgatcagccggatgctcatcaatagatttaccatgaaacataagaaggcgacgtatgagcccgatgtcgacctggggtccggaacccgcaacattggcatcgaaaacgagattcctaatctggacatcattggcaaaagaatcgaaaagattaaacaggagcacgaaacaagctggcattacgatcaggaccacccctataagacctgggcctaccacgggtcttatgagacaaaacagaccggatccgctagctctatggtgaacggcgttgtgaagctccttacaaagccgtgggatgtcgtgcctatggtgacccaaatggccatgacggacacaacccccttcgggcagcagcgggtctttaaagagaaggttgatacccgcacacaggaacctaaagagggaacgaagaaactgatgagaatcaccgctgaatggctgtggaaggagctcggcaagaaaaagacaccccggatgtgtaccagagaggagttcacacggaaagtgcgctccaatgccgctctgggggccatctttaccgacgagaacaagtggaaaagcgcgagagaagccgtggaggattctcggttctgggaacttgtcgaccgcgagagaaatctgcatctcgagggaaagtgcgaaacatgtgtgtacaacatgatgggcaaacgggagaagaagctgggcgaatttgggaaagctaagggatcccgcgccatttggtatatgtggctgggcgctagattcctcgagtttgaagccctggggttccttaatgaggatcactggtttagccggggaaactccctgagcggcgttgagggggaaggcctccataaactgggatacatccttcgcgacgtgtctaagaaagagggcggggccatgtacgcggatgacaccgctggatgggacacgagaattaccctggaagatctcaagaatgaggaaatggtcacaaaccacatgaagggcgagcataaaaagctggccgaggccatcttcaaactgacctatcaaaataaggtggttcgggtgcagcgccctacacccgggggaaccgtcatggacattatcagcagaaaagatcagcggggctccggacaggtgggcacgtacggactcaacacattcaccaatatggaagctcaactgatccgccagatggagggcgaagggatttttaagtctatccagagacttacagttaccgaggagattgccgtgcaaaactggctggctcgggtcggaagagaacgcctcagccggatggccatctccggcgacgattgcgtggtcaagccgctggacgatagattcgcgtctgcccttacggctctgaatgacatggggaaagtgcgcaaggatattcagcagtgggagcctagccggggatggaacgactggacccaggttcccttttgctcccaccacttccatgaactcgtgatgaaagatggcagagtcctggtggtgccctgtcgcaaccaagacgagctgatcgggcgggccagaatctctcagggcgctggatggagcctcaaggaaacagcctgcctgggcaaatcctatgcgcagatgtggacccttatgtactttcaccgccgggatctgagactcgccgctaatgccatttgtagcgctgttccttctcattgggtgccgacatcccgcaccacatggagcatccacgccaagcacgagtggatgaccacggaggacatgctggctgtctggaaccgggtgtggattcaggaaaatccctggatggaggacaagacacctgttgaatcttgggaggaagtgccctatcttgggaaaagagaggatcaatggtgcggatccctgatcggcctcaccagccgggccacctgggcgaagaacattcagacagccatcaatcaggtcagatccctgattgggaacgaggaatacaccgactatatgccttctatgaaacgcttccggaaggaggaagaggaagctggagtgctgtggtga

SEQ ID NO: 19944 - RNA, 9876 nt, synthetic construct
  misc_feature 1..9876: note = derived and/or modified CDS sequence (opt5) from DENV-2__EU569716__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacaccattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttatttgcaaaaagaatatggaagggaaagtcgttctccctgagaacctggaatacacgatcgtgatcacaccccacagcggggaggagcatgcggtgggaaatgacacaggcaagcacggcaaagaaattaagatcacccctcagtcttccattacagaggccgaacttaccgggtatggaacggtcaccatggagtgtagcccccggacaggcctggatttcaacgaaatggtgctcctgcagatggaggacaaggcttggcttgttcaccgccaatggtttctggatctcccgctgccttggctgcccggggccgacacccagggatctaattggatccagaaggagacactcgtgaccttcaagaaccctcatgctaaaaagcaggacgtcgtggttctgggctcccaagaaggggccatgcacacggcccttacaggcgctaccgagattcagatgagctccggaaatctgctctttacaggccatctgaaatgcagacttcggatggataagctgcagctcaaagggatgtcttacagcatgtgtaccggaaagttcaagatcgtgaaagaaatcgcggagacccaacacggcacaattgtcatcagagtgcagtatgagggggacggatccccctgcaagattcccttcgaaatcatggatctggagaaacgctacgtcctgggccggctcattacggtgaaccctatcgttaccgaaaaggacagcccggtgaacattgaggccgaacccccttttggggattcttacatcatcattggcgtcgagcccggacagctgaaacttaattggttcaagaagggctccagcatcgggcagatgtttgagacaaccatgagaggagctaaacgcatggccattctgggcgacacagcctgggatttcgggtctctcggaggcgtgtttaccagcatcgggaaggctctgcatcaagttttcggcgccatttatggagcggctttttccggcgtgtcttggacgatgaaaatcctgatcggggtcattatcacatggattggaatgaacagccggtccaccagcctttctgtgtccctcgtgctggttggcgtcgtgaccctgtacctcggggtgatggtccaggccgacagcggatgtgtggtttcttggaagaataaagaactgaagtgcggctccgggatcttcattacagataacgtgcacacctggacagagcagtataagtttcagcctgaaagcccctccaaacttgcctctgctatccaaaaggcccacgaggaaggcatctgtggaattagaagcgtcacgcgcctggagaatctcatgtggaaacagatcaccccggagctgaaccatattctgtccgaaaatgaggtgaaacttacaatcatgaccggcgacattaaagggatcatgcaggctggaaagcggtctctcagacctcagcccacagaactgaaatacagctggaagacctggggcaaggccaaaatgctgtccacggagagccacaaccaaaccttcctcatcgatgggcctgaaacagcggagtgccccaataccaaccgcgcctggaactctctggaggttgaagactatggatttggcgtgttctccacaaacatttggcttaagctgcgggagaaacaggacgtcttttgtgatagcaagctcatgtctgctgccatcaaagacaatagagctgtgcatgccgatatgggctactggattgaatccgcgctgaacgacacctggaagatggagaaggccagcttcatcgaggttaaatcttgccactggcctaagagccacacactgtggtccaatggggtgcttgaaagcgagatgattatccccaaaaacttcgctggaccggtctctcagcataactatcgccctggctaccacacccagacggccgggccctggcatctcggaaagctggaaatggattttgacttctgtgagggcacaaccgtggtggtcaccgaagattgcgggaatcggggaccctccctgagaacaaccacggctagcggcaaactcattacagagtggtgctgtcggtcctgcaccctgcctccgcttcgctacagaggcgaggacgggtgttggtatggaatggaaatccggcccctgaaggagaaggaagagaacctcgttaattctctggtgacagccggccacgggcaaatcgataactttagcctgggagtgcttggcatggccctcttcctggaagagatgctgagaacccgcgtcgggacaaaacatgctattctcctggtggcggtttcctttgtgacccttatcacgggaaatatgtctttccgggacctgggcagagtcatggtgatggttggcgccaccatgacagatgacattgggatgggagtgacctacctcgctctgctggccgcctttaaggtccgccctacattcgctgccggccttctgctcagaaaactgaccagcaaggagctcatgatggcgacgatcgggattgctctgctttcccagtctacaatccccgaaaccatcctggagctcacagatgccctggccctgggaatgatggtgcttaaaattgttcggaacatggaaaagtatcagctggctgtgaccatcatggccattctctgcgtccctaatgcggtgatcctgcaaaacgcttggaaggtgagctgtaccattctcgccgccgtctccgttagccccctgcttctgacatcttcccagcagaaagctgactggatccctctcgccctgacgatcaagggcctgaatcccaccgctatttttcttacaaccctgagccgcacatctaaaaagagatcctggccgctcaacgaggccgtgatggcggtggggatggtcagcatcctggcctcttccctcctgaaaaatgacattcctatgaccggaccccttgtggctggcggcctgctgacggtttgctacgtgctcacagggcggagcgccgatctggaacttgagcgcgctgccgacgtcaagtgggaggatcaggccgaaatctccggaagctctcctattctgagcatcaccatttccgaggacggctctatgagcatcaaaaacgaagaggaggaacaaaccctcacaatcctgattagaaccgggctcctggtgatctccggagttttccccgtgtctattccgatcacagctgcggcctggtatctttgggaggtcaagaagcagcgggctggcgtgctgtgggatgtcccttctccccctcccgtggggaaagccgaactggaggacggagcctaccgcattaagcagagaggcatctttggctattcccagatcggggctggagtttacaaagaaggcacgttccacaccatgtggcacgtgacaagaggggccgtcctcatgcatcgcggaaagagaattgagccctcctgggcggatgtgaaaaaggacctgatcagctacggcgggggatggaaacttgagggcgaatggaaagagggcgaagaggttcaagtgctggctctcgaacctgggaagaatccgcgggccgtccagaccaaacccggactgtttaagacaaacaccggcacgattggggccgtgtccctcgatttcagccctggaacctctggctcccccatcgtggacagaaaagggaaggttgtcggactgtatggcaatggcgtggtgacacgcagcggggcttacgtctctgccattgcgcagaccgagaagtccatcgaggataaccctgaaatcgaggacgatattttccggaaaaagagacttacaatcatggacctgcaccccggagctggcaaaaccaagcgctatctgcctgccattgtgcgggaagccatcaaaagagggctccgcacactgattcttgctccgacgcgggttgtggccgctgagatggaagaggccctgagaggactccccatccgctaccagacccctgcgattcgggccgagcatacaggcagagaaatcgtcgacctgatgtgtcacgctacctttaccatgcggctcctgagccccgtgcgcgttcctaactataatcttatcattatggatgaggcccatttcacagaccccgcttccatcgccgccagagggtacatttctacgcgggtggaaatgggcgaggctgcgggaatctttatgaccgccacaccgcctggcagccgcgatcccttcccccaatccaacgctcctattatggacgaggaaagagagatccccgaacggagctggaactctgggcacgagtgggtcaccgattttaagggaaagacagtgtggttcgttccttccatcaaagccggcaacgacattgccgcttgcctgagaaagaatgggaaaaaggtgatccagctgagccgcaaaacctttgattctgaatatgtcaagacgcgggccaacgactgggatttcgtggtgacaaccgacattagcgagatgggagcgaattttagagctgagcgcgtcatcgatccgcggagatgtatgaagcccgttattctcaccgacggcgaggaacgcgtgatcctggccgggcctatgcccgtgacacactcctctgccgctcagcggagaggccgcatcggaagaaaccctaaaaatgaaaacgaccaatacatttacatgggcgagccccttgaaaatgatgaggactgcgcccattggaaggaggcgaaaatgctgctcgataacatcaataccccggaagggattatccctagcatgttcgagcccgaacgggagaaggtcgacgccattgatggagaatatcgcctgagaggcgaggctcggaaaacatttgtggacctgatgcgcagaggggatctccctgtttggcttgcctaccgggtggctgccgagggaatcaactatgctgacagacgctggtgtttcgatggcattaagaataaccagatcctggaagagaacgtcgaagtggagatctggaccaaagagggggaacggaagaagctgaaacccagatggctcgacgcccgcatttactccgatcctctggcgcttaaggagttcaaagaatttgccgctggccggaagtctctgacgctcaatctgatcacagagatgggaagactgcccaccttcatgacacagaaagcccgggacgctctcgataaccttgccgttctgcacaccgccgaagtgggcgggcgcgcttataatcatgcgctgagcgagctcccggagacgctggaaacccttctgctcctgacactgctcgccaccgtcacaggaggcatttttcttttcctgatgtccgggaagggaatcggcaagatgaccctgggcatgtgctgcattatcacagctagcatcctcctgtggtacgcccagattcaacctcactggatcgccgcttctattatccttgagtttttcctgattgtgctcctgatccccgaacccgagaaacagagaacccctcaggacaaccagctgacgtatgtcgtgatcgccattctcacagttgtggcggccaccatggctaatgaaatggggtttcttgagaagaccaaaaaggacctgggactgggctccatcattacacaagagagcgaatccaacatcctcgatattgacctgcggccggcctctgcttggaccctttacgccgtggcgacaacgttcgtcacccccatgctgcgccacagcatcgaaaatagctctgttaacgtgagcctcacagccattgctaatcaggccaccgtgctgatggggctgggaagaggctggcctctctccaaaatggatatcggggtcccccttctggctatcggatgttacagccaggtgaaccctattacactgaccgccgctctcctgcttctggttgcccattatgcgatcattggccccggcctccaggccaaggctacgcgggaagcccaaaagcgcgctgccgccgggatcatgaaaaatcctaccgtggacggaattacagtcatcgatctggagccgatcccctacgaccctaagtttgaaaaacagctgggccaggtgatgctccttgtcctgtgcgtgacccaggttctgatgatgagaacaacctgggcgctctgtgaggctctgacgcttgccacagggcccatttctaccctgtgggagggaaaccctggccggttctggaatacaaccatcgctgtgtccatggccaacatttttcgcgggagctatctcgccggagctggcctgctgttctctatcatgaagaataccacaaacacgagacggggcaccgggaatattggagaaacactcggcgagaaatggaagtccagacttaacgccctgggaaagagcgaatttcaaatctacaaaaagtctggaatccaggaggtcgatcgcaccctggcgaaagagggcattaagagaggggaaacagaccaccatgccgtgagcagaggatccgctaaactccgctggttcgttgagcggaacatggtgacccccgaaggcaaggtcgtggatctgggctgcgggagaggaggctggtcttattactgtgggggacttaaaaatgtgcgcgaggttaagggcctgacgaaagggggaccgggccacgaggagcctatccccatgagcacatatggctggaacctcgtccggctgcagtccggggtggacgtgttctttacaccccctgagaaatgcgataccctgctctgtgacattggagaaagctcccccaatcctacaatcgaggccggcagaacccttcgcgtcctgaacctggttgaaaattggctcaacaataacacacaattctgcattaaggtgctgaatccgtacatgccctctgtgatcgagaaaatggaaacgcttcagcggaagtacgggggagctctggtcagaaaccctctcagccgcaattccacccatgagatgtattgggtgtctaacgccacaggcaatatcgttagctccgtgaacatgatttctcggatgctgatcaatagatttaccatgaaacacaagaaggcgacatacgagcccgatgtcgacctggggagcggaacccgcaacattggcatcgaaaacgagattcctaatctcgacatcattggcaaaagaatcgaaaagatcaaacaggagcacgaaacgtcctggcattatgatcaggaccacccctacaagacctgggcctatcatgggagctacgagacaaaacaaaccggatctgcttccagcatggtgaacggcgttgtgcggcttctgacaaagccgtgggatgtcgtgcctatggtgacccagatggccatgacagacaccacgcccttcgggcagcagcgcgtctttaaggagaaagttgatacaagaacccaagaacctaaggagggaaccaaaaagctgatgcggattacagctgaatggctctggaaagagctgggcaagaagaaaacgcccagaatgtgtacccgggaggagttcacacgcaaggtgagatctaatgccgctcttggggccatctttaccgacgagaacaaatggaagtccgcgcgggaagccgtggaggatagccgcttctgggaactggtcgacagagagcggaatctccacctggagggaaaatgcgaaacatgtgtgtataacatgatgggcaagcgcgagaaaaagctgggcgaatttgggaaggctaaaggatctagagccatttggtacatgtggctcggcgctcggttcctggagtttgaagcccttgggttcctgaatgaggatcactggttttcccgcggaaacagcctctccggcgttgagggggaaggcctgcataaacttggatacatcctgagagacgtgagcaaaaaggagggcggggccatgtatgcggatgacaccgctggatgggacacacggattaccctcgaagatctgaaaaatgaggaaatggtcacgaaccacatgaagggcgagcataagaaactggccgaggccatcttcaagctcacctaccagaataaagtggttcgcgtgcagagacctacaccccgggggaccgtcatggacatcatttctcgcaaggatcagagaggaagcggccaagtggggacatatggcctgaacaccttcacgaatatggaagctcagcttatccggcagatggagggagaaggcatttttaaatccatccaacacctgacagttaccgaggagattgccgtgcagaactggctcgctagagtcgggcgcgaacggctgtctagaatggccatcagcggagacgattgcgtggtcaagccgcttgacgatcgcttcgcgtccgccctgacagctctcaatgacatgggcaaggtgcggaaagatatccagcagtgggagccttctagagggtggaacgactggacccaagttcccttttgcagccatcacttccacgaactggtgatgaaggatggacgcgtcctggtggtgccctgtcggtcccaggacgagctcattggcagagcccgcatctctcagggggctggctggagcctgaaagaaacggcctgccttggaaagtcctacgcgcagatgtggaccctgatgtattttcatcggagagatctccgcctggccgctaacgccatttgtagcgctgttccttctcactgggtgccgacatcccggaccacatggagcatccatgccaaacacgagtggatgaccacagaggacatgcttgctgtctggaatagagtgtggattcaagaaaacccctggatggaggacaagacccctgttgaatcttgggaggaagtgccctacctgggcaagcgggaggatcagtggtgcgggtccctcatcggactgacgagcagagccacatgggcgaaaaatattcagaccgccatcaaccaggtccgctccctgatcggcaatgaggaatataccgactacatgccttctatgaagcggttcagaaaagaggaagaggaagctggggtgctctggtga

SEQ ID NO: 19945 - RNA, 9876 nt, synthetic construct
  misc_feature 1..9876: note = derived and/or modified CDS sequence (opt5) from DENV-2__EU569717__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccgtgagcatcccgattacggctgcggcctggtacctgtgggaggtcaagaagcaacgggctggcgtgctttgggatgtcccttctccccctcccgtggggaaagccgaactggaggacggagcctatcgcatcaagcagagaggcatttttggctacagccagatcggggctggagtttataaagaaggcaccttccatacaatgtggcacgtgaccagaggggccgtcctgatgcatcgcggaaagagaatcgagcccagctgggcggatgtgaaaaaggacctcatttcctacggcgggggatggaagctggagggcgaatggaaagagggcgaagaggttcaggtgcttgctctggaacctgggaagaatccgcgggccgtccaaacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcaccccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcataccggcagagaaattgtcgacctcatgtgtcacgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccagagcaacgctcctatcatggacgaggaaagagagattcccgaacggtcttggaactccgggcatgagtgggtcacagattttaagggaaagaccgtgtggttcgttcctagcatcaaagccggcaacgacatcgccgcttgccttagaaagaatgggaaaaaggtgattcaactgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccactctagcgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccaaattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccagcctcattggattgccgcttccatcattctggagtttttccttatcgtgctgctcattcccgaacccgagaaacaaagaacgcctcaggacaaccagctgacatacgtcgtgatcgccatcctgaccgttgtggcggccaccatggctaatgaaatggggtttctcgagaagaccaagaaggaccttggactgggcagcattaccacacaggagtccgaatctaacatcctggatattgacctccggccggccagcgcttggacgctgtatgccgtggcgaccacattcgtcacccccatgcttcgccactccatcgaaaattctagcgttaacgtgtccctgacagccattgctaatcaagccaccgtgctcatggggctgggaagaggctggcctctgagcaaaatggatatcggggtccccctccttgctattggatgttactctcaggtgaaccctatcacgctgaccgccgctctgctcctgcttgttgcccattacgcgatcattggccccggcctgcaggccaaggctacacgggaagcccagaagcgcgctgccgccgggatcatgaaaaatcctaccgtggacggaattacagtcatcgatctcgagccgattccctatgaccctaagtttgaaaaacaactgggccaggtgatgctgctcgtcctttgcgtgacccaggttctgatgatgagaacgacatgggcgctgtgtgaggctctcaccctggccacagggcccatctccaccctttgggagggaaaccctggccggttctggaataccacaatcgctgtgagcatggccaacatttttcgcgggtcttacctggccggagctggcctcctgttctccatcatgaagaatacgaccaacacaagacggggcaccgggaatattggagaaacactgggcgagaaatggaaaagcagactcaacgcccttgggaagtctgaatttcagatctataaaaagagcggcattcaagaggtcgatcgcaccctggcgaaagagggcatcaagagaggggaaacggaccaccatgccgtgtccagaggatctgctaaactgcgctggttcgttgagcggaacatggtgacacccgaaggcaaggtcgtggatctcggctgcgggagaggaggctggagctactattgtgggggactgaaaaatgtgcgcgaggttaagggccttaccaaagggggaccgggccacgaggagcctatccccatgtccacctacggctggaacctggtccggctccagagcggggtggacgtgttctttacaccccctgagaaatgcgataccctgctgtgtgacattggagaatcctctcccaatcctacaatcgaggccggcagaacgctccgcgtccttaacctggttgaaaattggctgaacaataacacccagttctgcattaaggtgctcaatccgtatatgcccagcgtgatcgagaaaatggaaacactgcaacggaagtacgggggagctcttgtcagaaaccctctgtcccgcaattctacccacgagatgtactgggtgagcaacgccacaggcaatattgtttcctctgtgaacatgatcagccggatgctcgtcaatagatttaccatgaaacataagaaggcgacgtatgagcccgatgtggacctggggtccggaacccgcaacatcggcattgaaaacgagatccctaatctggacattatcggcaaaagaattgaaaagatcaaacaggagcacgaaacaagctggcattacgatcaggaccacccctataagacctgggcctaccacgggtcttatgagacaaaacagaccggatccgctagctctatggttaacggcgtggtccggctccttacaaagccgtgggatgtggtgcctatggtcacccaaatggccatgacggacacaacccccttcgggcagcagcgcgtttttaaggagaaagtggataccagaacacaggaacctaaggagggaacgaaaaagctgatgcggattaccgctgaatggctgtggaaagagctcggcaagaagaaaacacccagaatgtgtacccgggaggagttcacacgcaaggtgagatccaatgccgctctgggggccatctttaccgacgagaacaaatggaaaagcgcgcgggaagccgtcgaggattctcgcttctgggaacttgtggacagagagcggaatctgcatctcgagggaaaatgcgaaacatgtgtttacaacatgatgggcaagcgcgagaaaaagctgggcgaatttgggaaggctaaaggatccagagccatctggtatatgtggctgggcgctcggttcctcgagtttgaagccctggggttccttaatgaggatcactggtttagccgcggaaactccctgagcggcgtggagggggaaggcctccataagctgggatacattcttagagacgtctctaaaaaggagggcggggccatgtacgcggatgacaccgctggatgggacacgcggatcaccctggaagatctcaaaaatgaggaaatggtgacaaaccacatgaagggcgagcataagaaactggccgaggccattttcaagctgacctatcaaaataaagttgtgcgcgtccagagacctacaccccgggggaccgtgatggacatcattagccgcaaggatcagagaggatccggccaggttgggacgtacggcctcaacacattcaccaatatggaagctcaactgatccggcagatggagggagaaggcatctttaaatctattcagagacttacagtgaccgaggagatcgccgtccaaaactggctggctcgcgtggggcgggaaagactcagccgcatggccatttccggagacgattgcgtcgtgaagccgctggacgatcggttcgcgtctgcccttacggctctgaatgacatgggcaaggttagaaaagatatccagcagtgggagcctagccgcgggtggaacgactggacccaggtgcccttttgctcccaccacttccatgaactcgtcatgaaggatggacgggtgctggtggttccctgtagaaaccaagacgagctgattggccgcgcccggatctctcagggggctggctggagcctcaaagaaacagcctgcctgggaaagtcctatgcgcagatgtggacccttatgtactttcacagacgcgatctgcggctcgccgctaatgccatctgtagcgctgtgccttctcattgggtcccgacatccagaaccacatggagcattcacgccaaacacgagtggatgaccacggaggacatgctggctgtgtggaaccgggtttggatccaggaaaatccctggatggaggacaagacacctgtggaatcttgggaggaagtcccctatcttggcaagagagaggatcaatggtgcgggtccctgattggactcaccagccgcgccacctgggcgaaaaacatccagacagccattaatcaggtgcggtccctgatcggcaacgaggaatacaccgactatatgccttctatgaagagattccgcaaagaggaagaggaagctggggtcctgtggtga

SEQ ID NO: 19946 - RNA, 9876 nt, synthetic construct
  misc_feature 1..9876: note = derived and/or modified CDS sequence (opt5) from DENV-2__EU569718__SS-prME
  source 1..9876: mol_type = other RNA
acagccggcgtgatcattatgctgatccccacagctatggccttccacctcacgacccggaatggggagcctcatatgattgtgggacggcaggaaaagggcaagagcctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagtatgcggtgggaaatgacaccggcaagcatggcaaagaaatcaagattacacctcagtcttccatcaccgaggccgaacttacggggtacggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcacgctaaaaagcaggacgtcgtggttctgggctcccaagaaggggccatgcatacagcccttaccggcgctacagagatccagatgagctccggaaatctgctctttaccggccacctgaaatgcagacttcggatggataagctgcagctcaaagggatgtcttatagcatgtgtaccggaaagttcaagattgtgaaagaaatcgcggagacacaacatggcacgatcgtcattagagtgcagtacgagggggacggatccccctgcaagatccccttcgaaattatggatctggagaaacgccacgtcctgggccggctcatcaccgtgaaccctattgttacagaaaaggacagcccggtgaacgtcgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcatcaagtgttcggcgccatttatggagcggctttttccggcgtctcttggacaatgaaaatcctgattggggtgatcatcacctggattggaatgaacagccggtccaccagcctttctgtgtccctcgttctggtcggcgtggtgacactgtacctcggggtcatggtgcaggccgacagcggatgtgttgtgtcttggaagaataaagaactgaagtgcggctccgggatcttcattaccgataacgtccacacatggacggagcagtataagtttcagcctgaaagcccctccaaacttgcctctgctatccaaaaggcccacgaggaaggcatttgtggaatcagaagcgtgacccgcctggagaatctcatgtggaaacagatcacaccggagctgaaccatattctgtccgaaaatgaggttaaacttaccatcatgacaggcgacattaaagggatcatgcaggctggaaagcggtctctcagacctcagcccaccgaactgaaatacagctggaagacgtggggcaaggccaaaatgctgtccaccgagagccacaaccaaacattcctcattgatgggcctgaaaccgcggagtgccccaatacaaaccgcgcctggaactctctggaggtggaagactatggatttggcgtcttctccaccaacatctggcttaagctgcgggagaaacaggacgtgttttgtgatagcaagctcatgtctgctgccatcaaagacaatagagctgttcatgccgatatgggctactggattgaatccgcgctgaacgacacatggaagatggagaaggccagcttcatcgaggtgaaatcttgccactggcctaagagccacaccctgtggtccaatggggtccttgaaagcgagatgattatccccaaaaacttcgctggaccggtgtctcagcataactatcgccctggctaccacacgcagacagccgggccctggcatctcggaaagctggaaatggattttgacttctgtgagggcaccaccgtggtcgttacagaagattgcgggaatcggggaccctccctgagaaccacgacagctagcggcaaactcattaccgagtggtgctgtcggtcctgcacactgcctccgcttcgctacagaggcgaggacgggtgttggtatggaatggaaatccggcccctgaaggagaaggaagagaacctcgtcaattctctggtgaccgccggccacgggcaaattgataactttagcctgggagtccttggcatggccctcttcctggaagagatgctgagaacacgcgtggggaccaaacatgctatcctcctggttgcggtgtcctttgtcacgcttatcaccggaaatatgtctttccgggacctgggcagagtgatggttatggtgggcgccacaatgaccgatgacattgggatgggagtcacatacctcgctctgctggccgcctttaaggtgcgccctaccttcgctgccggccttctgctcagaaaactgacgagcaaggagctcatgatggcgacaatcgggattgctctgctttcccagtctaccatccccgaaacaattctggagctcaccgatgccctggccctgggaatgatggttcttaaaatcgtgcggaacatggaaaagtatcagctggctgtcaccatcatggccattagctgcgtgcctaatgcggtgatcctccaaaacgcttggaaggtctcctgtacaattctggccgccgttagcgtgtctcccctcctgcttacgtccagccagcagaaagctgactggatccctctggccctcaccattaagggcctgaatcccacagctatctttctgaccacactttctcgcacctccaaaaagagaagctggccgctgaacgaggccgtgatggcggtcgggatggtgtctatcctcgcctccagcctgctcaaaaatgacattcctatgacgggacccctggttgctggcggccttctgacagtgtgctacgtcctgaccgggcggtccgccgatctcgaactggagcgcgctgccgacgtgaagtgggaggatcaggccgaaatcagcggatctagccctattctttccatcaccatttctgaggacggcagcatgtccatcaaaaacgaagaggaggaacaaacactgaccattctcatcagaacagggctgctcgttatctctggagtgttccccgtcagcattccgatcacggctgcggcctggtatctgtgggaggtgaagaagcagcgggctggcgtcctttgggatgtgccttctccccctcccgttgggaaagccgaactggaggacggagcctaccgcattaagcagagaggcatctttggctatagccagattggggctggagtgtacaaagaaggcaccttccacacaatgtggcacgtcaccagaggggccgtgctgatgcatcgcggaaagagaatcgagcccagctgggcggatgttaaaaaggacctcatctcctacggcgggggatggaagctggagggcgaatggaaagagggcgaagaggtgcaagtccttgctctggaacctgggaagaatccgcgggccgtgcagacaaaacccggactctttaagaccaacacgggcaccattggggccgtgagcctggatttctctcctggaacatccggcagccccatcgttgacagaaaagggaaggtcgtgggactctatggcaatggcgtggtcacccgctctggggcttacgtgtccgccattgcgcagacagaaaagagcatcgaggataaccctgaaattgaggacgatatcttccggaaaaagagactgaccatcatggaccttcaccccggagctggcaaaacaaagcgctatctgcctgccattgttcgggaagccatcaaaagagggctgcgcacgctcattctggctccgacccgggtggtcgccgctgagatggaagaggcccttagaggactgcccatccgctaccagacccctgcgattcgggccgagcataccggcagagaaatcgtggacctcatgtgtcacgctacctttacaatgcggctgctctcccccgttcgcgtgcctaactataatctgattatcatggatgaggcccatttcacggaccccgcttctatcgccgccagagggtacattagcacccgggtcgaaatgggcgaggctgcgggaatctttatgacagccaccccgcctggctcccgcgatcccttcccccaaagcaacgctcctattatggacgaggaaagagagatccccgaacggtcttggaactccgggcacgagtgggtgacagattttaagggaaagaccgtttggttcgtgcctagcattaaagccggcaacgacatcgccgcttgccttagaaagaatgggaaaaaggtcatccagctgtctcgcaaaacgtttgatagcgaatatgtgaagacacgggccaacgactgggatttcgtggtcaccaccgacatttccgagatgggagcgaattttagagctgagcgcgttatcgatccgcggagatgtatgaagcccgtgattctgacagacggcgaggaacgcgtgatcctcgccgggcctatgcccgtcacccactctagcgccgctcagcggagaggccgcattggaagaaaccctaaaaatgaaaacgaccaatacatctacatgggcgagcccctggaaaatgatgaggactgcgcccattggaaggaggcgaaaatgcttctggataacatcaatacaccggaagggattatcccttccatgttcgagcccgaacgggagaaggtggacgccattgatggagaatatcgcctcagaggcgaggctcggaaaacctttgttgacctgatgcgcagaggggatctgcctgtgtggctcgcctaccgggtcgctgccgagggaatcaactatgctgacagacgctggtgtttcgatggcattaagaataaccagatccttgaagagaacgtggaagttgagatttggacgaaagagggggaacggaagaagctgaaacccagatggctggacgcccgcatctactctgatcctctcgcgctgaaggagttcaaagaatttgccgctggccggaagtcccttacactgaatctcatcaccgagatgggaagactgcccacattcatgacccagaaagcccgggacgctctggataacctcgccgtgcttcacacggccgaagtcggcgggaaggcttataatcatgcgctgtccgagctgccggagaccctcgaaacactgcttctgctcaccctgctggccacagtgaccggaggcatttttctcttccttatgagcgggaagggaatcggcaaaatgacactgggcatgtgctgcattatcaccgcttctattctgctctggtacgcccagatccaacctcactggatcgccgcttccattatcctggagtttttccttattgtcctgctcatccccgaacccgagaagcagcgcacgcctcaggacaaccagctgacatatgtggttattgccatcctgaccgtggtggcggccaccatggctaatgaaatggggtttctcgagaaaacaaagaaagaccttggactgggcagcatcaccacacaagagtccgaatctaacattctggatatcgacctcagaccggccagcgcttggacgctgtacgccgtcgcgaccacattcgttacccccatgcttcggcactccattgaaaattctagcgtgaacgtgtccctgacagccatcgctaatcaggccaccgtcctcatggggctgggacgcggctggcctctgagcaagatggatattggggtgcccctccttgctatcggatgttactctcaggttaaccctattacgctgaccgccgctctgctcctgcttgtggcccattatgcgatcatcggccccggcctgcaggccaaggctacaagagaagcccaaaaacgggctgccgccgggattatgaagaatcctaccgtcgacggaatcacagtgattgatctcgagccgatcccctacgaccctaaatttgaaaagcagctgggccaggtcatgctgctcgtgctttgcgttacccaggtgctgatgatgcgcacgacatgggcgctgtgtgaggctctcaccctggccacagggcccatttccaccctttgggagggaaaccctggcagattctggaataccacaatcgctgtcagcatggccaacatctttcgggggtcttatctggccggagctggcctcctgttctccattatgaaaaatacgaccaacacacgcagaggcaccgggaatatcggagaaacactgggcgagaagtggaaaagccggctcaacgcccttgggaaatctgaatttcaaatttacaagaaaagcggaatccaggaggtggatagaaccctggcgaaggagggcattaaacgcggggaaacggaccaccatgccgtttcccggggatctgctaagctgagatggttcgtggagcgcaacatggtcacacccgaaggcaaagtggtggatctcggctgcgggcggggaggctggagctattactgtgggggactgaagaatgttagagaggtcaagggccttaccaaagggggaccgggccacgaggaacctatccccatgtccacctatggctggaacctggtgcgcctccagagcggggtggacgtcttctttacaccccctgagaagtgcgataccctgctgtgtgacatcggagaatcctctcccaatcctacaattgaggccggccggacgctcagagttcttaacctggtggaaaattggctgaacaataacacccaattctgcatcaaagtgctcaatccgtacatgcccagcgtcattgagaagatggaaacactgcagcgcaaatacgggggagctcttgtgcggaaccctctgtccagaaattctacccatgagatgtattgggttagcaacgccacaggcaatatcgtgtcctctgtcaacatgattagccgcatgctcatcaatcggtttaccatgaagcacaagaaagcgacgtacgagcccgatgtggacctggggtccggaaccagaaacatcggcattgaaaacgagatccctaatctggacattatcggcaagcgcattgagaagatcaagcaggagcacgaaacaagctggcattatgatcaggaccacccctacaaaacctgggcctatcatgggtcttacgagacaaagcaaaccggatccgctagctctatggttaacggcgtggtcagactccttacaaagccgtgggatgtggtgcctatggtcacccagatggccatgacggacacaacccccttcgggcagcagcgggtttttaaagagaaggtggatacccgcacacaagaacctaaagagggaacgaagaaactgatgagaattaccgctgaatggctgtggaaggagctcggcaagaaaaagacaccccggatgtgtaccagagaggagttcacacggaaagtgcgctccaatgccgctctgggggccatctttaccgacgagaacaagtggaaaagcgcgagagaagccgtcgaggattctcggttctgggaacttgtggaccgcgagagaaatctgcacctcgagggaaagtgcgaaacatgtgtttataacatgatgggcaaacgggagaagaagctgggcgaatttgggaaagctaagggatcccgcgccatctggtacatgtggctgggcgctagattcctcgagtttgaagccctggggttccttaatgaggatcactggtttagccggggaaactccctgagcggcgtggagggggaaggcctccataaactgggatacattcttcgcgacgtctctaagaaagagggcggggccatgtatgcggatgacaccgctggatgggacacgagaatcaccctggaagatctcaagaatgaggaaatggtgacaaaccacatgaagggcgagcataaaaagctggccgaggccattttcaaactgacctaccagaataaggttgtgcgggtccagcgccctacacccagagggaccgtgatggacatcattagccggaaagatcagcgcggatccggccaagttgggacgtatggcctcaacacattcaccaatatggaagctcagctgatcagacagatggagggagaaggcatctttaagtctattcaacggcttacagtgaccgaggagatcgccgtccagaactggctggctagagtggggcgcgaacggctcagcagaatggccatttccggagacgattgcgtcgtgaagccgctggacgatcgcttcgcgtctgcccttacggctctgaatgacatgggcaaagttcggaaggatatccagcagtgggagcctagcagagggtggaacgactggacccaagtgcccttttgctcccaccatttccacgaactcgtcatgaaagatggacgcgtgctggtggttccctgtcggaaccaggacgagctgattggcagagcccgcatctctcagggggctggctggagcctcaaggaaacagcctgcctgggaaaatcctacgcgcagatgtggacccttatgtattttcaccggagagatctgcgcctcgccgctaatgccatctgtagcgctgtgccttctcattgggtcccgacatcccggaccacatggagcattcacgccaagcatgagtggatgaccacggaggacatgctggctgtgtggaacagagtttggatccaagaaaatccctggatggaggacaagacacctgtggaatcttgggaggaagtcccctaccttggcaaacgggaggatcagtggtgcgggtccctgattggactcaccagcagagccacctgggcgaagaacatccagacagccattaatcaggtgcgctccctgatcggcaacgaggaatataccgactacatgccttctatgaaacggttcagaaaggaggaagaggaagctggggtcctgtggtga

SEQ ID NO: 19947 - RNA, 9876 nt, synthetic construct
  misc_feature 1..9876: note = derived and/or modified CDS sequence (opt5) from DENV-2__EU596488__SS-prME
  source 1..9876: mol_type = other RNA
accgccggcgtgatcattatgctgatccccaccgtcatggctttccacctcacgacccggaatggggagcctcatatgattgttggacggcaggaaaagggcaagagcctgctttttaagaccgaggacggggtgaatatgtgcaccctgatggccatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtcgcgctcgtgcctcatgttggaatgggcctggagaccagaacggaaacatggatgtcctctgagggcgcttggaagcacgtgcagcggatcgagacctggattctgcgccatcccgggttcacaatcatggccgccattctcgcttacaccatcggaaccacacactttcagagagccctgattttcatccttctgacggctgtcgcccctagcatgaccatgcggtgcattggcatctccaaccgcgattttgtggaaggggtttctggaggcagctgggtggacatcgtcctcgagcacgggtcctgtgtgacaaccatggcgaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtcacatgcgctatgtttacgtgcaaaaagaatatggaagggaaagttgtgctccctgagaacctggaatacaccattgtgatcacaccccacagcggggaggagcatgccgtcggaaatgacaccggcaagcacggcaaagaaatcaagattacacctcagtcttccatcaccgaggcggaacttacggggtatggaaccgtgacaatggagtgtagcccccggaccggcctggatttcaacgaaatggttctcctgcagatggaggacaaagcctggcttgtgcaccgccaatggtttctggatctcccgctgccttggctgcccggggctgacacacagggatctaattggattcagaaggagaccctcgtcacgttcaagaaccctcatgccaaaaagcaggacgtggttgtgctgggctcccaagaaggggctatgcacacagcccttaccggcgccacagagatccagatgagctccggaaatctgctctttaccggccatctgaaatgcagacttcggatggataagctgcagctcaaagggatgtcttacagcatgtgtaccggaaagttcaagattgtcaaagaaatcgctgagacacaacacggcacgatcgtgattagagtccagtatgagggggacggatccccctgcaagatccccttcgaaattatggatctggagaaacgccatgtgctgggccggctcatcaccgttaaccctattgtgacagaaaaggacagcccggtcaacatcgaggcggaacccccttttggggattcttacattatcatcggcgtggagcccggacagctgaaacttaattggttcaagaagggctccagcattgggcagatgtttgagaccacaatgagaggagccaaacgcatggctatcctgggcgacaccgcctgggatttcgggtctctcggaggcgtttttacgagcattgggaaggccctgcaccaagtgttcggcgctatctacggagccgcgttttccggcgtctcttggacaatgaaaattctgatcggggtgatcattacctggatcggaatgaacagccggtccaccagcctttctgtgtccctcgttctggtcggcgtggtgacactgtatctcggggtcatggtgcaggctgacaccggatgtgttgtgagctggaagaataaagaactgaagtgcggctctgggattttcatcacagataacgtccacacgtggaccgagcagtacaagtttcagcctgaatcccccagcaaacttgcctccgccattcaaaaggctcatgaggaaggcatctgtggaatcagatctgtgacacgcctggagaatctcatgtggaaacagattaccccggagctgaaccacatcctgagcgaaaatgaggttaaacttacaattatgaccggcgacatcaaagggattatgcaggccggaaagcggtccctcagacctcagcccacggaactgaaatattcttggaagacctggggcaaggctaaaatgctgagcacagagtcccataaccaaaccttcctcatcgatgggcctgaaacagccgagtgccccaataccaaccgcgcgtggaatagcctggaggtggaagactacggatttggcgtcttctctacaaacatctggcttaagctgcgggagaaacaggacgtgttttgtgattccaagctcatgagcgccgctattaaagacaatagagccgttcacgctgatatgggctattggatcgaatctgccctgaacgacacctggaagatggagaaggcgtccttcattgagatcaaaagctgccactggcctaagtctcatacgctgtggagcaatggggtgcttgaatccgagatgattatccccaaaaacttcgccggaccggtcagccagcacaactaccgccctggctatcatacacagaccgctgggccctggcacctcggaaagctggaaatggattttgacttctgtgagggcaccacagtggtggtcaccgaagattgcgggaatcggggaccctctctgagaacgacaaccgcctccggcaaactcattacagagtggtgctgtcggagctgcaccctgcctccgcttcgctacagaggcgaggacgggtgttggtacggaatggaaatccggcccctgaaggagaaggaagagaacctcgttaattccctggtgacagctggccatgggcaaatcgataacttttctctgggagtgcttggcatggccctcttcctggaagagatgctgagaacccgcgtcgggacgaaacacgccattctcctggtggctgttagctttgtgacccttatcacaggaaatatgtccttccgggacctgggcagagtcatggtgatggttggcgcgaccatgacagatgacattgggatgggagtgacctatctcgccctgctggctgcctttaaggtccgccctacgttcgccgctggccttctgctcagaaaactgacatctaaggagctcatgatggccaccatcgggattgcgctgcttagccagtccacaatccccgaaaccatcctggagctcaccgatgctctggccctgggaatgatggtgcttaaaattgttcggaacatggaaaagtaccagctggccgtgacaatcatggctatttcttgcgtccctaatgccgtgatcctccaaaacgcgtggaaggtgagctgtacgattctggctgccgtctccgttagccccctcctgcttacctcttcccagcagaaagccgactggatccctctggctctcacaatcaagggcctgaatcccaccgccatttttctgacaacccttagccgcacgtctaaaaagagatcctggccgctgaacgaggctgtgatggccgtggggatggtcagcatcctcgcgtcttccctgctcaaaaatgacattcctatgacaggacccctggtggccggcggccttctgaccgtttgctatgtgctgaccgggcggagcgctgatctcgaactggagcgcgccgctgacgtcaagtgggaggatcaggccgaaatctccggaagctctcctattcttagcatcacaatttccgaggacggctctatgagcatcaaaaacgaagaggaggaacacaccctgacaatcctcattagaacggggctgctcgtgatctccggagttttccccgtgtctattccgatcaccgccgctgcgtggtacctgtgggaggtcaagaagcaacgggccggcgtgctttgggatgtcccttctccccctcccgtggggaaagctgaactggaggacggagcctatcgcattaagcagagaggcatctttggctactcccagatcggggccggagtttataaagaaggcacattccataccatgtggcacgtgacaagaggggctgtcctgatgcatcgcggaaagagaattgagccctcctgggccgatgtgaaaaaggacctcatcagctacggcgggggatggaagctggagggcgaatggaaagagggcgaagaggttcaggtgcttgcgctggaacctgggaagaatccgcgggctgtccaaaccaaacccggactctttaagacgaacaccggcacaattggggccgtgtccctggatttcagccctggaacctctggctcccccatcgtggacagaaaagggaaggttgtcggactctacggcaatggcgtggtgacacgcagcggggcctatgtctctgctattgcccagaccgagaagtccatcgaggataaccctgaaatcgaggacgatattttccggaaaaagagactgacaatcatggaccttcaccccggagcgggcaaaacgaagcgctacctgcctgctattgtgcgggaagccatcaaaagagggctgcgcaccctcattctggccccgacacgggttgtggctgccgagatggaagaggctcttagaggactgcccatccgctatcagacccctgccattcgggcggagcataccggcagagaaatcgtcgacctcatgtgtcacgccacatttacgatgcggctgctcagccccgtgcgcgttcctaactacaatctgatcattatggatgaggctcacttcaccgaccccgcctccatcgctgccagagggtatatttctacacgggtggaaatgggcgaggccgctggaatctttatgaccgcgacaccgcctggcagccgcgatcccttcccccagtccaacgcccctattatggacgaggaaagagagatccccgaacggagctggaactctgggcatgagtgggtcaccgattttaagggaaagacggtgtggttcgttccttccatcaaagctggcaacgacattgccgcctgccttagaaagaatgggaaaaaggtgatccaactgagccgcaaaacatttgattctgaatacgtcaagacccgggctaacgactgggatttcgtggtgaccacagacattagcgagatgggagccaattttagagcggagcgcgtcatcgatccgcggagatgtatgaagcccgttattctgaccgacggcgaggaacgcgtgatcctcgctgggcctatgcccgtgacacactcctctgccgcccagcggagaggccgcatcggaagaaaccctaaaaatgaaaacgaccagtatatttacatgggcgagcccctggaaaatgatgaggactgcgctcattggaaggaggccaaaatgcttctggataacatcaataccccggaagggattatccctagcatgttcgagcccgaacgggagaaggtcgacgcgattgatggagaataccgcctcagaggcgaggcccggaaaacgtttgtggacctgatgcgcagaggggatctgcctgtttggctcgcttatcgggtggccgctgagggaatcaactacgccgacagacgctggtgtttcgatggcattaagaataaccaaatccttgaagagaacgtcgaagtggagatctggacaaaagagggggaacggaagaagctgaaacccagatggctggacgctcgcatttattccgatcctctcgccctgaaggagttcaaagaatttgcggccggccggaagtctcttaccctgaatctcatcacagagatgggaagactgcccaccttcatgacgcagaaagctcgggacgccctggataacctcgctgttcttcacaccgccgaagtgggcgggcgcgcctacaatcacgctctgagcgagctgccggagacactcgaaaccctgcttctgctcacactgctggcgaccgtcacaggaggcatttttctcttccttatgtccgggaagggaatcggcaagatgaccctgggcatgtgctgcattatcacggccagcatcctgctctggtatgctcagattcagcctcattggatcgccgcctctattatcctggagtttttccttattgtgctgctcatccccgaacccgagaaacaaagaacacctcaggacaaccagctgacctacgtcgtgatcgctattctgaccgttgtggccgcgacaatggccaatgaaatggggtttctcgagaagaccaaaaaggaccttggactgggctccatcacaacgcaggagagcgaatccaacattctggatatcgacctccggccggcttctgcctggaccctgtatgctgtggccacaaccttcgtcacacccatgcttcgccacagcattgaaaatagctctgttaacgtgagcctgaccgcgatcgccaatcaagctacggtgctcatggggctgggaagaggctggcctctgtccaaaatggatattggggtccccctccttgccatcggatgttacagccaggtgaaccctatcaccctgacagctgccctgctcctgcttgttgctcattacgccattatcggccccggcctgcaggcgaaggccacccgggaagctcagaagcgcacagccgctgggattatgaaaaatcctaccgtggacggaatcacggtcattgatctcgagccgatcccctatgaccctaagtttgaaaaacaactgggccaggtgatgctgctcgtcctttgcgtgacacaggttctgatgatgagaaccacatgggccctgtgtgaggccctcaccctggcgaccgggcccatctctacactttgggagggaaaccctggccggttctggaatacgaccattgctgtgtccatggccaacatctttcgcgggagctacctggctggagccggcctcctgttctctattatgaagaatacaatcaacaccagacggggcacagggaatattggagaaaccctgggcgagaaatggaagtccagactcaacgcccttggaaagagcgaatttcagatctataaaaagtctggaatccaagaggtcgatcgcacgctggctaaagagggcattaagagaggggaaacagaccaccatgccgtgagcagaggatccgcgaaactgcgctggttcgttgagcggaacatggtgacccccgaaggcaaggtcgtggatctcggctgcgggagaggaggctggtcttactattgtgggggactgaaaaatgtgcgcgaggttaagggccttaccaaagggggaccgggccacgaggagcctatccccatgagcacatacggctggaacctggtccggctccagtccggggtggacgtgttctttacaccccctgagaaatgcgatacactgctgtgtgacattggagaaagctcccccaatcctacgatcgaggccggcagaaccctccgcgtccttaacctggttgaaaattggctgaacaataacacacagttctgcgtgaaggtgctcaatccgtatatgccctctgtcattgagaaaatggaaaccctgcaacggaagtacgggggagctcttgtgagaaaccctctgagccgcaattccacacacgagatgtactgggtttctaacgccaccggcaatatcgtgagctccgtcaacatgatctctcggatgctcattaatagatttacgatgaaacataagaaggctacctatgagcccgatgtggacctggggagcggaacacgcaacatcggcattgaaaacgagatccctaatctggacattatcggcaaaagaattgaaaagatcaaacaggagcacgaaacctcctggcattacgatcaggaccacccctataagacatgggcctaccacgggagctatgagaccaaacagacaggatctgcgtccagcatggttaacggcgtggtcaagctccttaccaagccgtgggatgtggtgcctatggtcacgcaaatggccatgacagacaccacccccttcgggcagcagcgggtttttaaagagaaggtggatacacgcacgcaggaacctaaagagggaaccaagaaactgatgagaatcacagctgaatggctgtggaaggagctcggcaagaaaaagacaccccggatgtgtacaagagaggagttcacccggaaagtgcgctctaatgccgctctgggggccatttttacagacgagaacaagtggaaatccgctagagaagccgtcgaggatagccggttctgggaacttgtggaccgcgagagaaatctgcatctcgagggaaagtgcgaaacctgtgtttacaacatgatgggcaaacgggagaagaagctgggcgaatttgggaaagcgaagggatctcgcgccatctggtatatgtggctgggcgctagattcctcgagtttgaagccctggggttccttaatgaggatcactggttttcccggggaaacagcctgtccggcgtggagggggaaggcctccataaactgggatacattcttcgcgacgtcagcaagaaagagggcggggctatgtacgccgatgacacggccggatgggacaccagaatcacactggaagatctcaagaatgaggaaatggtgaccaaccacatgaagggcgagcataaaaagctggcggaggctattttcaaactgacatatcaaaataaggttgtgcgggtccagcgccctacccccagagggacggtgatggacatcatctctcggaaagatcagcgcggaagcggccaggttgggacatacggcctcaacaccttcacaaatatggaagcccaactgattagacagatggagggagaaggcatctttaagtccattcagcggcttaccgtgacggaggagatcgccgtccaaaactggctggctagagtggggcgcgaacggctctctagaatggccattagcggagacgattgcgtcgtgaagccgctggacgatcgcttcgcttccgcccttaccgcgctgaatgacatgggcaaagttcggaaggatatccagcagtgggagccttctagagggtggaacgactggacacaggtgcccttttgcagccaccacttccatgaactcgtcatgaaagatggacgcgtgctggtggttccctgtcggaaccaagacgagctgatcggcagagcccgcatttcccagggggctggctggtctctcaaggaaaccgcctgcctgggaaaaagctatgctcagatgtggacacttatgtactttcaccggagagatctgcgcctcgccgcgaatgccatctgttccgctgtgcctagccattgggtcccgacctctcggacaacctggtccattcacgccaagcacgagtggatgacgacagaggacatgctggctgtgtggaacagagtttggatccaggaaaatccctggatggaggacaagacccctgtggaaagctgggaggaagtcccctatcttggcaaacgggaggatcaatggtgcgggtctctgattggactcacctccagagccacatgggctaagaacatccagaccgccattaatcaggtgcgcagcctgatcggcaacgaggaatacacagactatatgccttccatgaaacggttcagaaaggaggaagaggaagcgggggtcctgtggtga

SEQ ID NO: 19948 - RNA, 9876 nt, synthetic construct
  misc_feature 1..9876: note = derived and/or modified CDS sequence (opt5) from DENV-2__EU596489__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaaccatggccgctatcctcgcctacaccattggaacaacgcactttcagagagctctgatcttcattcttctgaccgccgtggcgcctagcatgacaatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacggaggctaagcagcctgccacactgagaaaatattgcattgaagctaagctcaccaacaccacaaccgagagccggtgtccgacacaaggagagccctctctgaatgaagagcaggacaaacgctttatctgcaagcattccatggtggatagaggctggggcaacgggtgtggactgttcggcaaggggggaattgtgacgtgcgccatgtttacctgcaaaaagaatatggaaggcaaagtcgttctccctgagaacctggaatacacaatcgtgattaccccccacagcggggaggagcatgcggtgggaaatgacacaggcaagcacggcaaagaaatcaagatcacccctcagtcttccattacggaggccgaacttaccgggtatggaacagtcaccatggagtgtagcccccggacaggcctggatttcaacgaaatggtgctcctgcagatggaggacaaagcttggcttgttcaccgccaatggtttctggatctcccgctgccttggctgcccggggccgacacccagggatctaattggatccagaaggagacgctcgtgacattcaagaaccctcatgctaaaaagcaggacgtcgtggttctgggctcccaagaaggggccatgcacaccgcccttacaggcgctaccgagattcagatgagctccggaaatctgctctttaccggccatctgaaatgcagacttcggatggataagctgcagctcaaagggatgtcttacagcatgtgtacaggaaagttcaagatcgtgaaagaaattgcggagacgcaacacggcaccatcgtcatcagagtgcagtatgagggggacggatccccctgcaagattcccttcgaaatcatggatctggagaaacgccatgtcctgggccggctcattacagtgaaccctatcgttaccgaaaaggacagcccggtgaacattgaggccgaacccccttttggggattcttacatcattatcggcgtcgagcccggacagctgaaacttaattggttcaagaagggctccagcatcgggcagatgtttgagacaaccatgagaggagctaaacgcatggccattctgggcgacacggcctgggatttcgggtctctcggaggcgtgtttacaagcatcgggaaggctctgcaccaagttttcggcgccatttacggagcggctttttccggcgtgtcttggaccatgaaaatcctgattggggtcatcatcacctggattggaatgaacagccggtccacaagcctttctgtgtccctcgtgctggttggcatcgtcaccctgtatctcggggtgatggtgcaggccgacacaggatgtgtcgtgagctggaagaataaagaactgaagtgcggctctgggattttcatcacggataacgttcacacctggacagagcagtacaagtttcagcctgaattcccctccaaacttgccagcgctattaagaaagcccatgaggaaggcatctgtggaatcagatccgtgacccgcctggagaatctcatgtggaagcaaattacaccggagctgaaccacatcctgtctgaaaatgaggtcaaacttaccattatgacgggcgacatcaaggggattatgcaggctggaaaacggagcctcagacctcagcccaccgaactgaagtattcctggaagacatggggcaaagccaagatgctgtctaccgagagccataaccagacatttctcatcgatgggcctgaaaccgcggagtgccccaatacaaaccgcgcctggaattccctggaggtggaagactacggattcggcgtttttagcaccaacatctggcttaaactgcgggagaagcaagacgtgttctgtgattctaaactcatgtccgctgccattaaggacaatagagctgtccacgccgatatgggctattggatcgaaagcgcgctgaacgacacgtggaagatggagaaagcctctttcattgagatcaagtcctgccactggcctaaaagccatacactgtggtctaatggggtgcttgaaagcgagatgattatccccaagaactttgctggaccggtttcccagcacaactaccgccctggctatcatacccagaccgccgggccctggcacctcggaaaactggaaatggatttcgacttttgtgagggcacaaccgtggtcgtgacggaagattgcgggaatcggggacccagcctgagaacaaccacagcttctggcaagctcattaccgagtggtgctgtcggtcctgcacactgcctccgcttcgctacagaggcgaggacgggtgttggtacggaatggaaatccggcccctgaaggagaaagaagagaacctcgtgaatagcctggtcaccgccggccatgggcagatcgataacttctccctgggagttcttggcatggccctctttctggaagagatgctgagaacgcgcgtggggaccaagcacgctattctcctggtggcggtctctttcgtgacacttatcaccggaaatatgagctttcgggacctgggcagagttatggtgatggtcggcgccacaatgaccgatgacattgggatgggagtgacgtatctcgctctgctggccgccttcaaagttcgccctacatttgctgccggccttctgctcagaaagctgacctccaaagagctcatgatggcgacaatcgggattgctctgctttctcaaagcaccatccccgaaaccatcctggagctcacagatgccctggccctgggaatgatggtgcttaagattgtccggaacatggaaaagtaccagctggctgtgacgatcatggccatttcctgcgttcctaatgcggtgatcctccagaacgcttggaaagtctcttgtaccattctggccgccgtgagcgtgtcccccctcctgcttacaagctctcaacagaaggctgactggatccctctggccctcaccatcaaaggcctgaatcccacagctattttcctgaccacgctttcccgcacaagcaagaaaagatcttggccgctgaacgaggccgtcatggcggttgggatggtgtccatcctcgccagctctctgctcaagaatgacattcctatgaccggacccctggtggctggcggccttctgaccgtctgctatgtgctgacagggcggtccgccgatctcgaactggagaaagctgccgacgttaagtgggaggatcaggccgaaatcagcggatccagccctattctttctatcaccattagcgaggacggctccatgtctatcaagaacgaagaggaggaacacacactgacgatcctcattcgcaccgggctgctcgtgatcagcggagtctttcccgtgtccattccgatcacagctgcggcctggtacctgtgggaggttaaaaagcagagagctggcgtgctttgggatgtcccttctccccctcccgtggggaaagccgaactggaggacggagcctatcggattaagcaacgcggcatcttcggctacagccagatcggggctggagtctataaagaaggcacctttcatacaatgtggcacgtgaccagaggggccgttctgatgcatcggggaaagcgcattgagccctcctgggcggatgtgaagaaagacctcatctcttacggcgggggatggaagctggagggcgaatggaaagagggcgaagaggtccaggtgcttgctctggaacctgggaagaatccgagagccgttcagacgaaacccggactcttcaagaccaacacaggcaccattggggccgtgagcctggatttctcccctggaacaagcggctctcccatcgtcgaccggaaggggaaagtggtgggactctacggcaatggcgttgtcaccagatccggggcttatgtgagcgccattgcgcaaacagagaagtctatcgaggataaccctgaaatcgaggacgatatttttcgcaaaaagcggctgacgatcatggaccttcaccccggagctggcaaaaccaagagatacctgcctgccattgtgcgcgaagccatcaagcgggggctgagaacactcattctggctccgacccgcgtcgtggccgctgagatggaagaggcccttcggggactgcccatcagatatcagacccctgcgattcgcgccgagcatacaggccgggaaatcgttgacctcatgtgtcacgctacgttcaccatgagactgctctcccccgtgcgggtccctaactacaatctgatcattatggatgaggcccactttacagaccccgctagcatcgccgcccgcgggtatatttccaccagagtggaaatgggcgaggctgcgggaatcttcatgacagccaccccgcctggctctcgggatccctttccccagagcaacgctcctattatggacgaggaacgcgagatccccgaaagatcctggaatagcgggcatgagtgggttacggatttcaaaggaaagacagtgtggtttgtcccttctatcaaagccggcaacgacattgccgcttgccttcggaagaatgggaaaaaggtgatccagctgtccagaaagaccttcgatagcgaatacgttaaaacccgcgccaacgactgggattttgtggtcacaaccgacatttctgagatgggagcgaatttccgggctgagagagtgatcgatccgcgccggtgtatgaagcccgtgattctgacagacggcgaagagagagtcatcctcgccgggcctatgcccgttacccacagctccgccgctcaacgccggggcagaatcggacgcaaccctaaaaatgaaaacgaccagtatatttacatgggcgagcccctggaaaatgatgaggactgcgcccattggaaggaggcgaaaatgcttctggataacatcaatacgccggaagggattatcccttctatgtttgagcccgaaagagagaaggtggacgccattgatggagaataccggctccgcggcgaggctagaaaaacattcgtggacctgatgcggcgcggggatctgcctgtctggctcgcctatagagtggctgccgagggaatcaactacgctgaccggagatggtgtttcgatggcattaagaataaccagatccttgaagagaacgttgaagtggagatctggaccaaggagggggaacgcaaaaagctgaaaccccggtggctggacgccagaatttatagcgatcctctcgcgctgaaggagtttaaagaattcgccgctggccgcaagtcccttacactgaatctcatcaccgagatgggacggctgcccacgtttatgacccaaaaggccagagacgctctggataacctcgccgtccttcacacagccgaagtgggcgggcgggcttacaatcacgcgctgtctgagctgccggagaccctcgaaacactgcttctgctcaccctgctggccacagttaccggaggcattttcctctttcttatgagcgggaaaggaatcggcaagatgacgctgggcatgtgctgcattatcacagcttccatcctgctctggtatgcccagattcagcctcattggatcgccgctagcattatcctggagttctttcttattgtgctgctcatccccgaacccgagaaacagcgcacccctcaagacaaccagctgacctacgtcgtgatcgccattctgacagtcgtggcggccaccatggctaatgaaatggggttcctcgagaagacaaaaaaggaccttggactgggctctatcacgacccaggagtccgaaagcaacattctggatatcgacctcagaccggcctccgcttggacactgtatgccgttgcgaccacatttgtgacccccatgcttcggcactctattgagaatagctccgtgaacgtctctctgacggccatcgctaatcaggccaccgttctcatggggctgggacgcggctggcctctgagcaagatggatattggggtgcccctccttgctatcggatgttactcccaagtgaaccctatcacactgaccgccgctctgctcctgcttgtcgcccattacgcgattatcggccccggcctgcaggccaaagctacaagagaagcccagaagcggaccgctgccgggattatgaaaaatcctacggtggacggaatcacagttattgatctcgagccgatcccctatgaccctaagttcgaaaaacagctgggccaagtgatgctgctcgtcctttgcgtgacccaggtcctgatgatgcgcacaacctgggccctgtgtgaggcgctcaccctggctacagggcccatcagcacgctttgggagggaaaccctggcagattttggaataccacaattgccgtgtctatggctaacatcttccgggggtcctacctggccggagccggcctcctgtttagcattatgaagaataccacaaacacccgcagaggcacggggaatatcggagaaacactgggcgagaagtggaaatctcggctcaacgctcttgggaagtccgaattccagatttataaaaagagcggaatccaggaggttgatagaaccctggccaaagagggcatcaagcgcggggaaaccgaccaccatgcggtgtctcggggaagcgccaaactgagatggttcgtcgagcgcaacatggtgacacccgaaggcaaggttgtggatctcggctgcgggcggggaggctggtcctactattgtgggggactgaagaatgtcagagaggtgaaaggccttaccaaggggggaccgggccacgaagagcctattcccatgtctacatacggctggaacctggtgcgcctccaaagcggggttgacgtctttttcacgccccctgagaaatgcgataccctgctgtgtgacatcggagaatccagccccaatcctacaattgaggctggccggaccctcagagtgcttaacctggtggaaaattggctgaacaataacacacagttttgcgtcaaggttctcaatccgtatatgccctccgtgatcgagaaaatggaaaccctgcagcgcaagtacgggggagcccttgtgcggaaccctctgtctagaaatagcacgcacgagatgtactgggtctccaacgctaccggcaatattgtgtctagcgttaacatgatctcccgcatgctcatcaatcggttcacaatgaagcataaaaaggccacctatgagcccgatgtggacctggggtctggaacaagaaacattggcatcgaaaacgagattcctaatctggacatcattggcaaacgcatcgaaaagattaaacaagagcacgaaaccagctggcattacgatcaggaccacccctataagacatgggcgtaccacgggtcctatgagaccaagcagacgggaagcgcctcttccatggtcaacggcgtggttaaactccttacaaagccgtgggatgtggtccctatggtgacccagatggctatgaccgacacaacgccctttgggcaacagagagtgttcaaagagaaggtcgatacccggacacaggaacctaaagagggaaccaagaagctgatgcgcatcacagccgaatggctgtggaaagagctcggcaagaaaaagacccccagaatgtgtacacgggaggaatttaccagaaaagttcggagcaatgctgccctgggggctatcttcacggacgagaacaagtggaaatctgcccgcgaagcggtggaggattccagattttgggaacttgtggaccgggagcgcaatctgcatctcgagggaaagtgcgaaacctgtgtctacaacatgatgggcaagagagagaaaaagctgggcgaattcgggaaagccaagggaagccgggctatttggtatatgtggctgggcgcccgctttctcgagttcgaagctctggggtttcttaatgaggatcactggttctctagaggaaactccctgagcggcgtggagggggaaggcctccataaactgggatacatccttcgggacgtttccaagaaggagggcggggccatgtacgccgatgacacagcgggatgggacacccgcattacactggaagatctcaaaaatgaggaaatggtgaccaaccacatgaagggcgagcataaaaagctggctgaggccatcttcaaactgacgtatcagaataaggtcgtgagagttcaacggcctacaccccgcgggaccgtgatggacattatcagcagaaaggatcagcggggatctggccaggtcgggacatacggcctcaacacctttacgaatatggaagcccagctgatccgccaaatggagggagaaggcattttcaaaagcatccagagacttaccgtgacagaggagattgctgttcagaactggctggcccgggtggggagagaacgcctctcccggatggctatctctggagacgattgcgtcgtgaagccgctggacgatagatttgccagcgcgcttaccgccctgaatgacatgggcaaagtccgcaaggatattcaacagtgggagccttcccgggggtggaacgactggacacaggtgcccttctgctctcaccactttcatgaactcgttatgaaagatggaagaatgctggtggtcccctgtcgcaaccaggacgagctgatcggccgggctagaatcagccaaggggccggctggtccctcaaggaaaccgcttgcctgggaaagtcttatgcccagatgtggacacttatgtacttccaccgccgggatctgagactcgcggccaatgctatttgtagcgccgtgccttcccattgggtgccgaccagccgcacgacatggtctatccacgctaaacacgagtggatgaccaccgaggacatgctggccgtttggaaccgggtgtggattcaggaaaatccctggatggaggacaagacacctgtcgaatcctgggaggaagtgccctatcttggcaaaagagaggatcagtggtgcgggagcctgatcggactcacctctcgggctacatgggccaagaacattcaaacggcgatcaatcaggttagatccctgattggcaacgaggaatacaccgactatatgcctagcatgaaacgctttcggaaggaggaagaggaagccggggtgctgtggtga

SEQ ID NO: 19949 - RNA, 9876 nt, synthetic construct
  misc_feature 1..9876: note = derived and/or modified CDS sequence (opt5) from DENV-2__EU596490__SS-prME
  source 1..9876: mol_type = other RNA
accgccggagtgatcattatgctgatccccacagtcatggctttccacctcacgacccggaatggggagcctcatatgattgttggacggcaggaaaagggcaagagcctgctttttaagacagaggacggggtgaatatgtgcaccctgatggccatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtcgcgctcgtgcctcatgttggaatgggcctggagaccagaacggaaacatggatgtcctctgagggcgcttggaagcacgtgcagcggatcgagacctggattctgcgccatcccgggttcacaatcatggccgccattctcgcttacaccatcggaaccacacactttcagagagccctgattttcatccttctgacggctgtcgcccctagcatgaccatgcggtgcattggcatctccaaccgcgattttgtggaaggggtttctggaggcagctgggtggacatcgtcctcgagcacgggtcctgtgtgacaaccatggcgaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtcacatgcgctatgtttacgtgcaaaaagaatatggaagggaaagttgtgctccctgagaacctggaatacaccattgtgatcacaccccacagcggggaggagcatgccgtcggaaatgacaccggcaagcacggcaaagaaatcaagattacacctcagtcttccatcaccgaggcggaacttacggggtatggaaccgtgacaatggagtgtagcccccggaccggcctggatttcaacgaaatggttctcctgcagatggaggacaaagcctggcttgtgcaccgccaatggtttctggatctcccgctgccttggctgcccggggctgacacacagggatctaattggattcagaaggagaccctcgtcacgttcaagaaccctcatgccaaaaagcaggacgtggttgtgctgggctcccaagaaggggctatgcacacagcccttaccggcgccacagagatccagatgagctccggaaatctgctctttaccggccatctgaaatgcagacttcggatggataagctgcagctcaaagggatgtcttacagcatgtgtaccggaaagttcaagattgtcaaagaaatcgctgagacacaacacggcacgatcgtgattagagtccagtatgagggggacggatccccctgcaagatccccttcgaaattatggatctggagaaacgccatgtgctgggccggctcatcaccgttaaccctattgtgacagaaaaggacagcccggtcaacatcgaggcggaacccccttttggggattcttacattatcatcggcgtggagcccggacagctgaaacttaattggttcaagaagggctccagcattgggcagatgtttgagaccacaatgagaggagccaaacgcatggctatcctgggcgacaccgcctgggatttcgggtctctcggaggcgtttttacgagcattgggaaggccctgcaccaagtgttcggcgctatctacggagccgcgttttccggcgtctcttggacaatgaaaattctgatcggggtgatcattacctggatcggaatgaacagccggtccaccagcctttctgtgtccctcgttctggtcggcgtggtgacactgtatctcggggtcatggtgcaggctgacaccggatgtgttgtgagctggaagaataaagaactgaagtgcggctctgggattttcatcacagataacgtccacacgtggaccgagcagtacaagtttcagcctgaatcccccagcaaacttgcctccgccattcaaaaggctcatgaggaaggcatctgtggaatcagatctgtgacacgcctggagaatctcatgtggaaacagattaccccggagctgaaccacatcctgagcgaaaatgaggttaaacttacaattatgaccggcgacatcaaagggattatgcaggccggaaagcggtccctcagacctcagcccacggaactgaaatattcttggaagacctggggcaaggctaaaatgctgagcacagagtcccataaccaaaccttcctcatcgatgggcctgaaacagccgagtgccccaataccaaccgcgcgtggaatagcctggaggtggaagactacggatttggcgtcttctctacaaacatctggcttaagctgcgggagaaacaggacgtgttttgtgattccaagctcatgagcgccgctattaaagacaatagagccgttcacgctgatatgggctattggatcgaatctgccctgaacgacacctggaagatggagaaggcgtccttcattgagatcaaaagctgccactggcctaagtctcatacgctgtggagcaatggggtgcttgaatccgagatgattatccccaaaaacttcgccggaccggtcagccagcacaactaccgccctggctatcatacacagaccgctgggccctggcacctcggaaagctggaaatggattttgacttctgtgagggcaccacagtggtggtcaccgaagattgcgggaatcggggaccctctctgagaacgacaaccgcctccggcaaactcattacagagtggtgctgtcggagctgcaccctgcctccgcttcgctacagaggcgaggacgggtgttggtacggaatggaaatccggcccctgaaggagaaggaagagaacctcgttaattccctggtgacagctggccatgggcaaatcgataacttttctctgggagtgcttggcatggccctcttcctggaagagatgctgagaacccgcgtcgggacgaaacacgccattctcctggtggctgttagctttgtgacccttatcacaggaaatatgtccttccgggacctgggcagagtcatggtgatggttggcgcgaccatgacagatgacattgggatgggagtgacctatctcgccctgctggctgcctttaaggtccgccctacgttcgccgctggccttctgctcagaaaactgacatctaaggagctcatgatggccaccatcgggattgcgctgcttagccagtccacaatccccgaaaccatcctggagctcaccgatgctctggccctgggaatgatggtgcttaaaattgttcggaacatggaaaagtaccagctggccgtgacaatcatggctatttcttgcgtccctaatgccgtgatcctccaaaacgcgtggaaggtgagctgtacgattctggctgccgtctccgttagccccctcctgcttacctcttcccagcagaaagccgactggatccctctggctctcacaatcaagggcctgaatcccaccgccatttttctgacaacccttagccgcacgtctaaaaagagatcctggccgctgaacgaggctgtgatggccgtggggatggtcagcatcctcgcgtcttccctgctcaaaaatgacattcctatgacaggacccctggtggccggcggccttctgaccgtttgctatgtgctgaccgggcggagcgctgatctcgaactggagcgcgccgctgacgtcaagtgggaggatcaggccgaaatctccggaagctctcctattcttagcatcacaatttccgaggacggctctatgagcatcaaaaacgaagaggaggaacacaccctgacaatcctcattagaacggggctgctcgtgatctccggagttttccccgtgtctattccgatcaccgccgctgcgtggtacctgtgggaggtcaagaagcaacgggccggcgtgctttgggatgtcccttctccccctcccgtggggaaagctgaactggaggacggagcctatcgcattaagcagagaggcatctttggctactcccagatcggggccggagtttataaagaaggcacattccataccatgtggcacgtgacaagaggggctgtcctgatgcatcgcggaaagagaattgagccctcctgggccgatgtgaaaaaggacctcatcagctacggcgggggatggaagctggagggcgaatggaaagagggcgaagaggttcaggtgcttgcgctggaacctgggaagaatccgcgggctgtccaaaccaaacccggactctttaagacgaacaccggcacaattggggccgtgtccctggatttcagccctggaacctctggctcccccatcgtggacagaaaagggaaggttgtcggactctacggcaatggcgtggtgacacgcagcggggcctatgtctctgctattgcccagaccgagaagtccatcgaggataaccctgaaatcgaggacgatattttccggaaaaagagactgacaatcatggaccttcaccccggagcgggcaaaacgaagcgctacctgcctgctattgtgcgggaagccatcaaaagagggctgcgcaccctcattctggccccgacacgggttgtggctgccgagatggaagaggctcttagaggactgcccatccgctatcagacccctgccattcgggcggagcataccggcagagaaatcgtcgacctcatgtgtcacgccacatttacgatgcggctgctcagccccgtgcgcgttcctaactacaatctgatcattatggatgaggctcacttcaccgaccccgcctccatcgctgccagagggtatatttctacacgggtggaaatgggcgaggccgctggaatctttatgaccgcgacaccgcctggcagccgcgatcccttcccccagtccaacgcccctattatggacgaggaaagagagatccccgaacggagctggaactctgggcatgagtgggtcaccgattttaagggaaagacggtgtggttcgttccttccatcaaagctggcaacgacattgccgcctgccttagaaagaatgggaaaaaggtgatccaactgagccgcaaaacatttgattctgaatacgtcaagacccgggctaacgactgggatttcgtggtgaccacagacattagcgagatgggagccaattttagagcggagcgcgtcatcgatccgcggagatgtatgaagcccgttattctgaccgacggcgaggaacgcgtgatcctcgctgggcctatgcccgtgacacactcctctgccgcccagcggagaggccgcatcggaagaaaccctaaaaatgaaaacgaccagtatatttacatgggcgagcccctggaaaatgatgaggactgcgctcattggaaggaggccaaaatgcttctggataacatcaataccccggaagggattatccctagcatgttcgagcccgaacgggagaaggtcgacgcgattgatggagaataccgcctcagaggcgaggcccggaaaacgtttgtggacctgatgcgcagaggggatctgcctgtttggctcgcttatcgggtggccgctgagggaatcaactacgccgacagacgctggtgtttcgatggcattaagaataaccaaatccttgaagagaacgtcgaagtggagatctggacaaaagagggggaacggaagaagctgaaacccagatggctggacgctcgcatttattccgatcctctcgccctgaaggagttcaaagaatttgcggccggccggaagtctcttaccctgaatctcatcacagagatgggaagactgcccaccttcatgacgcagaaagctcgggacgccctggataacctcgctgttcttcacaccgccgaagtgggcgggcgcgcctacaatcacgctctgagcgagctgccggagacactcgaaaccctgcttctgctcacactgctggcgaccgtcacaggaggcatttttctcttccttatgtccgggaagggaatcggcaagatgaccctgggcatgtgctgcattatcacggccagcatcctgctctggtatgctcagattcagcctcattggatcgccgcctctattatcctggagtttttccttattgtgctgctcatccccgaacccgagaaacaaagaacacctcaggacaaccagctgacctacgtcgtgatcgctattctgaccgttgtggccgcgacaatggccaatgaaatggggtttctcgagaagaccaaaaaggaccttggactgggctccatcacaacgcaggagagcgaatccaacattctggatatcgacctccggccggcttctgcctggaccctgtatgctgtggccacaaccttcgtcacacccatgcttcgccacagcattgaaaatagctctgttaacgtgagcctgaccgcgatcgccaatcaagctacggtgctcatggggctgggaagaggctggcctctgtccaaaatggatgtcggggtgcccctccttgccattggatgttacagccaggttaaccctatcaccctgacagctgccctgctcctgcttgtggctcattacgccatcattggccccggcctgcaggcgaaggccacccgggaagctcagaagcgcacagccgctgggatcatgaaaaatcctaccgtcgacggaattacggtgatcgatctcgagccgattccctatgaccctaagtttgaaaaacaactgggccaggtcatgctgctcgtgctttgcgttacacaggtgctgatgatgagaaccacatgggccctgtgtgaggccctcaccctggcgaccgggcccatctctacactttgggagggaaaccctggccggttctggaatacgaccatcgctgtctccatggccaacatttttcgcgggagctacctggctggagccggcctcctgttctctatcatgaagaatacaaccaacacaagacggggcaccgggaatattggagaaacgctgggcgagaaatggaagtccagactcaacgcccttggaaagagcgaatttcagatctataaaaagtctggcattcaagaggtggatcgcacactggctaaagagggcatcaagagaggggaaaccgaccaccatgccgttagcagaggatccgcgaaactgcgctggttcgtggagcggaacatggtcacccccgaaggcaaggtggtggatctcggctgcgggagaggaggctggtcttactattgtgggggactgaaaaatgttcgcgaggtcaagggccttacaaaagggggaccgggccacgaggagcctatccccatgagcacctacggctggaacctggtgcggctccagtccggggtggacgtcttctttacaccccctgagaaatgcgatacgctgctgtgtgacattggagaaagctcccccaatcctaccatcgaggccggcagaacactccgcgttcttaacctggtggaaaattggctgaacaataacacccagttctgcgtgaaggtcctcaatccgtatatgccctctgtgattgagaaaatggaaacactgcaacggaagtacgggggagctcttgttagaaaccctctgagccgcaattccacccacgagatgtactgggtgtctaacgccacgggcaatatcgtcagctccgtgaacatgatttctcggatgctcatcaatagatttaccatgaaacataagaaggctacatatgagcccgatgttgacctggggagcggaacccgcaacatcggcattgaaaacgagatccctaatctggacattatcggcaaaagaattgaaaagatcaaacaggagcacgaaacatcctggcattacgatcaggaccacccctataagacctgggcctaccacgggagctatgagacaaaacagaccggatctgcgtccagcatggtgaacggcgtcgtgaagctccttacgaagccgtgggatgtggtccctatggttacacaaatggccatgaccgacaccacacccttcgggcagcagcgggtgtttaaagagaaggtggatacgcgcacccaggaacctaaagagggaacaaagaaactgatgagaattaccgctgaatggctgtggaaggagctcggcaagaaaaagacaccccggatgtgtaccagagaggagttcacacggaaagtccgctctaatgccgctctgggggccatctttaccgacgagaacaagtggaaatccgctagagaagccgtggaggatagccggttctgggaacttgttgaccgcgagagaaatctgcatctcgagggaaagtgcgaaacgtgtgtgtacaacatgatgggcaaacgggagaagaagctgggcgaatttgggaaagcgaagggatctcgcgccatctggtatatgtggctgggcgctagattcctcgagtttgaagccctggggttccttaatgaggatcactggttttcccggggaaacagcctgtccggcgtcgagggggaaggcctccataaactgggatacattcttcgcgacgtgagcaagaaagagggcggggctatgtacgccgatgacaccgccggatgggacacaagaatcaccctggaagatctcaagaatgaggaaatggttacaaaccacatgaagggcgagcataaaaagctggcggaggctattttcaaactgacctatcaaaataaggtggtccgggtgcagcgccctacgcccagagggacagttatggacatcatttctcggaaagatcagcgcggaagcggccaggtggggacctacggcctcaacacattcaccaatatggaagcccaactgatcagacagatggagggagaaggcatctttaagtccattcagcggcttacggtcaccgaggagatcgccgtgcaaaactggctggctagagtcgggcgcgaacggctctctagaatggccattagcggagacgattgcgtggttaagccgctggacgatcgcttcgcttccgcccttacagcgctgaatgacatgggcaaagtgcggaaggatatccagcagtgggagccttctagagggtggaacgactggacccaggtccccttttgcagccaccacttccatgaactcgtgatgaaagatggacgcgtgctggttgtgccctgtcggaaccaagacgagctgattggcagagcccgcatctcccagggggctggctggtctctcaaggaaacagcctgcctgggaaaaagctatgctcagatgtggacccttatgtactttcaccggagagatctgcgcctcgccgcgaatgccatctgttccgctgtccctagccattgggtgccgacatctcggaccacgtggtccattcacgccaagcacgagtggatgacaaccgaggacatgctggctgtttggaacagagtgtggatccaggaaaatccctggatggaggacaagacccctgtcgaaagctgggaggaagtgccctatcttggcaaacgggaggatcaatggtgcgggtctctgattggactcacatccagagccacctgggctaagaacatccagacagccattaatcaggtccgcagcctgatcggcaacgaggaatacacggactatatgccttccatgaaacggttcagaaaggaggaagaggaagcgggggtgctgtggtga

SEQ ID NO: 19950 - RNA, 9876 nt, synthetic construct
  misc_feature 1..9876: note = derived and/or modified CDS sequence (opt5) from DENV-2__EU596491__SS-prME
  source 1..9876: mol_type = other RNA
accgccggcgtgatcattatgctgatccccacagtcatggctttccacctcacgacccggaacggggagcctcatatgattgttggacggcaggaaaagggcaagtccctgctttttaagacagaggacggggtgaatatgtgcaccctgatggccatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtcgcgctcgtgcctcatgttggaatgggcctggagaccagaacggaaacatggatgtcctctgagggcgcttggaagcacgtgcagcggatcgagacctggattctgcgccatcccgggttcacaatcatggccgccattctcgcttacaccatcggaaccacacactttcagagagccctgattttcatccttctgacggctgtcgcccctagcatgaccatgcggtgcattggcatctccaaccgcgattttgtggaaggggtttctggaggcagctgggtggacatcgtcctcgagcacgggtcctgtgtgacaaccatggcgaagaataagcccacactggatttcgaacttattaagaccgaggccaagcagcctgctacgctgagaaaatattgcatcgaagccaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggcatcgtcacatgcgctatgtttacgtgcaaaaagaatatggaaggcaaaattgttcagcctgagaacctcgaatacaccatcgtgatcacaccccacagcggggaggagcatgccgtgggaaatgacaccggcaagcacggcaaagaaattaagatcacacctcagtcttccaccacggaggcggaactgaccgggtatggaacagtcaccatggagtgtagcccccggacaggccttgatttcaacgaaatggtgctgctccaaatggaggacaaagcctggctggttcaccgccagtggtttcttgatctgccgctcccttggctgcccggggctgacacccagggatctaattggattcagaaggagacgctggtgacattcaagaaccctcatgccaaaaagcaagacgtcgtggttctcggctcccaggaaggggctatgcacaccgccctgacaggcgccaccgagatccagatgagctccggaaatcttctgtttaccggccatctcaaatgcagactgcggatggataaacttcaactgaaagggatgtcttacagcatgtgtacaggaaagttcaagattgtgaaagaaatcgctgagacgcagcacggcaccatcgtcattagagtgcagtatgagggggacggatccccctgcaagatccccttcgaaattacagatctcgagaaacgccatgtcctgggccggctgatcaccgtgaaccctattgttacagaaaaggacgcgccggtgaacatcgaggccgaacccccttttggggatagctacattatcgtcggcgtggagcccggacagctcaaactgaattggttcaagaagggatcttccatcgggcaaatgtttgagaccacgatgagaggagctaaacgcatggccattcttggcgacacagcctgggatttcgggagcctgggaggcgtttttacctctatcgggaaggctctccaccaggtgttcggcgccatttacggagcggcttttagcggcgtctcctggaccatgaaaatcctgattggggtgatcatcacatggattggaatgaactctcggagcacctccctgagcgtgtctcttgttctcgtcggcgtggtgacactgtatctgggggccgtcgtgcaggccgactccggatgtgttgtgagctggaagaataaagaactcaagtgcggctctgggatcttcattacggataacgtccacacctggacagagcagtacaagtttcaacctgaatcccccagcaaactggcttccgccatccagaaggctcatgaggaaggcatttgtggaatcagatctgtgacccgccttgagaatctgatgtggaaacagatcacaccggagctcaaccacattctgagcgaaaatgaggttaagctgaccatcatgacgggcgacattaaagggatcatgcaggccggaaagcggtcccttagacctcaacccaccgaactcaaatattcttggaagacatggggcaaggcgaaaatgctgagcaccgagtcccataaccagacattcctgattgatgggcctgaaaccgccgagtgccccaatacaaaccgcgcttggaatagcctcgaggtggaagactacggatttggcgtcttcaccacgaacatctggctgaaacttcgggagaaacaggacgtgttttgtgattctaagctgatgtccgccgctatcaaagacaatagagccgttcacgcggatatgggctattggattgaaagcgccctcaacgacacatggaagatggagaaggcttctttcatcgaggtgaaatcctgccactggcctaagagccataccctgtggtctaatggggtcctggaaagcgagatgattatccccaaaaacttcgccggaccggtgtcccagcacaactaccgccctggctatcatacccaaacagctgggccctggcaccttggaaagctcgaaatggattttgacttctgtgagggcaccacggtggtcgttacagaagattgcgggaatcggggacccagcctgagaaccacaaccgcctctggcaaactgattacagagtggtgctgtcggtcctgcaccctccctccgctgcgctacagaggcgaggacgggtgttggtacggaatggaaatccggccccttaaggagaaggaagagaacctggtgaatagcctcgtgacggccggccatgggcagattgataacttttccctgggagtcctgggcatggctcttttcctcgaagagatgctgagaacccgcgtggggacaaaacacgcgaccctgctcgttgccctgtcttttgtgacacttatcaccggaaatatgagcttccgggacctgggcagagtcatggtgatggttggcgctacgatgacagatgacatcgggatgggagtgacctatctcgccctgctggccgcttttaaggtccgccctacattcgccgcgggccttctgctcagaaaactgacctccaaggagctcatgatggctaccattgggatcgccctgctttctcagagcacactgcccgaaacgattctcgagctgaccgatgccctggctcttggaatgatggtgctgaaaatcgttcggaacatggaaaagtaccaactcgccgtgacaattatggcgatctcctgcgtccctaatgctgtgatcctgcagaacgcctggaaggtgtcttgtaccattctcgccgctgtcagcgttagccccctgcttctgacaagctctcagcagaaagccgactggatccctctcgctctgaccattaagggcctgaatcccacggccatctttcttacaaccctgtcccgcaccagcaaaaagagatcttggccgctcaacgaggcgattatggccgtggggatggtgtccatcctggctagctctctcctgaaaaatgacatccctatgacaggaccccttgtcgccggcggcctgctgaccgtgtgctatgttctcacagggcggtccgctgatctggaacttgagcgcgccgccgacgtgaagtgggaggatcaagctgaaattagcggatccagccctatcctgtctattacgatcagcgaggacggctccatgtctattaaaaacgaagaggaggaacagaccctcacaatcctgattagaaccgggctcctggtcatcagcggagtgttccccgtttccatcccgattacagcggccgcttggtacctttgggaggtgaagaagcagcgggccggcgtcctgtgggatgtgccttctccccctcccgtcgggaaagccgaactggaggacggagcttatcgcatcaagcagagaggcattctcggctacagccaaatcggggccggagtgtataaagaaggcacctttcacacgatgtggcatgttaccagaggggcggtgctgatgcaccgcggaaagagaattgagccctcctgggctgatgtcaaaaaggaccttatctcttacggcgggggatggaagctggagggcgaatggaaagagggcgaagaggtgcaggttctcgccctggaacctgggaagaatccgcgggccgtgcagacaaaacccggaatcttcaagaccaacacaggcaccattggggctgtcagcctcgatttttcccctggaacaagcggctctcccatcgtggacagaaaagggaaggtggttggactgtacggcaatggcgtcgtgacgcgctccggggcctatgtgagcgcgattgctcagaccgagaagtctatcgaggataaccctgaaattgaggacgatatcttccggaaaaagagacttacaatcatggacctgcatcccggagccggcaaaaccaagcgctacctgcctgccattgtccgggaagctatcaaaagagggctccgcaccctgattcttgccccgacacgggtggttgctgccgagatggaagaggcgctgagaggactccccatccgctatcaaacgcctgccattcgggctgagcacaccggcagagaaatcgtggacctgatgtgtcatgccacattcaccatgcggctcctgtcccccgtccgcgtgcctaactacaatcttattatcatggatgaggctcactttacagaccccgccagcatcgccgctagagggtatatttccacccgggttgaaatgggcgaggcggccggaatcttcatgacggctacaccgcctggctctcgcgatccctttccccagagcaacgcccctattatcgacgaggaaagagagattcccgaacggtcctggaatagcgggcacgagtgggtgaccgatttcaagggaaagaccgtctggtttgtgccttctatcaaagccggcaacgacatcgctgcctgcctgagaaagaatgggaaaaaggttattcagctgtcccgcaaaacattcgatagcgaatacgtgaagacccgggcgaacgactgggattttgtcgtgacaaccgacatctctgagatgggagctaatttcaaggccgagagagtgattgatccgcgccggtgtatgaaacccgtcatcctcacggacggcgaagagagagttattctggccgggcctatgcccgtgacacatagctccgctgcccaacgccggggcagaatcggacgcaaccctaagaatgaaaacgaccagtatatctacatgggcgagccccttgaaaatgatgaggactgcgcgcactggaaagaggccaagatgctgctcgataacattaataccccggaagggatcattccttctatgtttgagcccgaaagagagaaagtggacgctgtcgatggagaataccggctgcgcggcgaggccagaaagacattcgtggacctgatgcggcgcggggatctccctgtttggcttgcttataaagtggccgctgagggaatcaactacgccgacagaaagtggtgttttgatggcattaagaataaccagatcctggaagagaacgtcgaagtggagatttggaccaaagagggggaacggaagaaactgaagcccagatggctcgacgcgcgcatctatagcgatcctctggcccttaaagagttcaaggagttcgctgccggccggaagtccctgacgctcaatctgatcaccgagatgggaagactgcccacatttatgacccagaaagctcgcaacgccctcgacaatcttgccgttctgcatacagctgaagtgggcgggcgggcgcacaaccacgccctgtctgagctcccggagaccctggaaacacttctgctcctgaccctgctcgctacggtcacaggaggcattttcctttttctgatgagcgggaagggaatcggcaaaatgaccctgggcatgtgctgcattatcaccgcctccattctcctgtggtacgcccaaatccagcctcattggatcgctgccagcattatccttgagttctttctgattgtgctcctgatccccgaacccgagaagcagagaacacctcaggataatcaactgacctatgtcgtgattgcgatcctcacagttgtggccgctacgatggccaacgaaatggggttccttgagaaaaccaagaaggacctgggatttggctctatcacaacccaggagtccgaaagcaatattctggacatcgatctccggccggcttccgcctggacactgtacgcggtggccaccacgttcgtcacccccatgcttcgccactctattgagaacagctccgttaatgtgtctctgacagctatcgccaaccaggctaccgtgctcatggggctgggaaaaggctggcctctgagcaagatggacattggggtccccctccttgccatcggatgttattcccaggtgaatcctattacactgaccgctgccctgctcctgcttgttgcgcattacgccatcatcggccccggcctgcaagctaaagccacgagagaagctcagaagcgggccgccgcggggattatgaaaaaccctacagtggatggaatcaccgtcattgacctcgagccgatcccctacgatcctaagtttgaaaagcagctgggccaggtgatgctgctcattctttgcgtcacacaagtgctgatgatgcgcaccacctgggctctgtgtgaggccctcacactggctacggggcccatcagcaccctttgggagggaaatcctggcagattctggaacacaaccatcgccgtttctatggccaatatttttcgggggtcctatctggctggagccggcctcctgttcagcatcatgaaaaacacaaccaatacgcgcagaggcacagggaacgtgggagaaaccctgggcgagaagtggaaatctcggctcaacgcgcttgggaagtccgaatttcagatttacaaaaagagcggaatccaggaggtcgaccgcaccctggccaaagagggcattaagagaggggaaacagatcaccatgctgtgtctcggggaagcgccaagctgagatggttcgttgagcgcaatatggtgacccccgaaggcaaagtcgtggacctcggctgcgggcggggaggctggtcctattactgtgggggactgaagaacgtgagagaggttaaaggccttacaaaagggggaccgggccacgaagaacctatccccatgtctacgtatggctggaatctggtccgcctccaaagcggggtggatgtgttctttacaccccctgagaaatgcgacaccctgctgtgtgatatcggagaatccagccccaaccctaccattgaggctggccggacactcagagtccttaatctggttgaaaactggctgaataacaatacccagttctgcatcaaggtgctcaacccgtacatgccctccgtgattgagaagatggaaacgctgcagcgcaaatatgggggagcccttgtccggaatcctctgtctagaaacagcacccacgagatgtactgggtgtccaatgcgacaggcaacatcgtttctagcgtgaatatgatttcccgcatgctcatcaaccggtttaccatgaagcataaaaaggccacatacgagcccgacgtcgatctggggtctggaaccagaaacatcggcattgaaagcgagatccctaatctggacattatcggcaaacgcattgaaaagatcaagcaggagcacgaaacatcctggcattatgaccaagatcacccctacaaaacctgggcttatcacgggagctacgagacgaagcagacaggatctgcctccagcatggtgaacggcgttgtgcggctccttaccaaaccgtgggacgtcgtgcctatggtgacccagatggctatgacagatacgacccccttcgggcagcaaagagtctttaaggagaaagttgacacacgcacccaggaacctaaggagggaacaaagaaactgatgaagattaccgccgaatggctgtggaaagagctcggcaagaaaaagacacccagaatgtgtacccgggaggagttcacgcgcaaagtgagatctaatgctgccctgggggcgatctttaccgatgagaacaagtggaagtccgcccgggaagctgtggaggacggaagattctgggaacttgtcgatcgggagcgcaatctgcatctcgagggcaaatgcgaaacatgtgtgtataacatgatgggcaagagagagaaaaagctgggggaatttggaaaagccaagggcagccgggctatctggtacatgtggctgggggcccgcttcctcgagtttgaagccctgggattccttaatgaggaccactggttttctagaggcaactccctgagcggggttgagggcgaaggactccatcggctgggctatattcttcgcgaggtggggaagaaagaaggaggcgcgatgtacgctgatgacaccgccgggtgggatacaagaatcaccctggaggacctcaagaatgaagagatggtcacgaaccacatgaaaggagagcataagaaactggccgaagctattttcaagctgacataccagaataaggtggttcgggtgcagcgccctacccccagaggcacagtcatggacatcatttcccggaaagatcaacgcgggagcggccaggtgggaacctatggcctcaacacgttcaccaatatggaggcccagctgatcagacaaatggaaggggagggaatctttaagtctattcagcaccttacagctaccgaggaaatcgccgttcagaactggctggcgcgggtgggccgcgagagactcagccggatggccatttccggggacgattgcgtcgtgaaaccgatcgacgatagattcgcttctgccctgacagctcttaatgacatgggaaaggtccgcaaagatattcagcaatgggaacctagccggggctggaacgactggacccaggtgcccttttgctcccaccatttccacgagctggttatgaaggatgggagagtgctcgtcgtgccctgtcgcaaccaggacgaactgatcggccgggccagaatctctcagggagcgggctggagcctgaaggagacagcctgcctcgggaaatcctacgctcaaatgtggaccctgatgtattttcatcgccgggatcttagactggccgctaatgccatttgttctgctgtgcctagccactgggttccgacgtcccgcacaacctggagcatccacgccaagcatgagtggatgaccacagaagacatgctcgcggtgtggaaccgggtctggattcaggagaatccctggatggaagataaaacccctgtggagtcttgggaagaggttccctacctgggaaagagagaggaccagtggtgcggctcccttatcgggctgacaagccgcgccacgtgggctaaaaacattcagaccgccatcaatcaagtgcggtctctcattggaaacgaagagtatacagactacatgccttccatgaagagattccggagagaagaggaagaggccggcgtcctgtggtga

SEQ ID NO: 19951 - RNA, 9876 nt, synthetic construct
  misc_feature 1..9876: note = derived and/or modified CDS sequence (opt5) from DENV-2__EU677141__SS-prME
  source 1..9876: mol_type = other RNA
accgccggagtgatcattatgctgatccccacagctatggccttccacctcacgaccagaaatggggaacctcatatgattgtgggacggcaggaaaagggcaaaagcctgctttttaagacagaagacggggttaatatgtgcaccctgatggcgatcgatctcggagaactgtgtgaggacacaattacctacaaatgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgctacgtcctgggccggctcatcaccgtgaaccctattgttacagggaaggacagcccggtgaacatcgaagccgagcccccttttggcgattcttacattatcatcggagtcgaacccggccagctgaaacttaattggttcaagaaggggtccagcattggacagatgtttgagaccacaatgagaggcgctaaacgcatggccatcctgggggacaccgcctgggatttcggatctctcggcggggtgtttacgagcattggcaaggctctgcatcaagttttcggagccatctatggcgcggctttttccggggtgtcttggacaatgaaaattctgatcggagtcatcattacctggatcggcatgaacagccggtccaccagcctttctgtgtccctcgtgctggttggggtcgtgacactgtacctcggagtgatggtccaggccgacagcggctgtgtggtttcttggaagaataaagagctgaagtgcgggtccggcattttcatcaccgataacgtgcacacatggacggaacagtataagtttcagcctgagagcccctccaaacttgcctctgctattcaaaaggcccacgaagagggaatctgtggcatcagaagcgtcacccgcctggaaaatctcatgtggaaacagattacaccggagctgaaccatatcctgtccgagaatgaagtgaaacttaccattatgacaggggacatcaaaggaattatgcaggctggcaagcggtctctcagacctcagcccaccgagctgaaatacagctggaagacgtgggggaaggccaaaatgctgtccaccgaaagccacaaccaaacattcctcatcgatggacctgagaccgcggaatgccccaatacaaaccgcgcctggaactctctggaggttgaggactatggctttggcgtgttctccaccaacatctggcttaagctgcgggaaaaacaggacgtcttttgtgatagcaagctcatgtctgctgccattaaagacaatagagctgtgcatgccgatatggggtactggatcgagtccgcgctgaacgacacatggaagatggaaaaggccagcttcattgaggttaaatcttgccactggcctaagagccacaccctgtggtccaatggagtgcttgagagcgaaatgatcattcccaaaaacttcgctggcccggtctctcagcataactatcgccctgggtaccacacgcagacagccggaccctggcatctcggcaagctggagatggattttgacttctgtgaagggaccaccgtggtggtcacagaggattgcggaaatcggggcccctccctgagaaccacgacagctagcggcaaactcatcaccgaatggtgctgtcggtcctgcacactgcctccgcttcgctacagaggggaggacggatgttggtatggcatggagattcggcccctgaaggaaaaggaggaaaacctcgttaattctctggtgaccgccgggcacggacaaatcgataactttagcctgggcgtgcttgggatggccctcttcctggaggaaatgctgagaacacgcgtcggaaccaaacatgctatcctcctggtggcggtttcctttgtgacgcttattaccggcaatatgtctttccgggacctgggcagagtcatggtgatggttggggccacaatgaccgatgacatcggaatgggcgtgacatacctcgctctgctggccgcctttaaggtccgccctaccttcgctgccgggcttctgctcagaaaactgacgagcaaggagctcatgatggcgacaattggaatcgctctgctttcccagtctaccattcccgagacaatcctggaactcaccgatgccctggccctgggcatgatggtgcttaaaatcgttcggaacatggagaagtatcagctggctgtgaccattatggccatcctctgcgtccctaatgcggtgattctgcaaaacgcttggaaggtgagctgtacaatcctcgccgccgtctccgttagccccctgcttctgacgtcttcccagcagaaagctgactggattcctctcgccctgaccatcaaggggctgaatcccacagctatctttcttaccacactgagccgcacctctaaaaagagatcctggccgctcaacgaagccgtgatggcggtgggaatggtcagcattctggcctcttccctcctgaaaaatgacatccctatgacgggcccccttgtggctggcgggctgctgacagtttgctacgtgctcaccggacggagcgccgatctggagcttgaacgcgctgccgacgtcaagtgggaggatcaggccgagatttccggcagctctcctatcctgagcattaccatctccgaagacgggtctatgagcattaaaaacgaggaagaggagcaaacactcaccatcctgatcagaacaggactcctggtgatttccggcgttttccccgtgtctatcccgattacggctgcggcctggtatctttgggaagtcaagaagcagcgggctggggtgctgtgggatgtcccttctccccctcccgtgggaaaagccgagctggaagacggcgcctaccgcatcaagcagagaggcatttttgggtattcccagatcggagctggcgtttacaaagaggggaccttccacacaatgtggcacgtgacccggggagccgtcctcatgcatcgcggcaagagaatcgaaccctcctgggcggatgtgaaaaaggacctgattagctacgggggaggctggaaacttgagggcgagtggaaagaaggggaggaagttcaagtgctggctctcgagcctggaaagaatccgcgggccgtccagacaaaacccggcctgtttaagaccaacacggggaccatcggagccgtgtccctcgatttcagccctggcacatctgggtcccccattgtggacagaaaaggaaaggttgtcggcctgtatggcaatggggtggtgacccgcagcggagcttacgtctctgccatcgcgcagacagaaaagtccattgaggataaccctgagatcgaagacgatatcttccggaaaaagagacttaccattatggacctgcaccccggcgctgggaaaacaaagcgctatctgcctgccatcgtgcgggaggccattaaaagaggactccgcacgctgatccttgctccgacccgggttgtggccgctgaaatggaggaagccctgagaggcctccccattcgctaccagacccctgcgatccgggccgagcataccgggagagagattgtcgacctgatgtgtcacgctacctttacaatgcggctcctgagccccgtgcgcgttcctaactataatcttatcatcatggatgaagcccatttcacggaccccgcttccattgccgccagaggctacatctctacccgggtggagatgggagaagctgcgggcatttttatgacagccaccccgcctgggagccgcgatcccttcccccaatccaacgctcctatcatggacgaggagagagaaattcccgagcggagctggaactctggacacgaatgggtcacagattttaagggcaagaccgtgtggttcgttccttccatcaaagccgggaacgacatcgccgcttgcctgagaaagaatggcaagaaggtgattcagctgagccgcaaaacgtttgattctgagtatgtcaagacacgggccaacgactgggatttcgtggtgaccaccgacatcagcgaaatgggcgcgaattttagagctgagcgcgtcattgatccgcggagatgtatgaagcccgttatcctcacagacggggaggaacgcgtgattctggccggccctatgcccgtgacccactcctctgccgctcagcggagaggacgcatcggcagaaaccctaaaaatgagaacgaccaatacatctacatgggggaaccccttgagaatgatgaagactgcgcccattggaaggaggcgaaaatgctgctcgataacattaatacaccggagggaatcattcctagcatgttcgaacccgagcgggaaaaggtcgacgccatcgatggcgagtatcgcctgagaggggaagctcggaaaacctttgtggacctgatgcgcagaggagatctccctgtttggcttgcctaccgggtggctgccgagggcattaactatgctgacagacgctggtgtttcgatgggatcaagaataaccagattctggaggaaaacgtcgaggtggaaatctggacgaaagagggcgagcggaagaagctgaaacccagatggctcgacgcccgcatctactccgatcctctggcgcttaaggagttcaaagagtttgccgctggacggaagtctctgacactcaatctgattaccgaaatgggcagactgcccacattcatgacccagaaagcccgggacgctctcgataaccttgccgttctgcacacggccgaggtcgggggacgcgcttataatcatgcgctgagcgaactcccggagaccctggagacacttctgctcctgaccctgctcgccacagtcaccggcgggatctttcttttcctgatgtccggaaagggcattggcaagatgacactggggatgtgctgcatcattaccgctagcatcctcctgtggtacgcccagatccaacctcactggattgccgcttctatcattcttgaatttttcctgatcgtgctcctgattcccgagcccgaaaaacagagaacgcctcaggacaaccagctgacatatgtcgtgatcgccatcctcaccgttgtggcggccaccatggctaatgagatgggatttcttgaaaagaccaagaaggacctgggcctggggtccattatcacccaagagagcgagtccaacattctcgatatcgacctgcggccggcctctgcttggacactttacgccgtggcgacgaccttcgtcacacccatgctgcgccacagcattgaaaattcctctgttaacgtgagcctcaccgccatcgctaatcaggccacagtgctgatgggactgggcagagggtggcctctctccaaaatggatattggagtcccccttctggctatcggctgttacagccaggtgaaccctatcaccctgacggccgctctcctgcttctggttgcccattatgcgattatcggccccgggctccaggccaaggctacccgggaggcccaaaagcgcgctgccgccggaattatgaaaaatcctacagtggacggcatcaccgtcattgatctggaaccgatcccctacgaccctaagtttgagaaacagctgggacaggtgatgctccttgtcctgtgcgtgacacaggttctgatgatgagaaccacgtgggcgctctgtgaagctctgacacttgccaccggacccatctctacactgtgggagggcaaccctgggcggttctggaataccaccattgctgtgtccatggccaacatctttcgcggaagctatctcgccggcgctggcctgctgttctctattatgaagaatacaacgaacaccagacgggggacaggaaatatcggcgagaccctcggggaaaaatggaagtccagacttaacgccctgggaaagagcgagtttcaaatttacaaaaagtctggcatccaggaagtcgatcgcacactggcgaaagaggggatcaagcggggagagaccgaccaccatgccgtgagcagaggctccgctaaactccgctggttcgttgaacggaacatggtgacgcccgagggcaaggtcgtggatctggggtgcggaagaggcgggtggtcttattactgtggaggccttaaaaatgtgcgcgaagttaaggggctgacaaagggaggcccgggccacgaggaacctattcccatgagcacctatgggtggaacctcgtccggctgcagtccggagtggacgtgttctttacaccccctgagaaatgcgatacactgctctgtgacatcggcgagagctcccccaatcctaccattgaagccgggagaacacttcgcgtcctgaacctggttgagaattggctcaacaataacacgcaattctgcatcaaggtgctgaatccgtacatgccctctgtgattgagaagatggagacccttcagcggaagtacggaggcgctctggtcagaaaccctctcagccgcaattccacacatgaaatgtattgggtgtctaacgccaccgggaatatcgttagctccgtgaacatgatctctcggatgctgattaatagatttacaatgaaacacaagaaggcgacctacgagcccgatgtcgacctgggaagcggcacgcgcaacatcggcattgagaacgaaatccctaatctcgacattatcgggaaaagaattgagaagatcaaacaggaacacgagacctcctggcattatgatcaggaccacccctacaagacatgggcctatcatggaagctacgaaaccaaacaaacaggctctgcttccagcatggtgaacggggttgtgcggcttctgaccaagccgtgggatgtcgtgcctatggtgacacagatggccatgaccgacacgacacccttcggacagcagcgcgtctttaaggagaaagttgataccagaacccaagagcctaaggaaggcaccaaaaagctgatgcggatcacggctgagtggctctggaaagaactggggaagaagaaaacccccagaatgtgtacacgggaggagttcacccgcaaggtgagatctaatgccgctcttggagccatttttacagacgaaaacaaatggaagtccgcgcgggaggccgtggaagatagccgcttctgggagctggtcgacagagaacggaatctccacctggagggcaaatgcgagacctgtgtgtataacatgatgggcaagcgcgagaaaaagctgggggagtttggaaaggctaaaggctctagagccatctggtacatgtggctcggggctcggttcctggaatttgaggcccttggattcctgaatgaagatcactggttttcccgcggcaacagcctctccggggttgagggcgagggactgcataaacttggctacattctgagagacgtgagcaaaaaggaagggggagccatgtatgcggatgacacagctggctgggacacccggatcacgctcgaggatctgaaaaatgaagagatggtcaccaaccacatgaagggggaacataagaaactggccgaggccattttcaagctcacataccagaataaagtggttcgcgtgcagagacctacaccccggggaacagtcatggacatcatctctcgcaaggatcagagaggcagcgggcaagtgggcacctatggactgaacacgttcacaaatatggaggctcagcttattcggcagatggaaggcgaggggatctttaaatccattcaacacctgaccgttacagaagagatcgccgtgcagaactggctcgctagagtcggacgcgagcggctgtctagaatggccattagcggcgacgattgcgtggtcaagccgcttgacgatcgcttcgcgtccgccctgaccgctctcaatgacatggggaaggtgcggaaagatatccagcagtgggaaccttctagaggatggaacgactggacgcaagttcccttttgcagccatcacttccacgagctggtgatgaaggatggccgcgtcctggtggtgccctgtcggaaccaggacgaactcatcgggagagcccgcatttcccagggcgctggatggtctctgaaagagaccgcctgccttggcaagagctacgcgcagatgtggacactgatgtattttcatcggagagatctccgcctggccgctaatgccatctgttccgctgttcctagccactgggtgccgacctctcggacaacctggtccattcatgccaaacacgaatggatgacaaccgaggacatgcttgctgtctggaacagagtgtggatccaagagaatccctggatggaagacaagacgcctgttgagagctgggaagaggtgccctacctggggaagcgggaagatcagtggtgcggatctctcattggcctgacatccagagccacctgggcgaaaaacatccagaccgccattaatcaggtccgcagcctgatcgggaacgaggagtatacagactacatgccttccatgaagcggttcagaaaagaagaggaagaggctggagtgctctggtga

SEQ ID NO: 19952 - RNA, 9876 nt, synthetic construct
  misc_feature 1..9876: note = derived and/or modified CDS sequence (opt5) from DENV-2__EU677144__SS-prME
  source 1..9876: mol_type = other RNA
accgccggcatgatcattatgctgatccccacagctatggccttccacctcacgaccagaaacggggagcctcatatgattgtgggacggcaggaaaagggcaaaagcctgctttttaagacagaggacggggtcaatatgtgcaccctgatggcgatcgatctcggagaactgtgtgaggacacaattacctacaaatgcccgcttctgcgccaaaacgaacccgaggatatcgactgttggtgcaattccacatctacctgggttacgtatggcacctgtacaaccacaggggagcacagacgggaaaagcgcagcgtggctctcgtgcctcatgtcggaatgggcctggagaccagaacggaaacatggatgtcctctgagggcgcctggaaacacgtgcagcggatcgagacctggattctgcgccatcccgggttcacaatcatggccgctattctcgcctacaccatcggaaccacacactttcagagagctctgattttcatccttctgacggccgttgcgcctagcatgaccatgcggtgcattggcatctccaaccgcgattttgtggaaggggtctctggaggcagctgggtggacatcgttctcgagcacgggtcctgtgtgacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagagcaggacaaacgctttatttgcaagcattccatggtcgatagaggctggggcaacgggtgtggactgttcggcaaggggggaatcgtgacatgcgccatgtttacgtgcaaaaagaatatggaaggcaaagtggtcctccctgagaacctggaatacaccattgttatcacaccccacagcggggaggagcatgcggtgggaaatgacaccggcaagcacggcaaagaaatcaagattacacctcagtcttccatcaccgaggccgaacttacggggtatggaaccgtgacaatggagtgtagcccccggaccggcctggatttcaacgaaatggtcctcctgcagatggaggacaaagcttggcttgtgcaccgccaatggtttctggatctcccgctgccttggctgcccggggccgacacacagggactcaattggattcagaaggagaccctggttacgttcaagaaccctcatgctaaaaagcaggacgtggtcgtgcttggctctcaagaaggggccatgcacacagccctgaccggcgctacagagatccagatgtccagcggaaatctcctgtttaccggccatcttaaatgcagactgcggatggataagctccagctgaaagggatgtcctactctatgtgtaccggaaagttcaagattgttaaagaaatcgcggagacacaacacggcacgatcgtgattagagtccagtatgagggggacggaagcccctgcaagatccccttcgaaattatggatctggagaaacgctacgtgctcggccggctgatcaccgtcaaccctattgtgacagaaaaggactccccggttaacatcgaggccgaacccccttttggggatagctacattatcatcggcgtggagcccggacagcttaaactgaattggttcaagaagggctcttccattgggcagatgtttgagaccacaatgagaggagctaaacgcatggccatcctcggcgacaccgcctgggatttcgggagcctgggaggcgtctttacgtctattgggaaggctctgcatcaagtgttcggcgccatctatggagcggcttttagcggcgtttcctggacaatgaaaattcttatcggggtgatcattacctggatcggaatgaactctcggagcacctccctcagcgtctctctggtgctggtgggcgttgtcacactctacctgggggtgatggtgcaggccgactccggatgtgtcgtgagctggaagaataaagaacttaagtgcggctctgggattttcatcaccgataacgttcacacatggacggagcagtataagtttcagcctgaatcccccagcaaactggcctccgctattcaaaaggcccacgaggaaggcatctgtggaatcagatctgtgacccgcctcgagaatctgatgtggaaacagattacaccggagctgaaccatatccttagcgaaaatgaggtcaagctcaccattatgacaggcgacatcaaagggattatgcaggctggaaagcggtccctgagacctcagcccaccgaactgaaatactcttggaagacgtggggcaaggccaaaatgctcagcaccgagtcccacaaccaaacattcctgatcgatgggcctgaaaccgcggagtgccccaatacaaaccgcgcctggaatagccttgaggtggaagactatggatttggcgttttctctaccaacatctggctgaagctccgggagaaacaggacgtgttttgtgattccaagctgatgagcgctgccattaaagacaatagagctgtccatgccgatatgggctactggatcgaatctgcgctgaacgacacatggaagatggagaaggcctccttcattgaggtgaaaagctgccactggcctaagtctcacaccctttggagcaatggggttctcgaatccgagatgatcattcccaaaaacttcgctggaccggtgagccagcataactatcgccctggctaccacacgcagacagccgggccctggcatctgggaaagctggaaatggattttgacttctgtgagggcaccaccgtcgtggtgacagaagattgcgggaatcggggaccctctctcagaaccacgacagcttccggcaaactgatcaccgagtggtgctgtcggagctgcacacttcctccgctgcgctacagaggcgaggacgggtgttggtatggaatggaaattcggcccctcaaggagaaggaagagaacctggtcaattccctggttaccgccggccacgggcaaatcgataacttttctcttggagtgctcggcatggccctgttcctggaagagatgctcagaacacgcgtggggaccaaacatgctatcctgcttgtcgcggtgagctttgttacgctgattaccggaaatatgtccttccgggacctcggcagagtgatggtcatggtgggcgccacaatgaccgatgacatcgggatgggagttacatacctggctctgcttgccgcctttaaggtgcgccctaccttcgctgccggcctgctcctgagaaaactcacgtctaaggagctgatgatggcgacaattgggatcgctcttctgagccagtccaccattcccgaaacaatcctcgagctgaccgatgccctggcccttggaatgatggtcctgaaaatcgtgcggaacatggaaaagtatcagctcgctgttaccattatggccatcctgtgcgtgcctaatgcggtcattctccaaaacgcttggaaggtgtcttgtacaatcctggccgccgtgagcgtctccccccttctgctcacgagctctcagcagaaagctgactggattcctctggccctgaccatcaagggccttaatcccacagctatctttctgaccacactctcccgcaccagcaaaaagagatcttggccgctgaacgaggccgttatggcggtggggatggtgtccattctcgccagctctctgcttaaaaatgacatccctatgacgggacccctggtcgctggcggcctgctcacagtgtgctacgttctgaccgggcggtccgccgatcttgaactggagcgcgctgccgacgtgaagtgggaggatcaggccgaaattagcggatccagccctatcctctctattaccatcagcgaggacggctccatgtctattaaaaacgaagaggaggaacaaacactgaccatcctcatcagaacagggctgcttgtcattagcggagtgttccccgtttccatcccgattacggctgcggcctggtatctgtgggaggtgaagaagcagcgggctggcgtcctgtgggatgtgccttctccccctcccatggaaaaagccgagctcgaagacggggcctaccgcatcaagcagagaggaatttttggctatagccagatcggcgctggggtctacaaagagggaaccttccacacaatgtggcacgtgacccggggcgccgttctgatgcatcgcgggaagagaatcgagccctcctgggcggatgtgaaaaaggaccttatttcttacggaggcgggtggaagctggaaggagagtggaaagaaggcgaggaagtccaagtgctcgctctggagcctggcaagaatccgcgggccgttcagacaaaacccgggctctttaagaccaacacgggaaccatcggcgccgtgagcctggatttctcccctgggacaagcggatctcccattgtcgacagaaaaggcaaggtggtggggctttatggaaatggcgttgtcacccgctccggcgcttacgtgagcgccatcgcgcagacagagaagtctattgaagataaccctgagatcgaagacgatatcttccggaaaaagagactgaccattatggacctgcaccccggggctggaaaaacaaagcgctatctccctgccatcgtgcgggaggccattaaaagaggcctgcgcacgcttatcctggctccgacccgggtcgtggccgctgaaatggaggaggccctcagagggctgcccattcgctaccagacacctgcgatccgggccgaacataccggaagagagattgttgacctcatgtgtcacgctacctttacaatgcggctgctttcccccgtgcgcgtccctaactataatctgatcatcatggatgaagcccatttcacggaccccgctagcattgccgccagaggctacatctccacccgggtggagatgggggaggctgcgggcatttttatgacagccaccccgcctggatctcgcgatcccttcccccaaagcaacgctcctatcatggacgaagagagagaaattcccgagcggtcctggaatagcggccacgaatgggttacagattttaaggggaagaccgtgtggttcgtcccttctatcaaagccggaaacgacatcgccgcttgcctgagaaagaatggcaaaaaggtgattcagctctcccgcaaaacgtttgatagcgagtatgttaagacacgggccaacgactgggatttcgtggtcaccaccgacatctctgagatgggggcgaattttagagctgaacgcgtgattgatccgcggagatgtatgaagcccgtgatcctgacagacggagaggaacgcgtcattcttgccggccctatgcccgttacccacagctccgccgctcagcggagagggcgcatcggcagaaaccctaaaaatgagaacgaccaatacatctacatgggagaacccctggagaatgatgaggactgcgcccattggaaggaagcgaaaatgctcctggataacattaatacaccggagggcatcattccttctatgttcgaacccgagcgggaaaaggtggacgccatcgatggggagtatcgcctgagaggagaggctcggaaaacctttgtggacctcatgcgcagaggcgatcttcctgtctggctggcctaccgggtggctgccgaagggattaactatgctgacagacgctggtgtttcgatggaatcaagaataaccagattctggaggaaaacgttgaggtggagatctggacgaaagaaggcgagcggaagaagctcaaacccagatggctggacgcccgcatctacagcgatcctcttgcgctgaaggaattcaaagagtttgccgctgggcggaagtccctcacactgaatctgattaccgaaatgggcagactccccacattcatgacccagaaagcccgggacgctcttgataacctggccgtcctgcacacggccgaggtgggaggccgcgcttataatcatgcgctctctgagctgccggaaacccttgagacactgctcctgctgaccctccttgccacagttaccgggggaatctttctgttcctgatgagcggcaaggggattggaaagatgacactcggcatgtgctgcatcattaccgcttccatcctgctttggtacgcccagatccaacctcactggattgccgctagcatcattctggaatttttcctcatcgtgctgctgattcccgagcccgaaaaacagagaacgcctcaggacaaccagctcacatatgtcgtgatcgccatccttaccgtcgtggcggccaccatggctaatgagatgggctttctggagaagacaaaaaaggacctggggctcggatctattatcacccaagaatccgagagcaacattctggatatcgaccttcggccggcctccgcttggacactgtacgccgttgcgacgaccttcgtgacacccatgctccgccactctattgaaaatagctccgtgaacgtctctctgaccgccatcgctaatcaggccacagttctgatgggcctcgggagaggatggcctcttagcaaaatggatattggcgtgcccctgctggctatcgggtgttactcccaggtgaaccctatcaccctcacggccgctctgcttctgctcgtcgcccattatgcgattatcggacccggcctgcaggccaaggctacccgggaggcccaaaagcgcgctgccgccggcattatgaaaaatcctacagtggacgggatcaccgttattgatctggaaccgatcccctacgaccctaagtttgagaaacagctcggacaggtgatgcttctggtcctgtgcgtgacacaggtcctcatgatgagaaccacgtgggcgctgtgtgaggctcttacactggccaccggccccatcagcacactctgggaagggaaccctggacggttctggaataccaccattgctgtgtctatggccaacatctttcgcggctcctatctggccggggctggactgctcttcagcattatgaagaatacaacgaacaccagacggggcacaggcaatatcggggagacccttggagaaaaatggaagtctagactgaacgccctgggcaagtccgagtttcaaatttacaaaaagagcgggatccaggaggttgatcgcacactcgcgaaagaaggaatcaagcggggcgagaccgaccaccatgccgtgtctagagggagcgctaaactgcgctggttcgtcgaacggaacatggtgacgcccgagggaaaggttgtggatcttggctgcggcagagggggatggtcctattactgtggcgggctgaaaaatgtccgcgaagtgaagggactcacaaagggcgggccgggacacgaggagcctattcccatgtctacctatggctggaacctggtgcggctgcagagcggcgttgacgtcttctttaccccccctgaaaaatgcgatacactcctttgtgacatcggggagtccagccccaatcctaccattgaagccggaagaacactgcgcgtgctgaacctcgtggagaattggctgaacaataacacgcaattctgcatcaaggtccttaatccgtacatgccctccgttattgaaaaaatggagaccctgcagcggaagtacggcggggctctcgtgagaaaccctctgtctcgcaatagcacacatgagatgtattgggtgtccaacgccaccggaaatatcgtctctagcgtgaacatgatctcccggatgctgattaatagatttacaatgaaacacaagaaggcgacctacgaacccgatgttgacctcggctctgggacgcgcaacatcggaattgagaacgaaatccctaatcttgacattatcggcaaaagaattgagaagatcaaacaggaacacgagaccagctggcattatgatcaggaccacccctacaagacatgggcctatcatggctcctacgagaccaaacaaacagggagcgcttcttccatggtgaacggagtcgtgcggctgctgaccaagccgtgggatgttgtgcctatggtcacacagatggccatgaccgacacgacacccttcggccagcagcgcgtgtttaaggaaaaagtggataccagaacccaagagcctaaggaagggacaaaaaagctcatgcggatcacggctgagtggctgtggaaagagcttggaaagaagaaaacccccagaatgtgtacacgggaagagttcacccgcaaggtcagaagcaatgccgctctgggcgccatttttacagacgaaaacaaatggaagtctgcgcgggaggccgttgaagattcccgcttctgggagctcgtggacagagagcggaatctgcacctggaagggaaatgcgagacctgtgtgtataacatgatgggaaagcgcgaaaaaaagctcggcgagtttggcaaggctaaagggagcagagccatctggtacatgtggctgggagctcggttccttgaatttgaggccctgggcttcctcaatgaggatcactggttttctcgcgggaactccctgagcggagtcgaaggcgaggggcttcataagctgggctacattctcagagacgtgtccaaaaaggaaggaggcgccatgtatgcggatgacacagctgggtgggacacccggatcacgctggaggatctgaaaaatgaagagatggttaccaaccacatgaagggagagcataagaaactcgccgaagccattttcaagctgacataccagaataaagtggtccgcgtgcagagacctaccccccggggcacagttatggacatcatcagccgcaaggatcagagagggtctggacaagtgggcacctatgggcttaacacgttcacaaatatggaggctcagctgattcggcagatggaaggcgagggaatctttaaaagcattcaacacctcaccgtcacagaggaaatcgccgtgagaaactggctggctcgcgttggccgggagagactttcccgcatggccatttctggggacgattgcgtggtcaagccgctggacgatcggttcgcgagcgccctcaccgctctgaatgacatgggaaaggtgagaaaagatatccagcagtgggaaccttcccgcggctggaacgactggacgcaggtccccttttgctctcatcacttccacgagctggtgatgaaggatgggcgggttctcgtggtcccctgtagaaaccaagacgaactgatcggacgcgcccggattagccagggcgctgggtggtcccttaaagagaccgcctgcctgggcaagtcttacgcgcagatgtggacactcatgtattttcatagacgcgatctgcggcttgccgctaatgccatctgtagcgctgtgccttcccactgggtgccgaccagcagaacaacctggtctattcatgccaaacacgagtggatgacaaccgaagacatgctggctgtttggaaccgggtgtggatccaggagaatccctggatggaagacaagacgcctgtcgagtcctgggaagaggtgccctacctcggaaagagagaggatcaatggtgcggcagcctgattgggctgacatctcgcgccacctgggcgaaaaacatccagaccgccattaatcaggttcggtccctcatcggaaacgaagagtatacagactacatgcctagcatgaagagattccgcaaagaagaggaagaggctggcgtgctgtggtga

SEQ ID NO: 19953 - RNA, 9876 nt, synthetic construct
  misc_feature 1..9876: note = derived and/or modified CDS sequence (opt5) from DENV-2__EU677145__SS-prME
  source 1..9876: mol_type = other RNA
accgccggcgtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgagacaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcattaccgaaaaggacagcccggtgaacatcgaggccgaacccccttttggggattcttacattatcatcggcgtcgagcccggacagctcaaactgaattggttcaagaagggctccagcattgggcaaatgtttgagacaaccatgagaggagctaaacgcatggccatccttggcgacacggcctgggatttcgggtctctgggaggcgtgtttacaagcattgggaaggctctccaccaggttttcggcgccatctacggagcggctttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggccgacagcggatgtgtcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaagagcttcgccggaccggtgtctcagcacaactaccgccctggctatcatacccaaaccgctgggccctggcaccttggaaagctcgaaatggattttgacttctgtgagggcacaaccgtcgtggtgacggaagattgcgggaaccggggaccctccctgagaacaaccacagccagcggcaaactgatcaccgagtggtgctgtcggtcctgcacactccctccgctgcgctacagaggcgaggacgggtgttggtacggaatggaaattcggccccttaaggagaaggaagagaatctggtcaactctctcgttaccgccggccatgggcagatcgataattttagcctgggagtgctgggcatggctcttttcctcgaagagatgctgagaacgcgcgtggggaccaaacacgcgatcctgctcgtcgccgtgtcctttgttacactgattaccggaaacatgtctttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcaccagcaaggagctgatgatggctacaattgggatcgccctcctgtcccagtctaccatgcccgaaaccattcttgagctgacagatgccctcgctctgggaatgatggtcctgaaaatcgtgcggaatatggaaaagtaccaacttgccgttacgatcatggcgattagctgcgtgcctaacgctgtcatcctgcagaatgcctggaaggtgtcctgtaccattctcgccacagtgagcgtctctcccctgctcctgacctccagccagcagaaagctgactggatccctcttgccctgacaattaagggcctcaaccccaccgctatctttctgacgacactgtctcgcacctccaaaaagagaagctggccgcttaatgaggccatcatggcggttgggatggtgtctattctggcctccagcctcctgaaaaacgacatccctatgaccggacccctcgtggctggcggcctgcttacagtctgctatgtgctgaccgggcggtccgccgatctggaactcgagcgcgctgccgacgttaagtgggaggatcaagccgaaattagcggatctagccctatcctgtccattacaatctctgaggacggcagcatgtccattaaaaatgaagaggaggaacagacgcttaccatcctgatcagaacagggctcctggtgatttctggagtcttccccgtgagcatcccgattaccgctgcggcctggtacctctgggaggttaagaagcagcgggctggcgtgctgtgggatgtcccttctccccctcccgtggggaaagccgaacttgaggacggagcctatcgcatcaagcagagaggcattctgggctacagccaaatcggggctggagtctataaagaaggcacatttcacaccatgtggcatgtgacgagaggggccgttctgatgcaccgcggaaagagaatcgagcccagctgggcggatgtgaaaaaggacctcatttcctacggcgggggatggaagctggagggcgaatggaaagagggcgaagaggtccaggtgcttgctctggaacctgggaagaacccgcgggccgttcagaccaaacccggaatcttcaagacaaataccggcacaattggggccgtgagcctcgatttttctcctggaacctccggcagccccatcgtcgacagaaaagggaaggtggtgggactgtacggcaacggcgttgtcacacgctctggggcttatgtgtccgccattgcgcagacggaaaagtccatcgaggataatcctgaaatcgaggacgatattttccggaaaaagagactcaccatcatggacctgcatcccggagctggcaaaacaaagcgctaccttcctgccattgtgcgggaagccatcaaaagagggctgcgcaccctgattctcgctccgacccgggtcgtggccgctgagatggaagaggccctgagaggacttcccatccgctatcaaacccctgcgattcgggccgagcacacgggcagagaaatcgttgacctgatgtgtcatgctaccttcacaatgcggctcctgtcccccgtgcgcgtccctaactacaacctcatcattatggatgaggcccactttaccgaccccgcttctatcgccgccagagggtatattagcacacgggtggaaatgggcgaggctgcgggaatcttcatgaccgccacgccgcctggctcccgcgatccctttccccagagcaatgctcctattatggacgaggaaagagagatccccgaacggtcttggaactccgggcacgagtgggttacagatttcaagggaaagaccgtgtggtttgtccctagcatcaaagccggcaatgacattgccgcttgcctgagaaagaacgggaaaaaggtgatccagctttctcgcaaaaccttcgatagcgaatacgttaagacacgggccaatgactgggattttgtggtcaccacagacatttccgagatgggagcgaacttcaaggctgagagagtgatcgatccgcgccggtgtatgaaacccgtgattctgaccgacggcgaagagagagtcatcctggccgggcctatgcccgttacgcattctagcgccgctcaacgccggggcagaatcggacgcaatcctaagaacgaaaatgaccagtatatttacatgggcgagcccctcgaaaacgatgaggactgcgcccactggaaagaggcgaagatgctgcttgataatatcaacacaccggaagggattatcccttccatgtttgagcccgaaagagagaaagtggacgccattgatggagaataccggctgcgcggcgaggctagaaagaccttcgtggacctcatgcggcgcggggatctgcctgtctggctggcctatagagtggctgccgagggaatcaattacgctgaccggaaatggtgttttgatggcattaagaacaatcagatcctcgaagagaacgttgaagtggagatctggacaaaggagggggaacgcaagaaacttaaaccccgctggctggacgcccggatttattctgatcctctggcgctcaaggagttcaaagagttcgccgctggcagaaagagcctgacccttaacctgatcacggagatgggacgcctccccacctttatgacacagaaggcccggaatgctctggacaacctggccgtcctccataccgccgaagctggcgggagagcgtacaatcacgccctttccgagctgccggagacactggaaaccctcctgcttctgacactcctggctaccgtgacgggaggcattttcctgtttctcatgagcgggaaaggaatcggcaagatgacacttggcatgtgctgcattatcaccgcctctatcctgctgtggtatgcccaaattcagcctcactggatcgctgcctccattatcctcgagttctttctgattgttcttctgatccccgaacccgagaaacagcggacccctcaggataaccaactcacatacgtggtcatcgcgattctgaccgtggtcgccgctacaatggccaatgaaatggggttcctggagaagacgaaaaaggacctcggacttggcagcatcaccacacaggagtccgaatctaacattctggacatcgatctgcgcccggctagcgcctggaccctctatgcggtggccacaacctttgttacgcccatgctgagacattccattgaaaattctagcgtgaacgtgtcccttaccgctatcgccaatcaggctacagtcctgatggggctcggaaagggctggcctctgagcaaaatggacattggggttcccctgctcgccatcggatgttactctcaggtgaaccctatcacccttacagctgccctgctgctcctggtggcgcactacgccattatcggccccggccttcaagctaaggccacccgggaagctcagaaacgcgccgccgcggggattatgaagaatcctacggtcgatggaatcacagtgattgacctggagccgatcccctatgatcctaaattcgaaaagcagctcggccaggttatgctgctgatcctctgcgtgacccaagtccttatgatgagaacaacctgggctctgtgtgaggccctgaccctcgctacagggcccatttccacgctgtgggagggaaaccctggccggttttggaataccacaatcgccgtgagcatggccaacattttccgcgggtcttaccttgctggagccggcctgctcttttccatcatgaagaataccacaaacaccagacggggcacggggaatattggagaaacactgggcgagaaatggaaaagccgcctgaacgcgctcgggaaatctgagttccagatctataagaaaagcggaatccaggaggtcgacagaacccttgccaaggagggcattaaaagaggggaaaccgatcatcacgctgtgtccagaggatctgccaagctgcgctggtttgttgagcggaacatggtgacacccgaaggcaaggtcgtggacctgggctgcgggagaggaggctggagctactattgtgggggactcaaaaatgttcgcgaggtgaagggcctgaccaaagggggaccgggccatgaagaacctgtccccatgtccacatacggctggaaccttgtgcggctgcaaagcggggtggatgttttcttcacgccccctgagaagtgcgacaccctcctgtgtgatatcggagaatcctctcccaatcctacaattgaggctggcagaaccctgcgcgtcctcaaccttgtggaaaattggctgaacaataacacacagttttgcatcaaagtgctgaatccgtatatgcccagcgtcattgagaagatggaaaccctccagcggaagtacgggggagccctggttagaaaccctctttcccgcaattctacgcacgagatgtactgggtgagcaacgcgaccggcaatatcgtgtcctctgtcaacatgatcagccggatgctgattaatagattcacaatgaaacacaagaaagccacctatgagcccgacgtggatctcgggtccggaacacgcaacatcggcattgaaagcgagatccctaacctggacattatcggcaagcggattgagaagatcaagcaggagcatgaaacctcttggcactacgaccaagatcatccctataagacatgggcttaccacgggtcctatgagaccaaacagacgggaagcgcctcttccatggttaatggcgtggtcagactgctcacaaagccgtgggacgtggttcctatggtgacccagatggctatgaccgatacaacgccctttgggcagcaacgcgtcttcaaagagaaggtggacaccagaacacaggaacctaaagagggaaccaagaaacttatgaagatcacagccgaatggctgtggaaggagctgggcaaaaagaaaacaccccggatgtgtacacgcgaggaatttaccaagaaagtgagaagcaacgctgccctcggggcgattttcacggatgagaataagtggaagtctgcccgggaagctgtcgaggacggaagattttgggaactggttgatcgggagcgcaaccttcacctggagggcaaatgcgaaacctgtgtgtacaatatgatgggcaagagagagaaaaagctcggggagttcggaaaagccaagggctcccgggctatctggtatatgtggctgggggcccgctttctggagttcgaagccctcggatttctgaacgaggaccattggttcagcagaggcaattcccttagcggggtggagggcgaaggactgcaccggctcggctacattctgcgcgaggtcgggaagaaagaaggaggcgcgatgtacgctgatgacacagccgggtgggataccagaatcacacttgaggacctgaagaacgaagagatggtgaccaatcatatgaaaggagagcacaagaaactcgccgaagctatttttaagctgacgtatcagaacaaggttgtgcgggtccagcgccctacacccagaggcaccgtgatggacatcatctctcggcgcgatcaaagagggagcggccaggttggaacatacggcctgaataccttcacgaacatggaggcccagctcattcggcaaatggaaggggagggaatcttcaaatccattcagcatctgaccgctacagaggaaatcgccgtgcagaattggcttgcgcgcgtcggcagagagcggctgtctagaatggccattagcggggacgattgcgtggttaagccgatcgacgatcgctttgcttccgccctcaccgctctgaacgacatgggaaaagtgcggaaggatatccagcaatgggaaccttctagaggctggaatgactggacacaggtccccttctgcagccaccactttcatgagcttgtgatgaaagatgggcgcgtcctggtggttccctgtcggaaccaggacgaactcattggcagagcccgcatctcccagggagcgggctggtctctgaaggagaccgcctgcctgggaaagagctatgctcaaatgtggacactcatgtacttccaccggagagatctgcgccttgccgctaacgccatttgttccgctgtgcctagccattgggtcccgacctctcggacgacatggtccatccacgccaaacacgagtggatgaccaccgaagacatgctggcggtgtggaatagagtgtggattcaggagaacccctggatggaagataagacacctgttgagagctgggaagaggtgccctatctcggaaaacgcgaggaccagtggtgcggctctctgatcgggcttacctcccgggccacatgggctaagaatattcagacggccatcaaccaagtcagaagcctgatcggaaatgaagagtacaccgactatatgccttccatgaaacggtttagacgcgaagaggaagaggccggcgtgctctggtga

SEQ ID NO: 19954 - RNA, 9876 nt, synthetic construct
  misc_feature 1..9876: note = derived and/or modified CDS sequence (opt5) from DENV-2__EU677146__SS-prME
  source 1..9876: mol_type = other RNA
accgtgggagtcatcgttatgctgattcccaccgccatggctttccacctcacgacccggaatggggagcctcatatgatcgtgggacggcaggaaaagggcaagagcctgctttttaagacagaggacggggtgaatatgtgcaccctgatggccattgatctcggagaactgtgtgaggacacaatcacctacaagtgcccgcttctgcgccaaaatgaacccgaggatattgactgttggtgcaattccacatctacctgggtcacgtatggcacctgtacaaccacaggggagcaccggcgggaaaagcgcagcgtggcgctcgttcctcatgtgggaatgggcctggagaccagaacggaaacatggatgtcctctgagggcgcttggaagcacgtccagcggatcgagacctggatcctgcgccatcccgggttcacaattatggccgccatcctcgcttacaccattggaaccacacactttcagagagccctgatcttcattcttctgacggctgtggcccctagcatgaccatgcggtgcatcggcatttccaaccgcgattttgttgaaggggtgtctggaggcagctgggtcgacatcgtgctcgagcacgggtcctgtgtgacaaccatggcgaagaataagcccacactggatttcgaacttatcaaaaccgaggccaagcagcctgctacgctgagaaaatattgcattgaagccaagctcacaaacaccaccacagagagccggtgtccgacccaaggagagccctctctgaatgaggaacaggacaaacgctttatctgcaagcattccatggtcgatagaggctggggcaacgggtgtggactgttcggcaaagggggaattgttacatgcgctatgtttacgtgcaaaaagaatatggaaggcaaagtggtgctccctgagaacctggaatacaccatcgtcattacaccccacagcggggaggagcatgccgtgggaaatgacaccggcaagcacggcaaagaaatcaagatcacacctcagtcttccattaccgaggcggaacttacggggtatggaaccgttacaatggagtgtagcccccggaccggcctggatttcaacgaaatggtgctcctgcagatggaggacaaagcctggcttgtccaccgccaatggtttctggatctcccgctgccttggctgcccggggctgacacacagggatctaattggatccagaaggagaccctcgtgacgttcaagaaccctcatgccaaaaagcaggacgttgtggtcctgggctcccaagaaggggctatgcacacagcccttaccggcgccacagagattcagatgagctccggaaatctgctctttaccggccatctgaaatgcagacttcggatggataagctgcagctcaaagggatgtcttacagcatgtgtaccggaaagttcaagatcgtgaaagaaattgctgagacacaacacggcacgatcgtcatcagagtgcagtatgagggggacggatccccctgcaagattcccttcgaaatcatggatctggagaaacgccatgttctgggccggctcattaccgtgaaccctatcgtcacagaaaaggacagcccggtgaacattgaggcggaacccccttttggggattcttacatcattatcggcgttgagcccggacagctgaaacttaattggttcaagaagggctccagcatcgggcagatgtttgagaccacaatgagaggagccaaacgcatggctattctgggcgacaccgcctgggatttcgggtctctcggaggcgtgtttacgagcatcgggaaggccctgcaccaagtcttcggcgctatttacggagccgcgttttccggcgtgtcttggacaatgaaaatcctgattggggtgatcatcacctggattggaatgaacagccggtccaccagcctttctgtttccctcgtcctggtgggcgtggtcacactgtatctcggggtgatggttcaggctgacagcggatgtgtggtctcttggaagaataaagaactgaagtgcggctccgggatcttcattaccgataacgtgcacacatggacggagcagtacaagtttcagcctgaaagcccctccaaacttgcctctgccatccaaaaggctcatgaggaaggcatttgtggaatcagaagcgttacccgcctggagaatctcatgtggaaacagatcacaccggagctgaaccacattctgtccgaaaatgaggccaaacttaccatcatgacaggcgacattaaagggatcatgcaggctggaaagcggtctctcagacctcagcccaccgaactgaaatatagctggaagacgtggggcaaggccaaaatgctgtccaccgagagccataaccaaacattcctcattgatgggcctgaaaccgcggagtgccccaatacaaaccgcgcctggaactctctggaggtggaagactacggatttggcgtcttctccaccaacatctggcttaagctgcgggagaaacaggacgtgttttgtgatagcaagctcatgtctgctgccatcaaagacaatagagctgttcacgccgatatgggctattggattgaatccgcgctgaacgacacatggaagatggagaaggccagcttcatcgagattaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccgtgagcatcccgattacggctgcggcctggtacctgtgggaggtcaagaagcaacgggctggcgtgctttgggatgtcccttctccccctcccgtggggaaagccgaactggaggacggagcctatcgcatcaagcagagaggcatttttggctacagccagatcggggctggagtttataaagaaggcaccttccatacaatgtggcacgtgaccagaggggccgtcctgatgcatcgcggaaagagaatcgagcccagctgggcggatgtgaaaaaggacctcatttcctacggcgggggatggaagctggagggcgaatggaaagagggcgaagaggttcaggtgcttgctctggaacctgggaagaatccgcgggccgtccaaacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcaccccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcataccggcagagaaattgtcgacctcatgtgtcacgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccagagcaacgctcctatcatggacgaggaaagagagattcccgaacggtcttggaactccgggcatgagtgggtcacagattttaagggaaagaccgtgtggttcgttcctagcatcaaagccggcaacgacatcgccgcttgccttagaaagaatgggaaaaaggtgattcaactgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccactctagcgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccaaattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccagcctcattggattgccgcttccatcattctggagtttttccttatcgtgctgctcattcccgaacccgagaaacaaagaacgcctcaggacaaccagctgacatacgtcgtgatcgccatcctgaccgttgtggcggccaccatggctaatgaaatggggtttctcgagaagaccaagaaggaccttggactgggcagcattaccacacaggagtccgaatctaacatcctggatattgacctccggccggccagcgcttggacgctgtatgccgtggcgaccacattcgtcacccccatgcttcgccactccatcgaaaattctagcgttaacgtgtccctgacagccattgctaatcaagccaccgtgctcatggggctgggaagaggctggcctctgagcaaaatggatatcggggtccccctccttgctattggatgttactctcaggtgaaccctatcacgctgaccgccgctctgctcctgcttgttgcccattacgcgatcattggccccggcctgcaggccaaggctacacgggaagcccagaagcgcaccgctgccgggatcatgaaaaatcctacagtggacggaattaccgtcatcgatctcgagccgattccctatgaccctaagtttgaaaaacaactgggccaggtgatgctgctcgtcctttgcgtgacgcaggttctgatgatgagaacaacctgggccctgtgtgaggcgctcacactggctaccgggcccatctccaccctttgggagggaaaccctggccggttctggaatacaacgatcgccgtgagcatggctaacatttttcgcgggtcttacctggccggagccggcctcctgttctccatcatgaagaataccacaaacaccagacggggcacagggaatattggagaaaccctgggcgagaaatggaaaagcagactcaacgctcttgggaagtctgaatttcagatctataaaaagagcggcattcaagaggtcgatcgcacgctggccaaagagggcatcaagagaggggaaacagaccaccatgcggtgtccagaggatctgccaaactgcgctggttcgttgagcggaacatggtgacccccgaaggcaaggtcgtggatctcggctgcgggagaggaggctggagctactattgtgggggactgaaaaatgtgcgcgaggttaagggccttaccaaagggggaccgggccacgaggagcctatccccatgtccacatacggctggaacctggtccggctccagagcggggtggacgtgttctttacaccccctgagaaatgcgatacactgctgtgtgacattggagaatcctctcccaatcctacgatcgaggctggcagaaccctccgcgtccttaacctggttgaaaattggctgaacaataacacacagttctgcattaaggtgctcaatccgtatatgcccagcgtgatcgagaaaatggaaaccctgcaacggaagtacgggggagcccttgtcagaaaccctctgtcccgcaattctacacacgagatgtactgggtgagcaacgctaccggcaatattgtttcctctgtgaacatgatcagccggatgctcatcaatagatttacgatgaaacataagaaggccacctatgagcccgatgtcgacctggggtccggaacacgcaacattggcatcgaaaacgagattcctaatctggacatcattggcaaaagaatcgaaaagattaaacaggagcacgaaaccagctggcattacgatcaggaccacccctataagacatgggcgtaccacgggtcttatgagaccaaacagacaggatccgccagctctatggtgaacggcgttgtgaagctccttaccaagccgtgggatgtcgtgcctatggtgacgcaaatggctatgacagacaccacccccttcgggcagcagcgggtctttaaagagaaggttgatacacgcacgcaggaacctaaagagggaaccaagaaactgatgagaatcacagccgaatggctgtggaaggagctcggcaagaaaaagacaccccggatgtgtacaagagaggagttcacccggaaagtgcgctccaatgctgccctgggggctatctttacagacgagaacaagtggaaaagcgccagagaagcggtggaggattctcggttctgggaacttgtcgaccgcgagagaaatctgcatctcgagggaaagtgcgaaacctgtgtgtacaacatgatgggcaaacgggagaagaagctgggcgaatttgggaaagccaagggatcccgcgctatttggtatatgtggctgggcgccagattcctcgagtttgaagctctggggttccttaatgaggatcactggtttagccggggaaactccctgagcggcgttgagggggaaggcctccataaactgggatacatccttcgcgacgtgtctaagaaagagggcggggccatgtacgccgatgacacggcgggatgggacaccagaattacactggaagatctcaagaatgaggaaatggtcaccaaccacatgaagggcgagcataaaaagctggctgaggccatcttcaaactgacatatcaaaataaggtggttcgggtgcagcgccctacccccagagggacggtcatggacattatcagccggaaagatcagcgcggatccggccaggtggggacatacggcctcaacaccttcacaaatatggaagcccaactgatcagacagatggagggagaaggcatttttaagtctatccagcggcttaccgttacggaggagattgctgtgcaaaactggctggccagagtcgggcgcgaacggctcagcagaatggctatctccggagacgattgcgtggtcaagccgctggacgatcgcttcgcctctgcgcttaccgccctgaatgacatgggcaaagtgcggaaggatattcagcagtgggagcctagcagagggtggaacgactggacacaggttcccttttgctcccaccacttccatgaactcgtgatgaaagatggacgcgtcctggtggtgccctgtcggaaccaagacgagctgatcggcagagctcgcatctctcagggggccggctggagcctcaaggaaaccgcttgcctgggaaaatcctatgcccagatgtggacacttatgtactttcaccggagagatctgcgcctcgcggccaatgctatttgtagcgccgttccttctcattgggtgccgacctcccggacaacctggagcatccacgctaagcacgagtggatgacgacagaggacatgctggccgtctggaacagagtgtggattcaggaaaatccctggatggaggacaagacccctgttgaatcttgggaggaagtgccctatcttggcaaacgggaggatcaatggtgcgggtccctgatcggactcaccagcagagctacatgggccaagaacattcagaccgcgatcaatcaggtccgctccctgattggcaacgaggaatacacagactatatgccttctatgaaacggttcagaaaggaggaagaggaagccggggtgctgtggtga

SEQ ID NO: 19955 - RNA, 9876 nt, synthetic construct
  misc_feature 1..9876: note = derived and/or modified CDS sequence (opt5) from DENV-2__EU687214__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaatagcacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccgttatggcggtggggatggtgagcatcctcgcctcttccctgctcaaaaatgacattcctatgacaggacccctggtcgctggcggccttctgaccgtgtgctatgttctgaccgggcggagcgccgatctcgaactggagcgcgctgccgacgtgaagtgggaggatcaggccgaaatctccggaagctctcctattcttagcatcacaatttccgaggacggctctatgagcatcaaaaacgaagaggaggaacacaccctgacaatcctcattagaacggggctgctcgtcatctccggagtgttccccgtttctattccgatcaccgctgcggcctggtacctgtgggaggtgaagaagcaacgggctggcgtcctttgggatgtgccttctccccctcccgtcgggaaagccgaactggaggacggagcctatcgcattaagcagagaggcatctttggctactcccagatcggggctggagtgtataaagaaggcacattccataccatgtggcacgttacaagaggggccgtgctgatgcatcgcggaaagagaattgagccctcctgggcggatgtcaaaaaggacctcatcagctacggcgggggatggaagctggagggcgaatggaaagagggcgaagaggtgcaggttcttgctctggaacctgggaagaatccgcgggccgtgcaaaccaaacccggactctttaagacgaacaccggcacaattggggccgtctccctggatttcagccctggaacctctggctcccccatcgtggacagaaaagggaaggtggttggactctacggcaatggcgtcgtgacacgcagcggggcttatgtgtctgccattgcgcagaccgagaagtccatcgaggataaccctgaaatcgaggacgatattttccggaaaaagagactgacaatcatggaccttcaccccggagctggcaaaacgaagcgctacctgcctgccattgtccgggaagccatcaaaagagggctgcgcaccctcattctggctccgacacgggtggttgccgctgagatggaagaggcccttagaggactgcccatccgctatcagacccctgcgattcgggccgagcataccggcagagaaatcgtggacctcatgtgtcacgctacatttacgatgcggctgctcagccccgtccgcgtgcctaactacaatctgatcattatggatgaggcccacttcaccgaccccgcttccatcgccgccagagggtatatttctacacgggttgaaatgggcgaggctgcgggaatctttatgaccgccacaccgcctggcagccgcgatcccttcccccagtccaacgctcctattatggacgaggaaagagagatccccgaacggagctggaactctgggcatgagtgggtgaccaactttaagggaaagacggtctggttcgtgccttccatcaaagccggcaatgatattgccgcttgccttagaaagaacgggaaaaaggttatccaactgagccgcaaaacatttgactctgaatacgtgaagacccgggccaatgattgggacttcgtcgtgaccacagatattagcgagatgggagcgaactttagagctgagcgcgtgatcgacccgcggagatgtatgaagcccgtcattctgaccgatggcgaggaacgcgttatcctcgccgggcctatgcccgtgacacactcctctgccgctcagcggagaggccgcatcggaagaaatcctaaaaacgaaaatgaccagtatatttacatgggcgagcccctggaaaacgacgaggattgcgcccattggaaggaggcgaaaatgcttctggacaatatcaacaccccggaagggattatccctagcatgttcgagcccgaacgggagaaggtggatgccattgacggagaataccgcctcagaggcgaggctcggaaaacgtttgtcgatctgatgcgcagaggggacctgcctgtgtggctcgcctatcgggttgctgccgagggaatcaattacgctgatagacgctggtgtttcgacggcattaagaacaaccaaatccttgaagagaatgtggaagtcgagatctggacaaaagagggggaacggaagaagctgaaacccagatggctggatgcccgcatttattccgaccctctcgcgctgaaggagttcaaagaatttgccgctggccggaagtctcttaccctgaacctcatcacagagatgggaagactgcccaccttcatgacgcagaaagcccgggatgctctggacaatctcgccgtgcttcacaccgccgaagttggcgggcgcgcttacaaccacgcgctgagcgagctgccggagacactcgaaaccctgcttctgctcacactgctggccaccgtgacaggaggcatttttctcttccttatgtccgggaagggaatcggcaagatgaccctgggcatgtgctgcattatcacggctagcatcctgctctggtatgcccagattcagcctcattggatcgccgcttctattatcctggagtttttccttattgtcctgctcatccccgaacccgagaaacaaagaacacctcaggataatcagctgacctacgtggtcatcgccattctgaccgtggttgcggccacaatggctaacgaaatggggtttctcgagaagaccaaaaaggaccttggactgggctccatcacaacgcaggagagcgaatccaatattctggacatcgatctccggccggcctctgcttggaccctgtatgccgtggcgacaaccttcgtgacacccatgcttcgccacagcattgagaactcctctgtcaatgttagcctgaccgccatcgctaaccaagccacggtgctcatggggctgggaagaggctggcctctgtccaaaatggacattggggtgcccctccttgctatcggatgttacagccaggtcaatcctatcaccctgacagccgctctgctcctgcttgtggcccattacgcgattatcggccccggcctgcaggccaaggctacccgggaagcccagaagcgcacagctgccgggattatgaaaaaccctaccgttgatggaatcacggtgattgacctcgagccgatcccctatgatcctaagtttgaaaaacaactgggccaggtcatgctgctcgtgctttgcgtcacacaggtgctgatgatgagaaccacatgggccctgtgtgaggcgctcaccctggctaccgggcccatctctacactttgggagggaaatcctggccggttctggaacacgaccattgccgtttccatggctaatatctttcgcgggagctacctggccggagccggcctcctgttctctattatgaagaacacaaccaatacaagacggggcaccgggaacatcggagaaacgctgggcgagaaatggaagtccagactcaacgctcttggaaagagcgaatttcagatttataaaaagtctggaatccaagaggtggaccgcacactggccaaagagggcatcaagagaggggaaaccgatcaccatgcggtcagcagaggatccgccaaactgcgctggttcgtggagcggaatatggttacccccgaaggcaaggtggtcgacctcggctgcgggagaggaggctggtcttactattgtgggggactgaaaaacgtgcgcgaggtgaagggccttacaaaagggggaccgggccacgaggaacctattcccatgagcacctacggctggaatctggttcggctccagtccggggtcgatgtgttctttacaccccctgagaaatgcgacacgctgctgtgtgatatcggagaaagctcccccaaccctaccattgaggctggcagaacactccgcgtgcttaatctggtcgaaaactggctgaataacaatacccagttctgcgttaaggtgctcaacccgtatatgccctctgtgatcgagaaaatggaaacactgcaacggaagtacgggggagcccttgtcagaaatcctctgagccgcaactccacccacgagatgtactgggtgtctaatgctacgggcaacattgttagctccgtgaatatgatctctcggatgctcatcaacagatttaccatgaaacataagaaggccacatatgagcccgacgtcgatctggggagcggaacccgcaacattggcatcgaaaatgagattcctaacctggacatcattggcaaaagaatcgaaaagattaaacaggagcacgaaacatcctggcattacgaccaggatcacccctataagacctgggcgtaccacgggagctatgagacaaaacagaccggatctgcctccagcatggtgaatggcgttgtgaagctccttacgaagccgtgggacgtcgtgcctatggtgacacaaatggctatgaccgataccacacccttcgggcagcagcgggtctttaaagagaaggttgacacgcgcacccaggaacctaaagagggaacaaagaaactgatgagaatcaccgccgaatggctgtggaaggagctcggcaagaaaaagacaccccggatgtgtaccagagaggagttcacacggaaagtgcgctctaacgctgccctgggggctatctttaccgatgagaataagtggaaatccgccagagaagcggtggaggacagccggttctgggaacttgtcgatcgcgagagaaacctgcatctcgagggaaagtgcgaaacgtgtgtgtacaatatgatgggcaaacgggagaagaagctgggcgaatttgggaaagccaagggatctcgcgctatttggtatatgtggctgggcgccagattcctcgagtttgaagctctggggttccttaacgaggaccactggttttcccggggaaatagcctgtccggcgttgagggggaaggcctccataaactgggatacatccttcgcgatgtgagcaagaaagagggcggggccatgtacgccgacgataccgcgggatgggacacaagaattaccctggaagacctcaagaacgaggaaatggtcacaaatcacatgaagggcgagcataaaaagctggctgaggccatcttcaaactgacctatcaaaacaaggtggttcgggtgcagcgccctacgcccagagggacagtcatggatattatctctcggaaagaccagcgcggaagcggccaggtggggacctacggcctcaatacattcaccaacatggaagcccaactgatcagacagatggagggagaaggcatttttaagtccatccagcggcttacggttaccgaggagattgctgtgcaaaattggctggccagagtcgggcgcgaacggctctctagaatggctatcagcggagatgactgcgtggtcaagccgctggatgaccgcttcgcctccgcgcttattgccctgaacgatatgggcaaagtgcggaaggacatccagcagtgggagccttctagagggtggaacgattggacacaggttcccttttgcagccaccacttccatgaactcgtgatgaaagacggacgcgtcctggtggtgccctgtcggaatcaagatgagctgatcggcagagctcgcatttcccagggggccggctggtctctcaaggaaaccgcttgcctgggaaaaagctatgcccagatgtggacacttatgtactttcaccggagagacctgcgcctcgcggccaacgctatctgttccgccgttcctagccattgggtgccgacctctcggacaacctggtccattcacgctaagcacgagtggatgacgacagaggatatgctggccgtctggaatagagtgtggatccaggaaaacccctggatggaggacaagacccctgttgaaagctgggaggaagtgccctatcttggcaaacgggaggaccaatggtgcgggtctctgattggactcacctccagagctacatgggccaagaatatccagaccgcgattaaccaggtccgcagcctgatcggcaatgaggaatacacagattatatgccttccatgaaacggttcagaaaggaggaagaggaagccggggtgctgtggtga

SEQ ID NO: 19956 - RNA, 9876 nt, synthetic construct
  misc_feature 1..9876: note = derived and/or modified CDS sequence (opt5) from DENV-2__EU687215__SS-prME
  source 1..9876: mol_type = other RNA
accgccggcgtgatcattatgctgatccccaccgctatggccttccacctcacgacccggaacggggagcctcatatgattgtcggacggcaggaaaagggcaaaagcctgctttttaagaccgaggacggggttaatatgtgcaccctgatggcgatcgatctcggagaactgtgtgaggacacgattacctacaaatgcccgcttctgcgccaaaacgaacccgaggatatcgactgttggtgcaatagcacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccgttatggcggtggggatggtgagcatcctcgcctcttccctgctcaaaaatgacattcctatgacaggacccctggtcgctggcggccttctgaccgtgtgctatgttctgaccgggcggagcgccgatctcgaactggagcgcgctgccgacgtgaagtgggaggatcaggccgaaatctccggaagctctcctattcttagcatcacaatttccgaggacggctctatgagcatcaaaaacgaagaggaggaacacaccctgacaatcctcattagaacggggctgctcgtcatctccggagtgttccccgtttctattccgatcaccgctgcggcctggtacctgtgggaggtgaagaagcaacgggctggcgtcctttgggatgtgccttctccccctcccgtcgggaaagccgaactggaggacggagcctatcgcattaagcagagaggcatctttggctactcccagatcggggctggagtgtataaagaaggcacattccataccatgtggcacgttacaagaggggccgtgctgatgcatcgcggaaagagaattgagccctcctgggcggatgtcaaaaaggacctcatcagctacggcgggggatggaagctggagggcgaatggaaagagggcgaagaggtgcaggttcttgctctggaacctgggaagaatccgcgggccgtgcaaaccaaacccggactctttaagacgaaaaccggcacaattggggccgtctccctggatttcagccctggaacctctggctcccccatcgtggacagaaaggggaaggtggttggactctacggcaacggcgtcgtgacacgcagcggggcttatgtgtctgccattgcgcagaccgagaaatccatcgaggataatcctgaaatcgaggacgatattttccggaagaaaagactgacaatcatggaccttcaccccggagctggcaagacgaaacgctacctgcctgccattgtccgggaagccatcaagagagggctgcgcaccctcattctggctccgacacgggtggttgccgctgagatggaagaggcccttagaggactgcccatccgctatcagacccctgcgattcgggccgagcataccggcagagaaatcgtggacctcatgtgtcacgctacatttacgatgcggctgctcagccccgtccgcgtgcctaactacaacctgatcattatggatgaggcccacttcaccgaccccgcttccatcgccgccagagggtatatttctacacgggttgaaatgggcgaggctgcgggaatctttatgaccgccacaccgcctggcagccgcgatcccttcccccagtccaatgctcctattatggacgaggaaagagagatccccgaacggagctggaactctgggcatgagtgggtgaccgattttaagggaaaaacggtctggttcgtgccttccatcaaggccggcaatgacattgccgcttgccttcgcaagaacgggaagaaagttatccaactgagccgcaagacatttgattctgaatacgtgaagacccgggccaatgactgggatttcgtcgtgaccacagacattagcgagatgggagcgaactttagagctgagcgcgtgatcgatccgcggagatgtatgaaacccgtcattctgaccgacggcgaagaaagagttatcctcgccgggcctatgcccgtgacacactcctctgccgctcagcggagaggccgcatcggaagaaatcctaagaacgaaaatgaccagtatatttacatgggcgagcccctggaaaacgatgaggactgcgcccattggaaagaggcgaagatgcttctggataatatcaacaccccggaagggattatccctagcatgttcgagcccgaacgggagaaagtggacgccattgatggagaataccgcctcagaggcgaggctcggaagacgtttgtcgacctgatgcgcagaggggatctgcctgtgtggctcgcctatcgggttgctgccgagggaatcaattacgctgacagacgctggtgtttcgatggcattaaaaacaatcaaatccttgaagagaacgtggaagtcgagatctggacaaaggagggggaacggaagaaactgaagcccagatggctggacgcccgcatttattccgatcctctcgcgctgaaagagttcaaggaatttgccgctggccggaaatctcttaccctgaacctcatcacagagatgggaagactgcccaccttcatgacgcagaaggcccgggacgctctggataatctcgccgtgcttcacaccgccgaagttggcgggcgcgcttacaaccacgcgctgagcgagctgccggagacactcgaaaccctgcttctgctcacactgctggccaccgtgacaggaggcatttttctcttccttatgtccgggaagggaatcggcaaaatgaccctgggcatgtgctgcattatcacggctagcatcctgctctggtatgcccagattcagcctcattggatcgccgcttctattatcctggagtttttccttattgtcctgctcatccccgaacccgagaagcaaagaacacctcaggacaatcagctgacctacgtggtcatcgccattctgaccgtggttgcggccacaatggctaacgaaatggggtttctcgagaaaaccaagaaagaccttggactgggctccatcacaacgcaggagagcgaatccaatattctggatatcgacctccggccggcctctgcttggaccctgtatgccgtggcgacagccttcgtgacccccatgcttcgccacagcattgagaactcctctgtcaatgttagcctgacagctatcgccaaccaagctaccgtgctcatggggctgggaagaggctggcctctgtccaagatggatattggggtgcccctccttgccatcggatgttacagccaggtcaatcctatcacgctgaccgctgccctgctcctgcttgtggcgcattacgccattatcggccccggcctgcaggctaaggccacacgggaagctcagaaacgcaccgccgccgggattatgaagaaccctacagttgacggaatcaccgtgattgatctcgagccgatcccctatgaccctaaatttgaaaagcaactgggccaggtcatgctgctcgtgctttgcgtcacacaggtgctgatgatgagaacaacctgggcgctgtgtgaggctctcacactggccaccgggcccatctctaccctttgggagggaaatcctggccggttctggaacacaacgattgctgtttccatggccaatatctttcgcgggagctacctggccggagctggcctcctgttctctattatgaaaaacaccacaaataccagacggggcacagggaacatcggagaaaccctgggcgagaagtggaagtccagactcaatgcccttgggaaaagcgaatttcagatttataagaaatctggaatccaagaggtggatcgcacgctggcgaaggagggcatcaaaagaggggaaacagaccaccatgccgtcagcagaggatccgctaagctgcgctggttcgtggagcggaacatggttacccccgaaggcaaagtggtcgatctcggctgcgggagaggaggctggtcttactattgtgggggactgaagaacgtgcgcgaggtgaagggccttaccaaagggggaccgggccacgaggaacctattcccatgagcacatacggctggaatctggttcggctccagtccggggtcgacgtgttctttacaccccctgagaagtgcgatacactgctgtgtgacatcggagaaagctcccccaaccctacgattgaggccggcagaaccctccgcgtgcttaatctggtcgaaaactggctgaataacaatacacagttctgcgttaaagtgctcaacccgtatatgccctctgtgatcgagaagatggaaaccctgcaacggaaatacgggggagctcttgtcagaaatcctctgagccgcaactccacacacgagatgtactgggtgtctaatgccaccggcaacattgttagctccgtgaatatgatctctcggatgctcatcaacagatttacgatgaagcataagaaagcgacctatgagcccgatgtcgacctggggagcggaacacgcaatattggcatcgaaaacgagattcctaacctggacatcattggcaagagaatcgagaaaattaagcaggagcacgaaacctcctggcattacgatcaggaccacccctataaaacatgggcctaccacgggagctatgagaccaagcagacaggatctgcttccagcatggtgaatggcgttgtgaagctccttaccaaaccgtgggatgtcgtgcctatggtgacgcaaatggccatgacagacaccacccccttcgggcagcagcgggtctttaaggagaaagttgatacacgcacgcaggaacctaaggagggaaccaaaaagctgatgagaatcacagctgaatggctgtggaaggagctcggcaaaaagaaaacaccccggatgtgtacaagagaggagttcacccggaaggtgcgctctaacgccgctctgggggccatctttacagacgagaataaatggaagtccgcgagagaagccgtggaggatagccggttctgggaacttgtcgaccgcgagagaaacctgcatctcgagggaaaatgcgaaacctgtgtgtacaatatgatgggcaagcgggagaagaaactgggcgaatttgggaaggctaaaggatctcgcgccatttggtatatgtggctgggcgctagattcctcgagtttgaagccctggggttccttaacgaggatcactggttttcccggggaaatagcctgtccggcgttgagggggaaggcctccataagctgggatacatccttcgcgacgtgagcaaaaaggagggcggggccatgtacgcggatgacacggctggatgggacaccagaattacactggaagatctcaagaacgaggaaatggtcaccaatcacatgaaaggcgagcataagaaactggccgaggccatcttcaagctgacatatcaaaacaaagtggttcgggtgcagcgccctacccccagagggacggtcatggacattatctctcggaaggatcagcgcggaagcggccaggtggggacatacggcctcaataccttcacaaacatggaagctcaactgatcagacagatggagggagaaggcatttttaagtccatccagcggcttaccgttacggaggagattgccgtgcaaaattggctggctagagtcgggcgcgaacggctctctagaatggccatcagcggagacgattgcgtggtcaaaccgctggacgatcgcttcgcgtccgcccttaccgctctgaacgacatgggcaaggtgcggaaagatattcagcagtgggagccttctagagggtggaatgactggacacaggttcccttttgcagccaccacttccatgaactcgtgatgaaggatggacgcgtcctggtggtgccctgtcggaaccaagacgagctgatcggcagagcccgcatctcccagggggctggctggtctctcaaagaaaccgcctgcctgggaaagagctatgcgcagatgtggacacttatgtactttcaccggagagatctgcgcctcgccgctaacgccatttgttccgctgttcctagccattgggtgccgacctctcggacaacctggtccatccacgccaagcacgagtggatgacgacagaggacatgctggctgtctggaatagagtgtggattcaggaaaacccctggatggaggacaaaacccctgttgaaagctgggaggaagtgccctatcttggcaagcgggaggatcaatggtgcgggtctctgatcggactcacctccagagccacatgggcgaaaaatattcagaccgccatcaaccaggtccgcagcctgattggcaatgaggaatacacagactatatgccttccatgaagcggttcagaaaagaggaagaggaagctggggtgctgtggtga

SEQ ID NO: 19957 - RNA, 9876 nt, synthetic construct
  misc_feature 1..9876: note = derived and/or modified CDS sequence (opt5) from DENV-2__EU687216__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaagacacaatcacctacaagtgcccgcttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttaatttctgtgagggcaccacggtcgtggtgacagaagactgcgggaaccggggaccctctctgagaaccacaaccgcctccggcaaactgattacagagtggtgctgtcggagctgcaccctccctccgctgcgctacagaggcgaggatgggtgttggtacggaatggaaatccggccccttaaggagaaggaagagaatctggtcaactccctcgttacggccggccatgggcagattgacaatttttctctgggagtgctgggcatggctcttttcctcgaagagatgctgagaacccgcgtggggacaaaacacgcgatcctgctcgtcgccctgagctttgtgacccttatcacaggaaacatgtccttccgggatctgggcagagttatggtgatggtcggcgctaccatgacggacgatattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggacgccctggctcttggaatgatggtgctgaaaattgtccggaatatggaaaagtaccaactcgccgtgaccatcatggcgatctcttgcgttcctaacgctgtgattctgcagaatgcctggaaggtcagctgtacaatcctcgccgctgtgtccgtgagccccctgcttctgacctcttcccagcagaaagccgattggattcctctcgctctgacaatcaagggcctgaaccccaccgccatttttcttacgacactgagccgcacctctaaaaagagatcctggccgctcaatgaggcgatcatggccgtcgggatggttagcatcctggcttcttccctcctgaaaaacgacattcctatgaccggaccccttgtggccggcggcctgctgacagtgtgctatgtcctcaccgggcggagcgctgacctggaacttgagcgcgccgccgatgtgaagtgggaggaccaagctgaaatctccggaagctctcctattctgagcatcacaatttccgaggatggctctatgagcatcaaaaatgaagaggaggaacagacgctcaccattctgatcagaacagggctcctggttatctccggagtgttccccgtctctattccgatcaccgcggccgcttggtacctttgggaggtgaagaagcagcgggccggcgttctgtgggacgtgccttctccccctcccgtcgggaaagccgaactggaggatggagcttatcgcattaagcagagaggcatcctcggctactcccaaattggggccggagtgtataaagaaggcacatttcacaccatgtggcatgtcacgagaggggcggtgctgatgcaccgcggaaagagaatcgagccctcctgggctgacgttaaaaaggatcttatcagctacggcgggggatggaagctggagggcgaatggaaagagggcgaagaggtgcaggtcctcgccctggaacctgggaagaacccgcgggccgtgcagaccaaacccggaattttcaagacaaataccggcacaatcggggctgtttccctcgactttagccctggaacctctggctcccccattgtggatagaaaagggaaggtcgtgggactgtacggcaacggcgtggttacacgcagcggggcctatgtctctgcgatcgctcagacggagaagtccattgaggacaaccctgaaatcgaggatgacatcttccggaaaaagagacttaccattatggatctgcatcccggagccggcaaaacaaagcgctacctgcctgccatcgtgcgggaagctattaaaagagggctccgcaccctgatccttgccccgacccgggtggtcgctgccgagatggaagaggcgctgagaggactccccattcgctatcaaacccctgccatccgggctgagcacacgggcagagaaattgtggacctgatgtgtcatgccaccttcacaatgcggctcctgagccccgttcgcgtgcctaattacaaccttatcatcatggacgaggctcactttaccgatcccgcctccattgccgctagagggtatatctctacacgggtcgaaatgggcgaggcggccggaattttcatgaccgctacgccgcctggcagccgcgacccctttccccagtccaatgcccctatcatggatgaggaaagagagattcccgaacggagctggaactctgggcacgagtgggtgacagacttcaagggaaagaccgtttggtttgtgccttccatcaaagccggcaatgatatcgctgcctgcctgagaaagaacgggaaaaaggtcattcagctgagccgcaaaaccttcgactctgaatacgtgaagacacgggcgaatgattgggactttgttgtgaccacagatatcagcgagatgggagctaacttcaaggccgagagagtcattgacccgcgccggtgtatgaaacccgtgatcctcaccgatggcgaagagagagtgattctggccgggcctatgcccgtcacgcattcctctgctgcccaacgccggggcagaatcggacgcaatcctaagaacgaaaatgaccagtatatctacatgggcgagccccttgaaaacgacgaggattgcgcgcactggaaagaggccaagatgctgctcgacaatattaacacaccggaagggatcattcctagcatgtttgagcccgaaagagagaaagttgatgctatcgacggagaataccggctgcgcggcgaggccagaaagaccttcgtggagctgatgcggcgcggggatctccctgtgtggcttgcttataaagtcgccgctgaaggaattaattacgccgacagaaagtggtgttttgatggcatcaagaacaaccagattctggaggaaaatgtggaggttgagatctggacaaaagaaggggagcggaagaaactgaagcccagatggctcgacgcgcgcatctattccgatcctctggcccttaaagagttcaaggagttcgctgccggccggaagtctctgaccctcaacctgattacggaaatgggaagactgcccacctttatgacacagaaagctcgcaatgccctcgacaaccttgccgtgctgcataccgctgaggtcggcgggcgggcgtacaatcacgccctgagcgagctcccggaaacactggagacccttctgctcctgacactgctcgctaccgtgacgggaggcatcttcctttttctgatgtccgggaagggagttggcaaaatgacactgggcatgtgctgcattatcaccgccagcattctcctgtggtatgcccaaatccagcctcactggatcgctgcctctattatccttgagttctttctgattgtgctcctgatccccgagcccgaaaagcagagaacccctcaggataaccaactgacatacgtcgtgattgcgatcctcaccgtcgtggccgctacaatggccaatgagatggggttccttgagaaaacgaagaaggacctgggatttggctccatcaccacacaggaaagcgagtccaacattctggatatcgacctccggccggcttctgcctggaccctgtatgcggttgccacaaccttcattacgcccatgcttcgccatagcatcgaaaattcctctgtgaacgtgagcctgaccgctattgccaatcaggctacagtcctcatggggctgggaaaaggctggcctctgtccaagatggacatcggggttcccctccttgccattggatgttacagccaggtgaaccctatcaccctgacagctgccctgctcctgcttgtggcgcactacgccatcattggccccggcctgcaagctaaagccaccagagaggctcagaagcgggccgccgcggggatcatgaaaaatcctacggtcgatggaattacagtgatcgacctcgaaccgattccctatgatcctaagtttgagaagcagctgggccaggttatgctgctcatcctttgcgtgacccaagtcctgatgatgcgcacaacctgggctctgtgtgaggccctcaccctggctacagggcccatctctacgctttgggaaggaaaccctggcagattctggaataccacaattgccgtgtccatggccaacatctttcgggggagctacctggctggagccggcctcctgttctctattatgaaaaataccacaaacacccgcagaggcacggggaacgtcggagagacactgggcgaaaagtggaaatcccggctcaatgcgcttggaaagagcgagtttcagatctataaaaagtctggcattcaggaggtggaccgcaccctggccaaagaaggcatcaagagaggggagaccgatcatcacgctgttagccggggatccgccaagctgagatggttcgtggaacgcaacatggtcacacccgagggcaaagtggttgacctcggctgcgggcggggaggctggtcttactattgtgggggactgaagaatgtgagagaagtcaaaggccttaccaaagggggaccgggccatgaggagcctatccccatgagcacatacggctggaacctggtgcgcctccaatccggggtggatgttttctttacgccccctgaaaaatgcgacaccctgctgtgtgatattggagagagctcccccaatcctacaatcgaagctggccggaccctcagagtccttaacctggtggagaattggctgaacaataacacacagttctgcattaaggtgctcaatccgtatatgccctctgtcatcgaaaagatggagaccctgcagcgcaaatacgggggagcccttgttcggaaccctctgagcagaaattccacgcacgagatgtactgggtgtctaacgcgaccggcaatattgtgagctccgtcaacatgatctctcgcatgctcatcaaccggtttacaatgaagcacaaaaaggccacctatgaacccgacgtggatctggggagcggaacaagaaatattggcatcgagtccgaaattcctaacctggacatcattggcaaacgcatcgagaagattaagcaggaacatgagaccagctggcactacgatcaagaccatccctataaaacatgggcttaccacgggtcttatgagaccaagcagacgggatccgccagctctatggttaatggcgtggtccggctccttacaaaaccgtgggacgtggttcctatggtgacccagatggctatgaccgatacaacgcccttcgggcagcaaagagtctttaaggaaaaagtggacacccgcacacaggagcctaaggaaggaaccaagaaactgatgaagatcacagccgagtggctgtggaaagagctcggcaaggagaagacacccagaatgtgtacacgggaggagttcacccgcaaggtgagatccaacgctgccctgggggcgatctttacggatgagaataaatggaaaagcgcccgggaagctgtcgaggacggaagattctgggagcttgttgatcgggaacgcaacctgcacctcgagggcaagtgcgaaacctgtgtgtacaatatgatgggcaaaagagagaagaaactgggggaatttggaaaggccaaaggctctcgggctatttggtatatgtggctgggggcccgcttcctcgagtttgaggccctgggattccttaacgaagaccattggttttccagaggcaatagcctgtccggggtggagggcgaaggactccaccggctgggctacatccttcgcgaggtcgggaagaaggaaggaggcgcgatgtacgctgatgacacagccgggtgggataccagaattacactggaggacctcaaaaacgaggaaatggtgaccaatcatatgaagggagagcacaaaaagctggccgaagctatcttcaaactgacgtatcagaacaaggttgtgcgggtccagcgccctacacccagaggcaccgtgatggatattatcagccggaaggaccaacgcgggtctggccaggttggaacatacggcctcaataccttcacgaacatggaggcccagctgatcagacaaatggagggggaaggaatttttaaaagcatccagcatcttaccgctacagaggaaattgccgtgcagaattggctggcgcgggtcggccgcgagagactctcccggatggccatctctggggacgattgcgtggttaagccgattgacgatagattcgctagcgccctgaccgctcttaacgacatgggaaaagtgcgcaaggatatccagcaatgggaaccttcccggggctggaacgactggacacaggtccccttttgctctcaccacttccatgagctggtgatgaaagatgggagagtcctcgtggttccctgtcgcaatcaggacgagctgatcggccgggccagaattagccagggagcgggctggtccctgaaggaaaccgcctgcctcgggaagtcttatgctcaaatgtggacactgatgtactttcaccgccgggatcttagactggccgctaacgccatctgtagcgctgtgccttcccattgggtcccgaccagccgcacgacatggtctattcacgccaaacacgagtggatgaccaccgaagacatgctcgcggtgtggaatcgggtgtggatccaggagaacccctggatggaagataagacacctgttgagtcctgggaggaagtgccctatctgggaaaaagagaggaccagtggtgcggcagccttattgggctgacctctcgcgccacatgggctaagaatatccagacggccattaaccaagtccggtccctcatcggaaatgaagagtacaccgattatatgcctagcatgaaaagattccggagagaagaggaggaagccggcgtgctgtggtga

SEQ ID NO: 19958 - RNA, 9876 nt, synthetic construct
  misc_feature 1..9876: note = derived and/or modified CDS sequence (opt5) from DENV-2__EU726770__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccgttatggcggtggggatggtgagcatcctcgcctcttccctgctcaaaaatgacattcctatgacaggacccctggtcgctggcggccttctgaccgtgtgctatgttctgaccgggcggagcgccgatctcgaactggagcgcgctgccgacgtgaagtgggaggatcaggccgaaatctccggaagctctcctattcttagcatcacaatttccgaggacggctctatgagcatcaaaaacgaagaggaggaacacaccctgacaatcctcattagaacggggctgctcgtcatctccggagtgttccccgtttctattccgatcaccgctgcggcctggtacctgtgggaggtgaagaagcaacgggctggcgtcctttgggatgtgccttctccccctcccgtcgggaaagccgaactggaggacggagcctatcgcattaagcagagaggcatctttggctactcccagatcggggctggagtgtataaagaaggcacattccataccatgtggcacgttacaagaggggccgtgctgatgcatcgcggaaagagaattgagccctcctgggcggatgtcaaaaaggacctcatcagctacggcgggggatggaagctggagggcgaatggaaagagggcgaagaggtgcaggttcttgctctggaacctgggaagaatccgcgggccgtgcaaaccaaacccggactctttaagacgaacaccggcacaattggggccgtctccctggatttcagccctggaacctctggctcccccatcgtggacagaaaagggaaggtggttggactctacggcaatggcgtcgtgacacgcagcggggcttatgtgtctgccattgcgcagaccgagaagtccatcgaggataaccctgaaatcgaggacgatattttccggaaaaagagactgacaatcatggaccttcaccccggagctggcaaaacgaagcgctacctgcctgccattgtccgggaagccatcaaaagagggctgcgcaccctcattctggctccgacacgggtggttgccgctgagatggaagaggcccttagaggactgcccatccgctatcagacccctgcgattcgggccgagcataccggcagagaaatcgtggacctcatgtgtcacgctacatttacgatgcggctgctcagccccgtccgcgtgcctaactacaatctgatcattatggatgaggcccacttcaccgaccccgcttccatcgccgccagagggtatatttctacacgggttgaaatgggcgaggctgcgggaatctttatgaccgccacaccgcctggcagccgcgatcccttcccccagtccaacgctcctattatggacgaggaaagagagatccccgaacggagctggaactctgggcatgagtgggtgaccgattttaagggaaagacggtctggttcgtgccttccatcaaagccggcaacgacattgccgcttgccttagaaagaatgggaaaaaggttatccaactgagccgcaaaacatttgattctgaatacgtgaagacccgggccaacgactgggatttcgtcgtgaccacagacattagcgagatgggagcgaattttagagctgagcgcgtgatcgatccgcggagatgtatgaagcccgtcattctgaccgacggcgaggaacgcgttatcctcgccgggcctatgcccgtgacacactcctctgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaataccccggaagggattatccctagcatgttcgagcccgaacgggagaaggtggacgccattgatggagaataccgcctcagaggcgaggctcggaaaacgtttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacaaaagagggggaacggaagaagctgaaacccagatggctggacgcccgcatttattccgatcctctcgcgctgaaggagttcaaagaatttgccgctggccggaagtctcttaccctgaatctcatcacagagatgggaagactgcccaccttcatgacgcagaaagcccgggacgctctggataacctcgccgtgcttcacaccgccgaagttggcgggcgcgcttacaatcacgcgctgagcgagctgccggagacactcgaaaccctgcttctgctcacactgctggccaccgtgacaggaggcatttttctcttccttatgtccgggaagggaatcggcaagatgaccctgggcatgtgctgcattatcacggctagcatcctgctctggtatgcccagattcagcctcattggatcgccgcttctattatcctggagtttttccttattgtcctgctcatccccgaacccgagaaacaaagaacacctcaggacaaccagctgacctacgtggtcatcgccattctgaccgtggttgcggccacaatggctaatgaaatggggtttctcgagaagaccaaaaaggaccttggactgggctccatcacaacgcaggagagcgaatccaacattctggatatcgacctccggccggcctctgcttggaccctgtatgccgtggcgacaaccttcgtgacacccatgcttcgccacagcattgaaaatagctctgtcaacgttagcctgaccgccatcgctaatcaagccacggtgctcatggggctgggaagaggctggcctctgtccaaaatggatattggggtgcccctccttgctatcggatgttacagccaggtcaaccctatcaccctgacagccgctctgctcctgcttgtggcccattacgcgattatcggccccggcctgcaggccaaggctacccgggaagcccagaagcgcacagctgccgggattatgaaaaatcctaccgttgacggaatcacggtgattgatctcgagccgatcccctatgaccctaagtttgaaaaacaactgggccaggtcatgctgctcgtgctttgcgtcacacaggtgctgatgatgagaaccacatgggccctgtgtgaggcgctcaccctggctaccgggcccatctctacactttgggagggaaaccctggccggttctggaatacgaccattgccgtttccatggctaacatctttcgcgggagctacctggccggagccggcctcctgttctctattatgaagaatacaaccaacacaagacggggcaccgggaatatcggagaaacgctgggcgagaaatggaagtccagactcaacgctcttggaaagagcgaatttcagatttataaaaagtctggaatccaagaggtggatcgcacactggccaaagagggcatcaagagaggggaaaccgaccaccatgcggtcagcagaggatccgccaaactgcgctggttcgtggagcggaacatggttacccccgaaggcaaggtggtcgatctcggctgcgggagaggaggctggtcttactattgtgggggactgaaaaatgtgcgcgaggtgaagggccttacaaaagggggaccgggccacgaggagcctattcccatgagcacctacggctggaacctggttcggctccagtccggggtcgacgtgttctttacaccccctgagaaatgcgatacgctgctgtgtgacatcggagaaagctcccccaatcctaccattgaggctggcagaacactccgcgtgcttaacctggtcgaaaattggctgaacaataacacccagttctgcgttaaggtgctcaatccgtatatgccctctgtgatcgagaaaatggaaacactgcaacggaagtacgggggagcccttgtcagaaaccctctgagccgcaattccacccacgagatgtactgggtgtctaacgctacgggcaatattgttagctccgtgaacatgatctctcggatgctcatcaatagatttaccatgaaacataagaaggccacatatgagcccgatgtcgacctggggagcggaacccgcaacattggcatcgaaaacgagattcctaatctggacatcattggcaaaagaatcgaaaagattaaacaggagcacgaaacatcctggcattacgatcaggaccacccctataagacctgggcgtaccacgggagctatgagacaaaacagaccggatctgcctccagcatggtgaacggcgttgtgaagctccttacgaagccgtgggatgtcgtgcctatggtgacacaaatggctatgaccgacaccacacccttcgggcagcagcgggtctttaaagagaaggttgatacgcgcacccaggaacctaaagagggaacaaagaaactgatgagaatcaccgccgaatggctgtggaaggagctcggcaagaaaaagacaccccggatgtgtaccagagaggagttcacacggaaagtgcgctctaatgctgccctgggggctatctttaccgacgagaacaagtggaaatccgccagagaagcggtggaggatagccggttctgggaacttgtcgaccgcgagagaaatctgcatctcgagggaaagtgcgaaacgtgtgtgtacaacatgatgggcaaacgggagaagaagctgggcgaatttgggaaagccaagggatctcgcgctatttggtatatgtggctgggcgccagattcctcgagtttgaagctctggggttccttaatgaggatcactggttttcccggggaaacagcctgtccggcgttgagggggaaggcctccataaactgggatacatccttcgcgacgtgagcaagaaagagggcgggaccatgtacgccgatgacacagccggatgggacaccagaattacactggaagatctcaagaatgaggaaatggtcaccaaccacatgaagggcgagcataaaaagctggcggaggctatcttcaaactgacgtatcaaaataaggtggttcgggtgcagcgccctacacccagagggaccgtcatggacattatctctcggaaagatcagcgcggaagcggccaggtggggacatacggcctcaacaccttcacgaatatggaagcccaactgatcagacagatggagggagaaggcatttttaagtccatccagcggcttaccgttacagaggagattgccgtgcaaaactggctggctagagtcgggcgcgaacggctctctagaatggccatcagcggagacgattgcgtggtcaagccgctggacgatcgcttcgcttccgcccttaccgcgctgaatgacatgggcaaagtgcggaaggatattcagcagtgggagccttctagagggtggaacgactggacacaggttcccttttgcagccaccacttccatgaactcgtgatgaaagatggacgcgtcctggtggtgccctgtcggaaccaagacgagctgatcggcagagcccgcatctcccagggggctggctggtctctcaaggaaaccgcctgcctgggaaaaagctatgctcagatgtggacacttatgtactttcaccggagagatctgcgcctcgccgcgaatgccatttgttccgctgttcctagccattgggtgccgacctctcggacgacatggtccatccacgccaagcacgagtggatgaccaccgaggacatgctggctgtctggaacagagtgtggattcaggaaaatccctggatggaggacaagacacctgttgaaagctgggaggaagtgccctatcttggcaaacgggaggatcaatggtgcgggtctctgatcggactcacctccagagccacatgggctaagaacattcagacggccatcaatcaggtccgcagcctgattggcaacgaggaatacaccgactatatgccttccatgaaacggttcagaaaggaggaagaggaagcgggggtgctgtggtga

SEQ ID NO: 19959 - RNA, 9876 nt, synthetic construct
  misc_feature 1..9876: note = derived and/or modified CDS sequence (opt5) from DENV-2__EU781135__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccatcatggcggttgggatggtgagcattctcgcctcttccctgctcaaaaatgacatccctatgacaggacccctggtggctggcggccttctgaccgtctgctatgtgctgaccgggcggagcgccgatctcgaactggagcgcgctgccgacgttaagtgggaggatcaggccgaaatttccggaagctctcctatccttagcattacaatctccgaggacggctctatgagcatcaaaaacgaagaggaggaacacaccctgacaattctcatcagaacggggctgctcgtgatttccggagtcttccccgtgtctatcccgattaccgctgcggcctggtacctgtgggaggttaagaagcaacgggctggcgtgctttgggatgtcccttctccccctcccgtggggaaagccgaactggaggacggagcctatcgcatcaagcagagaggcatctttggctactcccagattggggctggagtctataaagaaggcacattccataccatgtggcacgtgacaagaggggccgttctgatgcatcgcggaaagagaatcgagccctcctgggcggatgtgaaaaaggacctcattagctacggcgggggatggaagctggagggcgaatggaaagagggcgaagaggtccaggtgcttgctctggaacctgggaagaatccgcgggccgttcaaaccaaacccggactctttaagacgaacaccggcacaatcggggccgtgtccctggatttcagccctggaacctctggctcccccattgtcgacagaaaagggaaggtggtgggactctacggcaatggcgttgtcacacgcagcggggcttatgtgtctgccatcgcgcagaccgagaagtccatcgaggataaccctgaaattgaggacgatatcttccggaaaaagagactgacaattatggaccttcaccccggagctggcaaaacgaagcgctacctgcctgccatcgtgcgggaagccattaaaagagggctgcgcaccctcatcctggctccgacacgggtcgtggccgctgagatggaagaggcccttagaggactgcccattcgctatcagacccctgcgatccgggccgagcataccggcagagaaatcgttgacctcatgtgtcacgctacatttacgatgcggctgctcagccccgtgcgcgtccctaactacaatctgattatcatggatgaggcccacttcaccgaccccgcttccattgccgccagagggtatatctctacacgggtggaaatgggcgaggctgcgggaatttttatgaccgccacaccgcctggcagccgcgatcccttcccccagtccaacgctcctatcatggacgaggaaagagagatccccgaacggagctggaactctgggcatgagtgggttaccgattttaagggaaagacggtgtggttcgtcccttccattaaagccggcaacgacatcgccgcttgccttagaaagaatgggaaaaaggtgattcaactgagccgcaaaacatttgattctgaatacgttaagacccgggccaacgactgggatttcgtggtcaccacagacatcagcgagatgggagcgaattttagagctgagcgcgtgattgatccgcggagatgtatgaagcccgtgatcctgaccgacggcgaggaacgcgtcatcctcgccgggcctatgcccgttacacactcctctgccgctcagcggagaggccgcattggaagaaaccctaaaaatgaaaacgaccagtatatctacatgggcgagcccctggaaaatgatgaggactgcgcccattggaaggaggcgaaaatgcttctggataacattaataccccggaagggatcattcctagcatgttcgagcccgaacgggagaaggtggacgccatcgatggagaataccgcctcagaggcgaggctcggaaaacgtttgtggacctgatgcgcagaggggatctgcctgtctggctcgcctatcgggtggctgccgagggaattaactacgctgacagacgctggtgtttcgatggcatcaagaataaccaaatccttgaagagaacgttgaagtggagatttggacaaaagagggggaacggaagaagctgaaacccagatggctggacgcccgcatctattccgatcctctcgcgctgaaggagttcaaagaatttgccgctggccggaagtctcttaccctgaatctcattacagagatgggaagactgcccaccttcatgacgcagaaagcccgggacgctctggataacctcgccgtccttcacaccgccgaagtgggcgggcgcgcttacaatcacgcgctgagcgagctgccggagacactcgaaaccctgcttctgctcacactgctggccaccgttacaggaggcatctttctcttccttatgtccgggaagggaattggcaagatgaccctgggcatgtgctgcatcatcacggctagcattctgctctggtatgcccagatccagcctcattggattgccgcttctatcattctggagtttttccttatcgtgctgctcatccccgaacccgagaaacaaagaacacctcaggacaaccagctgacctacgtcgtgattgccatcctgaccgtcgtggcggccacaatggctaatgaaatggggtttctcgagaagaccaaaaaggaccttggactgggctccattacaacgcaggagagcgaatccaacatcctggatattgacctccggccggcctctgcttggaccctgtatgccgttgcgacaaccttcgtgacacccatgcttcgccacagcatcgaaaatagctctgtgaacgtcagcctgaccgccattgctaatcaagccacggttctcatggggctgggaagaggctggcctctgtccaaaatggatatcggggtgcccctccttgctatcggatgttacagccaggtgaaccctattaccctgacagccgctctgctcctgcttgtcgcccattacgcgatcattggccccggcctgcaggccaaggctacccgggaagcccagaagcgcacagctgccgggatcatgaaaaatcctaccgtggacggaattacggttatcgatctcgagccgatcccctatgaccctaagtttgaaaaacaactgggccaggtgatgctgctcgtcctttgcgtgacacaggtcctgatgatgagaaccacatgggccctgtgtgaggcgctcaccctggctaccgggcccatttctacactttgggagggaaaccctggccggttctggaatacgaccatcgccgtgtccatggctaacatttttcgcgggagctacctggccggagccggcctcctgttctctatcatgaagaatacaaccaacacaagacggggcaccgggaatattggagaaacgctgggcgagaaatggaagtccagactcaacgctcttggaaagagcgaatttcagatctataaaaagtctggaatccaagaggttgatcgcacactggccaaagagggcattaagagaggggaaaccgaccaccatgcggtgagcagaggatccgccaaactgcgctggttcgtcgagcggaacatggtgacccccgaaggcaaggttgtggatctcggctgcgggagaggaggctggtcttactattgtgggggactgaaaaatgtccgcgaggtgaagggccttacaaaagggggaccgggccacgaggagcctatccccatgagcacctacggctggaacctggtgcggctccagtccggggttgacgtcttctttacaccccctgagaaatgcgatacgctgctgtgtgacattggagaaagctcccccaatcctaccatcgaggctggcagaacactccgcgtgcttaacctggtggaaaattggctgaacaataacacccagttctgcgtcaaggttctcaatccgtatatgccctctgtgattgagaaaatggaaacactgcaacggaagtacgggggagcccttgtgagaaaccctctgagccgcaattccacccacgagatgtactgggtctctaacgctacgggcaatatcgtgagctccgttaacatgatctctcggatgctcattaatagatttaccatgaaacataagaaggccacatatgagcccgatgtggacctggggagcggaacccgcaacatcggcattgaaaacgagatccctaatctggacattatcggcaaaagaattgaaaagatcaaacaggagcacgaaacatcctggcattacgatcaggaccacccctataagacctgggcgtaccacgggagctatgagacaaaacagaccggatctgcctccagcatggtcaacggcgtggttaagctccttacgaagccgtgggatgtggtccctatggtgacacaaatggctatgaccgacaccacacccttcgggcagcagcgggtgtttaaagagaaggtcgatacgcgcacccaggaacctaaagagggaacaaagaaactgatgagaatcaccgccgaatggctgtggaaggagctcggcaagaaaaagacaccccggatgtgtaccagagaggagttcacacggaaagttcgctctaatgctgccctgggggctatttttaccgacgagaacaagtggaaatccgccagagaagcggtggaggatagccggttctgggaacttgtggaccgcgagagaaatctgcatctcgagggaaagtgcgaaacgtgtgtctacaacatgatgggcaaacgggagaagaagctgggcgaatttgggaaagccaagggatctcgcgctatctggtatatgtggctgggcgccagattcctcgagtttgaagctctggggttccttaatgaggatcactggttttcccggggaaacagcctgtccggcgtggagggggaaggcctccataaactgggatacattcttcgcgacgttagcaagaaagagggcggggccatgtacgccgatgacaccgcgggatgggacacaagaatcaccctggaagatctcaagaatgaggaaatggtgacaaaccacatgaagggcgagcataaaaagctggctgaggccattttcaaactgacctatcaaaataaggtcgtgcgggttcagcgccctacgcccagagggacagtgatggacatcatctctcggaaagatcagcgcggaagcggccaggtcgggacctacggcctcaacacattcaccaatatggaagcccaactgattagacagatggagggagaaggcatctttaagtccattcagcggcttacggtgaccgaggagatcgctgttcaaaactggctggccagagtggggcgcgaacggctctctagaatggctattagcggagacgattgcgtcgtgaagccgctggacgatcgcttcgcctccgcgcttacagccctgaatgacatgggcaaagtccggaaggatatccagcagtgggagccttctagagggtggaacgactggacccaggtgcccttttgcagccaccacttccatgaactcgttatgaaagatggacgcgtgctggtcgtgccctgtcggaaccaagacgagctgatcggcagagctcgcatttcccagggggccggctggtctctcaaggaaacagcttgcctgggaaaaagctatgcccagatgtggacccttatgtactttcaccggagagatctgcgcctcgcggccaatgctatctgttccgccgtgcctagccattgggttccgacatctcggaccacgtggtccattcacgctaagcacgagtggatgacaaccgaggacatgctggccgtgtggaacagagtctggatccaggaaaatccctggatggaggacaagacccctgtggaaagctgggaggaagttccctatcttggcaaacgggaggatcaatggtgcgggtctctgattggactcacatccagagctacctgggccaagaacatccagacagcgattaatcaggtgcgcagcctgatcggcaacgaggaatacacggactatatgccttccatgaaacggttcagaaaggaggaagaggaagccggggtcctgtggtga

SEQ ID NO: 19960 - RNA, 9876 nt, synthetic construct
  misc_feature 1..9876: note = derived and/or modified CDS sequence (opt5) from DENV-2__EU687222__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacggaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgagatcaaatcttgccactggcctaagagccataccctgtggtccaatggggttcttgaaagcgagatgattatccccaaaaacttcgctggaccggtgtctcagcacaactaccgccctggctatcatacgcagacagccgggccctggcacctcggaaagctggaaatggattttgacttctgtgagggcaccaccgtcgtggtgacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgtcaattctctggttaccgccggccatgggcaaatcgataactttagcctgggagtgcttggcatggccctcttcctggaagagatgctgagaacacgcgtggggaccaaacacgctattctcctggtcgcggtgtcctttgttacgcttatcaccggaaatatgtctttccgggacctgggcagagtgatggtcatggtgggcgccacaatgaccgatgacattgggatgggagttacatatctcgctctgctggccgcctttaaggtgcgccctaccttcgctgccggccttctgctcagaaaactgacgagcaaggagctcatgatggcgacaatcgggattgctctgctttcccagtctaccatccccgaaacaatcctggagctcaccgatgccctggccctgggaatgatggtccttaaaattgtgcggaacatggaaaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaagggcctgaatcccacagctatttttctgaccacactttctcgcacctccaaaaagagaagctggccgctgaacgaggccgttatggcggtggggatggtgtctatcctcgcctccagcctgctcaaaaatgacattcctatgacgggacccctggtcgctggcggccttctgacagtgtgctatgttctgaccgggcggtccgccgatctcgaactggagcgcgctgccgacgtgaagtgggaggatcaggccgaaatcagcggatctagccctattctttccatcaccatttctgaggacggcagcatgtccatcaaaaacgaagaggaggaacacacactgaccatcctcattagaacagggctgctcgtcatctctggagtgttccccgttagcattccgatcacggctgcggcctggtacctgtgggaggtgaagaagcaacgggctggcgtcctttgggatgtgccttctccccctcccgtcgggaaagccgaactggaggacggagcctatcgcattaagcagagaggcatctttggctacagccagatcggggctggagtgtataaagaaggcaccttccatacaatgtggcacgttaccagaggggccgtgctgatgcatcgcggaaagagaattgagcccagctgggcggatgtcaaaaaggacctcatctcctacggcgggggatggaagctggagggcgaatggaaagagggcgaagaggtgcaggttcttgctctggaacctgggaagaatccgcgggccgtgcaaacaaaacccggactctttaagaccaacacgggcaccattggggccgtcagcctggatttctctcctggaacatccggcagccccatcgtggacagaaaagggaaggtggttggactctacggcaatggcgtcgtgacccgctctggggcttatgtgtccgccattgcgcagacagaaaagagcatcgaggataaccctgaaatcgaggacgatattttccggaaaaagagactgaccatcatggaccttcaccccggagctggcaaaacaaagcgctacctgcctgccattgtccgggaagccatcaaaagagggctgcgcacgctcattctggctccgacccgggtggttgccgctgagatggaagaggcccttagaggactgcccatccgctatcagacccctgcgattcgggccgagcataccggcagagaaatcgtggacctcatgtgtcacgctacctttacaatgcggctgctctcccccgtccgcgtgcctaactacaatctgatcattatggatgaggcccacttcacggaccccgcttctatcgccgccagagggtatattagcacccgggttgaaatgggcgaggctgcgggaatctttatgacagccaccccgcctggctcccgcgatcccttcccccagagcaacgctcctattatggacgaggaaagagagatccccgaacggtcttggaactccgggcatgagtgggtgacagattttaagggaaagaccgtctggttcgtgcctagcatcaaagccggcaacgacattgccgcttgccttagaaagaatgggaaaaaggttatccaactgtctcgcaaaacgtttgatagcgaatacgtgaagacacgggccaacgactgggatttcgtcgtgaccaccgacatttccgagatgggagcgaattttagagctgagcgcgtgatcgatccgcggagatgtatgaagcccgtcattctgacagacggcgaggaacgcgttatcctcgccgggcctatgcccgtgacccactctagcgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaatacaccggaagggattatcccttccatgttcgagcccgaacgggagaaggtggacgccattgatggagaataccgcctcagaggcgaggctcggaaaacctttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacgaaagagggggaacggaagaagctgaaacccagatggctggacgcccgcatttattctgatcctctcgcgctgaaggagttcaaagaatttgccgctggccggaagtcccttacactgaatctcatcaccgagatgggaagactgcccacattcatgacccagaaagcccgggacgctctggataacctcgccgtgcttcacacggccgaagttggcgggcgcgcttacaatcacgcgctgtccgagctgccggagaccctcgaaacactgcttctgctcaccctgctggccacagtgaccggaggcatttttctcttccttatgagcgggaagggaatcggcaagatgacactgggcatgtgctgcattatcaccgcttctatcctgctctggtatgcccagattcagcctcattggatcgccgcttccattatcctggagtttttccttattgtcctgctcatccccgaacccgagaaacaaagaacgcctcaggacaaccagctgacatacgtggtcatcgccattctgaccgtggttgcggccaccatggctaatgaaatggggtttctcgagaagaccaagaaggaccttggactgggcagcatcaccacacaggagtccgaatctaacattctggatatcgacctccggccggccagcgcttggacgctgtatgccgtggcgaccacattcgtgacccccatgcttcgccactccattgaaaattctagcgtcaacgtttccctgacagccatcgctaatcaagccaccgtgctcatggggctgggaagaggctggcctctgagcaaaatggatattggggtgcccctccttgctatcggatgttactctcaggtcaaccctatcacgctgaccgccgctctgctcctgcttgtggcccattacgcgattatcggccccggcctgcaggccaaggctacacgggaagcccagaagcgcaccgctgccgggattatgaaaaatcctacagttgacggaatcaccgtgattgatctcgagccgatcccctatgaccctaagtttgaaaaacaactgggccaggtcatgctgctcgtgctttgcgtcacacaggtgctgatgatgagaacaacctgggccctgtgtgaggcgctcacactggctaccgggcccatctccaccctttgggagggaaaccctggccggttctggaatacaacgattgccgttagcatggctaacatctttcgcgggtcttacctggccggagccggcctcctgttctccattatgaagaataccacaaacaccagacggggcacagggaatatcggagaaaccctgggcgagaaatggaaaagcagactcaacgctcttgggaagtctgaatttcagatttataaaaagagcggaatccaagaggtggatcgcacgctggccaaagagggcatcaagagaggggaaacagaccaccatgcggtctccagaggatctgccaaactgcgctggttcgtggagcggaacatggttacccccgaaggcaaggtggtcgatctcggctgcgggagaggaggctggagctactattgtgggggactgaaaaatgtgcgcgaggtgaagggccttaccaaagggggaccgggccacgaggagcctattcccatgtccacatacggctggaacctggttcggctccagagcggggtcgacgtgttctttacaccccctgagaaatgcgatacactgctgtgtgacatcggagaatcctctcccaatcctacgattgaggctggcagaaccctccgcgtgcttaacctggtcgaaaattggctgaacaataacacacagttctgcatcaaggttctcaatccgtatatgcccagcgtgattgagaaaatggaaaccctgcaacggaagtacgggggagcccttgtgagaaaccctctgtcccgcaattctacacacgagatgtactgggtcagcaacgctaccggcaatatcgtgtcctctgttaacatgatcagccggatgctcattaatagatttacgatgaaacataagaaggccacctatgagcccgatgtggacctggggtccggaacacgcaacatcggcattgaaaacgagatccctaatctggacattatcggcaaaagaattgaaaagatcaaacaggagcacgaaaccagctggcattacgatcaggaccacccctataagacatgggcgtaccacgggtcttatgagaccaaacagacaggatccgccagctctatggtcaacggcgtggttaagctccttaccaagccgtgggatgtggtccctatggtgacgcaaatggctatgacagacaccacccccttcgggcagcagcgggtgtttaaagagaaggtcgatacacgcacgcaggaacctaaagagggaaccaagaaactgatgagaatcacagccgaatggctgtggaaggagctcggcaagaaaaagacaccccggatgtgtacaagagaggagttcacccggaaagttcgctccaatgctgccctgggggctatttttacagacgagaacaagtggaaaagcgccagagaagcggtggaggattctcggttctgggaacttgtggaccgcgagagaaatctgcatctcgagggaaagtgcgaaacctgtgtctacaacatgatgggcaaacgggagaagaagctgggcgaatttgggaaagccaagggatcccgcgctatctggtatatgtggctgggcgccagattcctcgagtttgaagctctggggttccttaatgaggatcactggtttagccggggaaactccctgagcggcgtggagggggaaggcctccataaactgggatacattcttcgcgacgtttctaagaaagagggcggggccatgtacgccgatgacacggcgggatgggacaccagaatcacactggaagatctcaagaatgaggaaatggtgaccaaccacatgaagggcgagcataaaaagctggctgaggccattttcaaactgacatatcaaaataaggtcgtgcgggttcagcgccctacccccagagggacggtgatggacatcatcagccggaaagatcagcgcggatccggccaggtcgggacatacggcctcaacaccttcacaaatatggaagcccaactgattagacagatggagggagaaggcatctttaagtctattcagcggcttaccgtgacggaggagatcgctgttcaaaactggctggccagagtggggcgcgaacggctcagcagaatggctatttccggagacgattgcgtcgtgaagccgctggacgatcgcttcgcctctgcgcttaccgccctgaatgacatgggcaaagtccggaaggatatccagcagtgggagcctagcagagggtggaacgactggacacaggtgcccttttgctcccaccacttccatgaactcgttatgaaagatggacgcgtgctggtcgtgccctgtcggaaccaagacgagctgatcggcagagctcgcatttctcagggggccggctggagcctcaaggaaaccgcttgcctgggaaaatcctatgcccagatgtggacacttatgtactttcaccggagagatctgcgcctcgcggccaatgctatctgtagcgccgtgccttctcattgggttccgacctcccggacaacctggagcattcacgctaagcacgagtggatgacgacagaggacatgctggccgtgtggaacagagtctggatccaggaaaatccctggatggaggacaagacccctgtggaatcttgggaggaagttccctatcttggcaaacgggaggatcaatggtgcgggtccctgattggactcaccagcagagctacatgggccaagaacatccagaccgcgattaatcaggtgcgctccctgatcggcaacgaggaatacacagactatatgccttctatgaaacggttcagaaaggaggaagaggaagccggggtcctgtggtga

SEQ ID NO: 19961 - RNA, 9876 nt, synthetic construct
  misc_feature 1..9876: note = derived and/or modified CDS sequence (opt5) from DENV-2__EU687223__SS-prME
  source 1..9876: mol_type = other RNA
accgccggagtgatcattatgctgatccccaccgctatggccttccacctcacgaccagaaatggggaacctcatatgattgtgggacggcaggaaaagggcaaaagcctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagggaaggacagcccggtgaacatcgaagccgagcccccttttggcgattcttacattatcatcggagtcgaacccggccagctgaaacttaattggttcaagaaggggtccagcattggacagatgtttgagaccacaatgagaggcgctaaacgcatggccatcctgggggacaccgcctgggatttcggatctctcggcggggtgtttacgagcattggcaaggctctgcaccaagttttcggagccatctacggcgcggctttttccggggtgtcttggacaatgaaaattctgatcggagtcatcattacctggatcggcatgaacagccggtccaccagcctttctgtgtccctcgtgctggttggggtcgtgacactgtatctcggagtgatggtccaggccgacagcggctgtgtggtttcttggaagaataaagagctgaagtgcgggtccggcattttcatcaccgataacgtgcacacatggacggaacagtacaagtttcagcctgagagcccctccaaacttgcctctgctattcaaaaggcccatgaagagggaatctgtggcatcagaagcgtcacccgcctggaaaatctcatgtggaaacagattacaccggagctgaaccacatcctgtccgagaatgaagtgaaacttaccattatgacaggggacatcaaaggaattatgcaggctggcaagcggtctctcagacctcagcccaccgagctgaaatatagctggaagacgtgggggaaggccaaaatgctgtccaccgaaagccataaccaaacattcctcatcgatggacctgagaccgcggaatgccccaatacaaaccgcgcctggaactctctggaggttgaggactacggctttggcgtgttctccaccaacatctggcttaagctgcgggaaaaacaggacgtcttttgtgatagcaagctcatgtctgctgccattaaagacaatagagctgtgcacgccgatatggggtattggatcgagtccgcgctgaacgacacatggaagatggaaaaggccagcttcattgagatcaaatcttgccactggcctaagagccataccctgtggtccaatggagttcttgagagcgaaatgattatccccaaaaacttcgctggcccggtgtctcagcacaactaccgccctgggtatcatacgcagacagccggaccctggcacctcggcaagctggagatggattttgacttctgtgaagggaccaccgtcgtggtgacagaggattgcggaaatcggggcccctccctgagaaccacgacagctagcggcaaactcattaccgaatggtgctgtcggtcctgcacactgcctccgcttcgctacagaggggaggacggatgttggtacggcatggagatccggcccctgaaggaaaaggaggaaaacctcgtcaattctctggttaccgccgggcatggacaaatcgataactttagcctgggcgtgcttgggatggccctcttcctggaggaaatgctgagaacacgcgtgggaaccaaacacgctattctcctggtcgcggtgtcctttgttacgcttatcaccggcaatatgtctttccgggacctgggcagagtgatggtcatggtgggggccacaatgaccgatgacattggaatgggcgttacatatctcgctctgctggccgcctttaaggtgcgccctaccttcgctgccgggcttctgctcagaaaactgacgagcaaggagctcatgatggcgacaatcggaattgctctgctttcccagtctaccatccccgagacaatcctggaactcaccgatgccctggccctgggcatgatggtccttaaaattgtgcggaacatggagaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaaggggctgaatcccacagctatttttctgaccacactttctcgcacctccaaaaagagaagctggccgctgaacgaagccgttatggcggtgggaatggtgtctatcctcgcctccagcctgctcaaaaatgacattcctatgacgggccccctggtcgctggcgggcttctgacagtgtgctatgttctgaccggacggtccgccgatctcgagctggaacgcgctgccgacgtgaagtgggaggatcaggccgagatcagcggctctagccctattctttccatcaccatttctgaagacgggagcatgtccatcaaaaacgaggaagaggagcacacactgaccatcctcattagaacaggactgctcgtcatctctggcgctttccccgtgagcattccgatcacggcggccgcttggtacctgtgggaagttaagaagcaacgggccggggtgctttgggatgtcccttctccccctcccgtgggaaaagccgagctggaagacggcgcttatcgcattaagcagagaggcatctttgggtacagccagatcggagccggcgtctataaagaggggaccttccatacaatgtggcacgtgacccggggagcggttctgatgcatcgcggcaagagaattgaacccagctgggctgatgtgaaaaaggacctcatctcctacgggggaggctggaagctggagggcgagtggaaagaaggggaggaagtccaggtgcttgccctggagcctggaaagaatccgcgggccgttcaaacaaaacccggcctctttaagaccaacacggggaccattggagctgtgagcctggatttctctcctggcacatccgggagccccatcgtcgacagaaaaggaaaggtggtgggcctctacggcaatggggttgtcacccgctctggagcctatgtgtccgcgattgctcagacagaaaagagcatcgaggataaccctgagatcgaagacgatattttccggaaaaagagactgaccatcatggaccttcaccccggcgccgggaaaacaaagcgctacctgcctgccattgtgcgggaggctatcaaaagaggactgcgcacgctcattctggccccgacccgggtcgtggctgccgaaatggaggaagcgcttagaggcctgcccatccgctatcagacccctgccattcgggctgagcataccgggagagagatcgttgacctcatgtgtcacgccacctttacaatgcggctgctctcccccgtgcgcgtccctaactacaatctgatcattatggatgaagctcacttcacggaccccgcctctatcgccgctagaggctatattagcacccgggtggagatgggagaagcggccggcatctttatgacagctaccccgcctgggtcccgcgatcccttcccccagagcaacgcccctattatggacgaggagagagaaatccccgagcggtcttggaactccggacatgaatgggttacagattttaagggcaagaccgtgtggttcgtccctagcatcaaagccgggaacgacattgctgcctgccttagaaagaatggcaagaaggtgatccaactgtctcgcaaaacgtttgatagcgagtacgttaagacacgggcgaacgactgggatttcgtggtcaccaccgacatttccgaaatgggcgctaattttagagccgagcgcgtgatcgatccgcggagatgtatgaagcccgtgattctgacagacggggaggaacgcgtcatcctcgccggccctatgcccgttacccactctagcgctgcccagcggagaggacgcatcggcagaaaccctaaaaatgagaacgaccagtatatttacatgggggaacccctggagaatgatgaagactgcgcgcattggaaggaggccaaaatgcttctggataacatcaatacaccggagggaattatcccttccatgttcgaacccgagcgggaaaaggtggacgctattgatggcgagtaccgcctcagaggggaagcccggaaaacctttgtggacctgatgcgcagaggagatctgcctgtctggctcgcttatcgggtggccgctgagggcatcaactacgccgacagacgctggtgtttcgatgggattaagaataaccaaatccttgaggaaaacgttgaggtggaaatctggacgaaagagggcgagcggaagaagctgaaacccagatggctggacgcgcgcatttattctgatcctctcgccctgaaggagttcaaagagtttgctgccggaagaaagagccttacactgaatctcatcaccgaaatgggccggctgcccacattcatgacccagaaagctcgggacgccctggataacctcgccgtccttcacacggctgaggtcggcgggcgcgcgtacaatcacgccctgtccgaactgccggagaccctcgagacactgcttctgctcaccctgctggctacagttaccggagggatttttctcttccttatgagcgggaagggcatcggcaagatgacactggggatgtgctgcattatcaccgcctctatcctgctctggtatgcccagattcagcctcattggatcgctgcctccattatcctggaatttttccttattgtgctgctcatccccgagcccgaaaaacaaagaacgcctcaggacaaccagctgacatacgtcgtgatcgcgattctgaccgtcgtggccgctaccatggccaatgagatgggatttctcgaaaagaccaaaaaggaccttggcctggggagcatcaccacacaggagtccgagtctaacattctggatatcgacctccggccggctagcgcctggacgctgtatgcggttgccaccacattcgtgacccccatgcttcgccactccattgaaaattctagcgtgaacgtctccctgacagctatcgccaatcaagctaccgttctcatgggactgggcagagggtggcctctgagcaaaatggatattggagtgcccctccttgccatcggctgttactctcaggtgaaccctatcacgctgaccgctgccctgctcctgcttgtcgcgcattacgccattatcggccccgggctgcaggctaaggccacacgggaggctcagaagcgcaccgccgccggaattatgaaaaatcctacagtggacggcatcaccgttattgatctcgaaccgatcccctatgaccctaagtttgagaaacaactgggacaggtgatgctgctcgtcctttgcgtgacgcaggtcctgatgatgagaacaacctgggcgctgtgtgaagctctcacactggccaccggacccatctccaccctttgggagggcaaccctgggcggttctggaatacaacgattgctgtgagcatggccaacatctttcgcggatcttacctggccggcgctggcctcctgttctccattatgaagaataccacaaacaccagacgggggacaggaaatatcggcgagaccctgggggaaaaatggaagtccagactcaacgcccttggaaagtctgagtttcagatttataaaaagagcggcatccaagaagttgatcgcacgctggcgaaagaggggatcaagcggggagagacagaccaccatgccgtgtccagaggctctgctaaactgcgctggttcgtcgaacggaacatggtgacccccgagggcaaggttgtggatctcgggtgcggaagaggcgggtggagctactattgtggaggcctgaaaaatgtccgcgaagtgaaggggcttaccaagggaggcccgggccacgaggaacctattcccatgtccacatacgggtggaacctggtgcggctccagagcggagttgacgtcttctttacaccccctgagaaatgcgatacactgctgtgtgacatcggcgagtcctctcccaatcctacgattgaagccgggagaaccctccgcgtgcttaacctggtggagaattggctgaacaataacacacagttctgcatcaaggtcctcaatccgtatatgcccagcgttattgagaaaatggagaccctgcaacggaagtacggaggcgctcttgtgagaaaccctctgtcccgcaattctacacacgaaatgtactgggtgagcaacgccaccgggaatatcgtctcctctgtgaacatgatcagccggatgctcattaatagatttacgatgaaacataagaaggcgacctatgagcccgatgttgacctgggatccggcacacgcaacatcggcattgagaacgaaatccctaatctggacattatcgggaaaagaattgagaagatcaaacaggaacacgagaccagctggcattacgatcaggaccacccctataagacatgggcctaccacggatcttatgaaaccaaacagacaggctccgctagctctatggtgaacggggtcgtgaagctccttaccaagccgtgggatgttgtgcctatggtcacgcaaatggccatgacagacaccacccccttcggacagcagcgggtgtttaaagagaaggtggatacacgcacgcaggagcctaaagaaggcaccaagaaactgatgagaatcacagctgagtggctgtggaaggaactcgggaagaaaaagacaccccggatgtgtacaagagaggagttcacccggaaagtccgctccaatgccgctctgggagccatttttacagacgaaaacaagtggaaaagcgcgagagaggccgttgaagattctcggttctgggagcttgtggaccgcgaaagaaatctgcatctcgagggcaagtgcgagacctgtgtgtacaacatgatgggcaaacgggaaaagaagctgggggagtttggaaaagctaagggctcccgcgccatctggtatatgtggctgggggctagattcctcgaatttgaggccctgggattccttaatgaagatcactggtttagccggggcaactccctgagcggggtcgagggcgagggactccataaactgggctacattcttcgcgacgtgtctaagaaagaagggggagccatgtacgcggatgacacggctggctgggacaccagaatcacactggaggatctcaagaatgaagagatggttaccaaccacatgaagggggaacataaaaagctggccgaggccattttcaaactgacatatcaaaataaggtggtccgggtgcagcgccctacccccagaggaacggttatggacatcatcagccggaaagatcagcgcggctccggacaggtgggcacatacggactcaacaccttcacaaatatggaggctcaactgattagacagatggaaggcgaggggatctttaagtctattcagcggcttaccgtcacggaagagatcgccgtgcaaaactggctggctagagttggacgcgagcggctcagcagaatggccatttccggcgacgattgcgtggtcaagccgctggacgatcgcttcgcgtctgcccttaccgctctgaatgacatggggaaagtgcggaaggatatccagcagtgggaacctagcagaggatggaacgactggacacaggtccccttttgctcccaccacttccatgagctcgtgatgaaagatggccgcgttctggtggtcccctgtcggaaccaagacgaactgatcgggagagcccgcatttctcagggcgctggatggagcctcaaggagaccgcctgcctgggcaaatcctatgcgcagatgtggacacttatgtactttcaccggagagatctgcgcctcgccgctaatgccatctgtagcgctgtgccttctcattgggtgccgacctcccggacaacctggagcattcacgccaagcacgaatggatgacgacagaggacatgctggctgtttggaacagagtgtggatccaggagaatccctggatggaagacaagacccctgtcgagtcttgggaagaggtgccctatcttgggaaacgggaagatcaatggtgcggatccctgattggcctcaccagcagagccacatgggcgaagaacatccagaccgccattaatcaggttcgctccctgatcgggaacgaggagtacacagactatatgccttctatgaaacggttcagaaaggaagaggaagaggctggagtgctgtggtga

SEQ ID NO: 19962 - RNA, 9876 nt, synthetic construct
  misc_feature 1..9876: note = derived and/or modified CDS sequence (opt5) from DENV-2__EU687227__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacggaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgagatcaaatcttgccactggcctaagagccataccctgtggtccaatggggttcttgaaagcgagatgattatccccaaaaacttcgctggaccggtgtctcagcacaactaccgccctggctatcatacgcagacagccgggccctggcacctcggaaagctggaaatggattttgacttctgtgagggcaccaccgtcgtggtgacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgtcaattctctggttaccgccggccatgggcaaatcgataactttagcctgggagtgcttggcatggccctcttcctggaagagatgctgagaacacgcgtggggaccaaacacgctattctcctggtcgcggtgtcctttgttacgcttatcaccggaaatatgtctttccgggacctgggcagagtgatggtcatggtgggcgccacaatgaccgatgacattgggatgggagttacatatctcgctctgctggccgcctttaaggtgcgccctaccttcgctgccggccttctgctcagaaaactgacgagcaaggagctcatgatggcgacaatcgggattgctctgctttcccagtctaccatccccgaaacaatcctggagctcaccgatgccctggccctgggaatgatggtccttaaaattgtgcggaacatggaaaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaagggcctgaatcccacagctatttttctgaccacactttctcgcacctccaaaaagagaagctggccgctgaacgaggccgttatggcggtggggatggtgtctatcctcgcctccagcctgctcaaaaatgacattcctatgacgggacccctggtcgctggcggccttctgacagtgtgctatgttctgaccgggcggtccgccgatctcgaactggagcgcgctgccgacgtgaagtgggaggatcaggccgaaatcagcggatctagccctattctttccatcaccatttctgaggacggcagcatgtccatcaaaaacgaagaggaggaacacacactgaccatcctcattagaacagggctgctcgtcatctctggagtgttccccgttagcattccgatcacggctgcggcctggtacctgtgggaggtgaagaagcaacgggctggcgtcctttgggatgtgccttctccccctcccgtcgggaaagccgaactggaggacggagcctatcgcattaagcagagaggcatctttggctacagccagatcggggctggagtgtataaagaaggcaccttccatacaatgtggcacgttaccagaggggccgtgctgatgcatcgcggaaagagaattgagcccagctgggcggatgtcaaaaaggacctcatctcctacggcgggggatggaagctggagggcgaatggaaagagggcgaagaggtgcaggttcttgctctggaacctgggaagaatccgcgggccgtgcaaacaaaacccggactctttaagaccaacacgggcaccattggggccgtcagcctggatttctctcctggaacatccggcagccccatcgtggacagaaaagggaaggtggttggactctacggcaatggcgtcgtgacccgctctggggcttatgtgtccgccattgcgcagacagaaaagagcatcgaggataaccctgaaatcgaggacgatattttccggaaaaagagactgaccatcatggaccttcaccccggagctggcaaaacaaagcgctacctgcctgccattgtccgggaagccatcaaaagagggctgcgcacgctcattctggctccgacccgggtggttgccgctgagatggaagaggcccttagaggactgcccatccgctatcagacccctgcgattcgggccgagcataccggcagagaaatcgtggacctcatgtgtcacgctacctttacaatgcggctgctctcccccgtccgcgtgcctaactacaatctgatcattatggatgaggcccacttcacggaccccgcttctatcgccgccagagggtatattagcacccgggttgaaatgggcgaggctgcgggaatctttatgacagccaccccgcctggctcccgcgatcccttcccccagagcaacgctcctattatggacgaggaaagagagatccccgaacggtcttggaactccgggcatgagtgggtgacagattttaagggaaagaccgtctggttcgtgcctagcatcaaagccggcaacgacattgccgcttgccttagaaagaatgggaaaaaggttatccaactgtctcgcaaaacgtttgatagcgaatacgtgaagacacgggccaacgactgggatttcgtcgtgaccaccgacatttccgagatgggagcgaattttagagctgagcgcgtgatcgatccgcggagatgtatgaagcccgtcattctgacagacggcgaggaacgcgttatcctcgccgggcctatgcccgtgacccactctagcgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaatacaccggaagggattatcccttccatgttcgagcccgaacgggagaaggtggacgccattgatggagaataccgcctcagaggcgaggctcggaaaacctttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacgaaagagggggaacggaagaagctgaaacccagatggctggacgcccgcatttattctgatcctctcgcgctgaaggagttcaaagaatttgccgctggccggaagtcccttacactgaatctcatcaccgagatgggaagactgcccacattcatgacccagaaagcccgggacgctctggataacctcgccgtgcttcacacggccgaagttggcgggcgcgcttacaatcacgcgctgtccgagctgccggagaccctcgaaacactgcttctgctcaccctgctggccacagtgaccggaggcatttttctcttccttatgagcgggaagggaatcggcaagatgacactgggcatgtgctgcattatcaccgcttctatcctgctctggtatgcccagattcagcctcattggatcgccgcttccattatcctggagtttttccttattgtcctgctcatccccgaacccgagaaacaaagaacgcctcaggacaaccagctgacatacgtggtcatcgccattctgaccgtggttgcggccaccatggctaatgaaatggggtttctcgagaagaccaagaaggaccttggactgggcagcatcaccacacaggagtccgaatctaacattctggatatcgacctccggccggccagcgcttggacgctgtatgccgtggcgaccacattcgtgacccccatgcttcgccactccattgaaaattctagcgtcaacgtttccctgacagccatcgctaatcaagccaccgtgctcatggggctgggaagaggctggcctctgagcaaaatggatattggggtgcccctccttgctatcggatgttactctcaggtcaaccctatcacgctgaccgccgctctgctcctgcttgtggcccattacgcgattatcggccccggcctgcaggccaaggctacacgggaagcccagaagcgcaccgctgccgggattatgaaaaatcctacagttgacggaatcaccgtgattgatctcgagccgatcccctatgaccctaagtttgaaaaacaactgggccaggtcatgctgctcgtgctttgcgtcacacaggtgctgatgatgagaacaacctgggccctgtgtgaggcgctcacactggctaccgggcccatctccaccctttgggagggaaaccctggccggttctggaatacaacgattgccgttagcatggctaacatctttcgcgggtcttacctggccggagccggcctcctgttctccattatgaagaataccacaaacaccagacggggcacagggaatatcggagaaaccctgggcgagaaatggaaaagcagactcaacgctcttgggaagtctgaatttcagatttataaaaagagcggaatccaagaggtggatcgcacgctggccaaagagggcatcaagagaggggaaacagaccaccatgcggtctccagaggatctgccaaactgcgctggttcgtggagcggaacatggttacccccgaaggcaaggtggtcgatctcggctgcgggagaggaggctggagctactattgtgggggactgaaaaatgtgcgcgaggtgaagggccttaccaaagggggaccgggccacgaggagcctattcccatgtccacatacggctggaacctggttcggctccagagcggggtcgacgtgttctttacaccccctgagaaatgcgatacactgctgtgtgacatcggagaatcctctcccaatcctacgattgaggctggcagaaccctccgcgtgcttaacctggtcgaaaattggctgaacaataacacacagttctgcatcaaggttctcaatccgtatatgcccagcgtgattgagaaaatggaaaccctgcaacggaagtacgggggagcccttgtgagaaaccctctgtcccgcaattctacacacgagatgtactgggtcagcaacgctaccggcaatatcgtgtcctctgttaacatgatcagccggatgctcattaatagatttacgatgaaacataagaaggccacctatgagcccgatgtggacctggggtccggaacacgcaacatcggcattgaaaacgagatccctaatctggacattatcggcaaaagaattgaaaagatcaaacaggagcacgaaaccagctggcattacgatcaggaccacccctataagacatgggcgtaccacgggtcttatgagaccaaacagacaggatccgccagctctatggtcaacggcgtggttaagctccttaccaagccgtgggatgtggtccctatggtgacgcaaatggctatgacagacaccacccccttcgggcagcagcgggtgtttaaagagaaggtcgatacacgcacgcaggaacctaaagagggaaccaagaaactgatgagaatcacagccgaatggctgtggaaggagctcggcaagaaaaagacaccccggatgtgtacaagagaggagttcacccggaaagttcgctccaatgctgccctgggggctatttttacagacgagaacaagtggaaaagcgccagagaagcggtggaggattctcggttctgggaacttgtggaccgcgagagaaatctgcatctcgagggaaagtgcgaaacctgtgtctacaacatgatgggcaaacgggagaagaagctgggcgaatttgggaaagccaagggatcccgcgctatctggtatatgtggctgggcgccagattcctcgagtttgaagctctggggttccttaatgaggatcactggtttagccggggaaactccctgagcggcgtggagggggaaggcctccataaactgggatacattcttcgcgacgtttctaagaaagagggcggggccatgtacgccgatgacacggcgggatgggacaccagaatcacactggaagatctcaagaatgaggaaatggtgaccaaccaaatgaagggcgagcacaaaaagctggctgaggccattttcaaactgacatatcagaataaggtcgtgcgggttcagcgccctacccccagagggacggtgatggacatcatcagccggaaagatcagcgcggatccggccaagtcgggacatacggcctcaacaccttcacaaatatggaagcccagctgattagacagatggagggagaaggcatctttaagtctattcaacggcttaccgtgacggaggagatcgctgttcagaactggctggccagagtggggcgcgaacggctcagcagaatggctatttccggagacgattgcgtcgtgaagccgctggacgatcgcttcgcctctgcgcttaccgccctgaatgacatgggcaaagtccggaaggatatccagcagtgggagcctagcagagggtggaacgactggacacaagtgcccttttgctcccatcacttccacgaactcgttatgaaagatggacgcgtgctggtcgtgccctgtcggaaccaggacgagctgatcggcagagctcgcatttctcagggggccggctggagcctcaaggaaaccgcttgcctgggaaaatcctatgcccagatgtggacacttatgtactttcatcggagagatctgcgcctcgcggccaatgctatctgtagcgccgtgccttctcactgggttccgacctcccggacaacctggagcattcatgctaagcacgagtggatgacgacagaggacatgctggccgtgtggaacagagtctggatccaagaaaatccctggatggaggacaagacccctgtggaatcttgggaggaagttccctatcttggcaaacgggaggatcagtggtgcgggtccctgattggactcaccagcagagctacatgggccaagaacatccagaccgcgattaatcaggtgcgctccctgatcggcaacgaggaatacacagactatatgccttctatgaaacggttcagaaaggaggaagaggaagccggggtcctgtggtga

SEQ ID NO: 19963 - RNA, 9876 nt, synthetic construct
  misc_feature 1..9876: note = derived and/or modified CDS sequence (opt5) from DENV-2__EU687228__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagacggaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaacgaaatcaaaattacacctcagtcttccatcaccgaggccgaacttacggggtatggaaccgtcacaatggagtgtagcccccggaccggcctggatttcaatgaaatggtgctcctgcagatggaggacaaggcttggcttgttcaccgccaatggtttctggatctcccgctgccttggctgcccggggccgacacacagggatctaactggattcagaaagagaccctcgtgacgttcaagaatcctcatgctaagaaacaggacgtcgtggttctgggctcccaagaaggggccatgcacacagcccttaccggcgctacagagatccagatgagctccggaaacctgctctttaccggccatctgaagtgcagacttcggatggataaactgcagctcaaggggatgtcttacagcatgtgtaccggaaaattcaagattgtgaaggaaatcgcggagacacaacacggcacgatcgtcattagagtgcagtatgagggggacggatccccctgcaaaatccccttcgaaattatggatctggagaagcgccatgtcctgggccggctcatcaccgtgaaccctattgttacagaaaaagacagcccggtgaatatcgaggccgaacccccttttggggattcttacattatcatcggcgtcgagcccggacagctgaaacttaactggttcaaaaagggctccagcattgggcagatgtttgagaccacaatgagaggagctaagcgcatggccatcctgggcgacaccgcctgggatttcgggtctctcggaggcgtgtttacgagcattgggaaagctctgcaccaagttttcggcgccatctacggagcggctttttccggcgtgtcttggacaatgaagattctgatcggggtcatcattacctggatcggaatgaatagccggtccaccagcctttctgtgtccctcgtgctggttggcgtcgtgacactgtatctcggggtgatggtccaggccgacagcggatgtgtggtttcttggaaaaacaaggaactgaaatgcggctccgggattttcatcaccgataatgtgcacacatggacggagcagtacaagtttcagcctgaaagcccctccaaacttgcctctgctattcaaaaagcccatgaggaaggcatctgtggaatcagaagcgtcacccgcctggagaacctcatgtggaagcagattacaccggagctgaatcacatcctgtccgaaaacgaggtgaaacttaccattatgacaggcgacatcaaggggattatgcaggctggaaaacggtctctcagacctcagcccaccgaactgaagtatagctggaaaacgtggggcaaggccaagatgctgtccaccgagagccataatcaaacattcctcatcgatgggcctgaaaccgcggagtgccccaacacaaatcgcgcctggaactctctggaggttgaagactacggatttggcgtgttctccaccaatatctggcttaaactgcgggagaagcaggacgtcttttgtgatagcaaactcatgtctgctgccattaaggacaacagagctgtgcacgccgatatgggctattggatcgaatccgcgctgaatgacacatggaaaatggagaaggccagcttcattgagatcaagtcttgccactggcctaaaagccataccctgtggtccaacggggttcttgaaagcgagatgattatccccaagaacttcgctggaccggtgtctcagcacaattaccgccctggctatcatacgcagacagccgggccctggcacctcggaaaactggaaatggattttgacttctgtgagggcaccaccgtcgtggtgacagaagattgcgggaaccggggaccctccctgagaaccacgacagctagcggcaagctcattaccgagtggtgctgtcggtcctgcacactgcctccgcttcgctacagaggcgaggacgggtgttggtacggaatggaaatccggcccctgaaagagaaggaagagaatctcgtcaactctctggttaccgccggccatgggcaaatcgataattttagcctgggagtgcttggcatggccctcttcctggaagagatgctgagaacacgcgtggggaccaagcacgctattctcctggtcgcggtgtcctttgttacgcttatcaccggaaacatgtctttccgggacctgggcagagtgatggtcatggtgggcgccacaatgaccgatgacattgggatgggagttacatatctcgctctgctggccgcctttaaagtgcgccctaccttcgctgccggccttctgctcagaaagctgacgagcaaagagctcatgatggcgacaatcgggattgctctgctttcccagtctaccatccccgaaacaatcctggagctcaccgatgccctggccctgggaatgatggtccttaagattgtgcggaatatggaaaaataccagctggctgttaccatcatggccattagctgcgtgcctaacgcggtcatcctccaaaatgcttggaaggtgtcctgtacaattctggccgccgtgagcgtctctcccctcctgcttacgtccagccagcagaaggctgactggatccctctggccctcaccatcaaaggcctgaaccccacagctatttttctgaccacactttctcgcacctccaagaaaagaagctggccgctgaatgaggccgttatggcggtggggatggtgtctatcctcgcctccagcctgctcaagaacgacattcctatgacgggacccctggtcgctggcggccttctgacagtgtgctatgttctgaccgggcggtccgccgatctcgaactggagcgcgctgccgacgtgaaatgggaggatcaggccgaaatcagcggatctagccctattctttccatcaccatttctgaggacggcagcatgtccatcaagaatgaagaggaggaacacacactgaccatcctcattagaacagggctgctcgtcatctctggagtgttccccgttagcattccgatcacggctgcggcctggtacctgtgggaggtgaaaaagcaacgggctggcgtcctttgggatgtgccttctccccctcccgtcgggaaggccgaactggaggacggagcctatcgcattaaacagagaggcatctttggctacagccagatcggggctggagtgtataaggaaggcaccttccatacaatgtggcacgttaccagaggggccgtgctgatgcatcgcggaaaaagaattgagcccagctgggcggatgtcaagaaagacctcatctcctacggcgggggatggaagctggagggcgaatggaaggagggcgaagaggtgcaggttcttgctctggaacctgggaaaaacccgcgggccgtgcaaacaaagcccggactctttaaaaccaatacgggcaccattggggccgtcagcctggatttctctcctggaacatccggcagccccatcgtggacagaaaggggaaagtggttggactctacggcaacggcgtcgtgacccgctctggggcttatgtgtccgccattgcgcagacagaaaagagcatcgaggataaccctgaaatcgaggacgatattttccggaagaaaagactgaccatcatggaccttcaccccggagctggcaagacaaaacgctacctgcctgccattgtccgggaagccatcaagagagggctgcgcacgctcattctggctccgacccgggtggttgccgctgagatggaagaggcccttagaggactgcccatccgctatcagacccctgcgattcgggccgagcataccggcagagaaatcgtggacctcatgtgtcacgctacctttacaatgcggctgctctcccccgtccgcgtgcctaattacaacctgatcattatggatgaggcccacttcacggaccccgcttctatcgccgccagagggtatattagcacccgggttgaaatgggcgaggctgcgggaatctttatgacagccaccccgcctggctcccgcgatcccttcccccagagcaatgctcctattatggacgaggaaagagagatccccgaacggtcttggaactccgggcatgagtgggtgacagattttaaaggaaagaccgtctggttcgtgcctagcatcaaggccggcaatgacattgccgcttgccttcgcaagaacgggaagaaagttatccaactgtctcgcaagacgtttgatagcgaatacgtgaaaacacgggccaatgactgggatttcgtcgtgaccaccgacatttccgagatgggagcgaactttagagctgagcgcgtgatcgatccgcggagatgtatgaagcccgtcattctgacagacggcgaagaaagagttatcctcgccgggcctatgcccgtgacccactctagcgccgctcagcggagaggccgcatcggaagaaatcctaagaacgaaaatgaccagtatatttacatgggcgagcccctggaaaacgatgaggactgcgcccattggaaagaggcgaagatgcttctggataatatcaacacaccggaagggattatcccttccatgttcgagcccgaacgggagaaagtggacgccattgatggagaataccgcctcagaggcgaggctcggaagacctttgtcgacctgatgcgcagaggggatctgcctgtgtggctcgcctatcgggttgctgccgagggaatcaattacgctgacagacgctggtgtttcgatggcattaaaaacaaccaaatccttgaagagaatgtggaagtcgagatctggacgaaggagggggaacggaaaaagctgaagcccagatggctggacgcccgcatttattctgatcctctcgcgctgaaagagttcaaggaatttgccgctggccggaaaagccttacactgaacctcatcaccgagatgggaagactgcccacattcatgacccagaaggcccgggacgctctggataatctcgccgtgcttcacacggccgaagttggcgggcgcgcttacaaccacgcgctgtccgagctgccggagaccctcgaaacactgcttctgctcaccctgctggccacagtgaccggaggcatttttctcttccttatgagcgggaaaggaatcggcaagatgacactgggcatgtgctgcattatcaccgcttctatcctgctctggtatgcccagattcagcctcattggatcgccgcttccattatcctggagtttttccttattgtcctgctcatccccgaacccgagaagcaaagaacgcctcaggacaatcagctgacatacgtggtcatcgccattctgaccgtggttgcggccaccatggctaacgaaatggggtttctcgagaaaacaaagaaagaccttggactgggcagcatcaccacacaggagtccgaatctaatattctggatatcgacctccggccggccagcgcttggacgctgtatgccgtggcgaccacattcgtgacccccatgcttcgccactccattgagaactctagcgtcaatgtttccctgacagccatcgctaaccaagccaccgtgctcatggggctgggaagaggctggcctctgagcaagatggatattggggtgcccctccttgctatcggatgttactctcaggtcaatcctatcacgctgaccgccgctctgctcctgcttgtggcccattacgcgattatcggccccggcctgcaggccaaagctacacgggaagcccagaagcgcaccgctgccgggattatgaagaaccctacagttgacggaatcaccgtgattgatctcgagccgatcccctatgaccctaaatttgaaaagcaactgggccaggtcatgctgctcgtgctttgcgtcacacaggtgctgatgatgagaacaacctgggccctgtgtgaggcgctcacactggctaccgggcccatctccaccctttgggagggaaatcctggccggttctggaacacaacgattgccgttagcatggctaatatctttcgcgggtcttacctggccggagccggcctcctgttctccattatgaaaaacaccacaaataccagacggggcacagggaacatcggagaaaccctgggcgagaagtggaaaagcagactcaacgctcttgggaagtctgaatttcagatttataagaaaagcggaatccaagaggtggatcgcacgctggccaaggagggcatcaaaagaggggaaacagaccaccatgcggtctccagaggatctgccaagctgcgctggttcgtggagcggaatatggttacccccgaaggcaaagtggtcgatctcggctgcgggagaggaggctggagctactattgtgggggactgaagaacgtgcgcgaggtgaaaggccttaccaaagggggaccgggccacgaggagcctattcccatgtccacatacggctggaatctggttcggctccagagcggggtcgacgtgttctttacaccccctgagaagtgcgatacactgctgtgtgacatcggagaatcctctcccaaccctacgattgaggctggcagaaccctccgcgtgcttaatctggtcgaaaactggctgaataacaatacacagttctgcatcaaagttctcaacccgtatatgcccagcgtgattgagaagatggaaaccctgcaacggaaatacgggggagcccttgtgagaaatcctctgtcccgcaactctacacacgagatgtactgggtcagcaatgctaccggcaacatcgtgtcctctgttaatatgatcagccggatgctcattaacagatttacgatgaagcataaaaaggccacctatgagcccgatgtggacctggggtccggaacacgcaacatcggcattgaaaatgagatccctaacctggacattatcggcaagagaattgagaagatcaagcaggagcacgaaaccagctggcattacgatcaggaccacccctataaaacatgggcgtaccacgggtcttatgagaccaagcagacaggatccgccagctctatggtcaatggcgtggttaaactccttaccaagccgtgggatgtggtccctatggtgacgcaaatggctatgacagacaccacccccttcgggcagcagcgggtgtttaaggagaaagtcgatacacgcacgcaggaacctaaggagggaaccaaaaagctgatgagaatcacagccgaatggctgtggaaagagctcggcaagaagaaaacaccccggatgtgtacaagagaggagttcacccggaaggttcgctccaacgctgccctgggggctatttttacagacgagaataaatggaagtccgccagagaagcggtggaggattctcggttctgggaacttgtggaccgcgagagaaacctgcatctcgagggaaaatgcgaaacctgtgtctacaatatgatgggcaagcgggagaaaaagctgggcgaatttgggaaggccaaaggatcccgcgctatctggtatatgtggctgggcgccagattcctcgagtttgaagctctggggttccttaacgaggatcactggtttagccggggaaattccctgagcggcgtggagggggaaggcctccataagctgggatacattcttcgcgacgtttctaaaaaggagggcggggccatgtacgccgatgacacggcgggatgggacaccagaatcacactggaagatctcaaaaacgaggaaatggtgaccaatcacatgaagggcgagcataagaaactggctgaggccattttcaagctgacatatcaaaacaaagtcgtgcgggttcagcgccctacccccagagggacggtgatggacatcatcagccggaaggatcagcgcggatccggccaggtcgggacatacggcctcaataccttcacaaacatggaagcccaactgattagacagatggagggagaaggcatctttaaatctattcagcggcttaccgtgacggaggagatcgctgttcaaaattggctggccagagtggggcgcgaacggctcagcagaatggctatttccggagacgattgcgtcgtgaagccgctggacgatcgcttcgcctctgcgcttaccgccctgaacgacatgggcaaggtccggaaagatatccagcagtgggagcctagcagagggtggaacgactggacacaggtgcccttttgctcccaccacttccatgaactcgttatgaaggatggacgcgtgctggtcgtgccctgtcggaatcaagacgagctgatcggcagagctcgcatttctcagggggccggctggagcctcaaagaaaccgcttgcctgggaaagtcctatgcccagatgtggacacttatgtactttcaccggagagatctgcgcctcgcggccaacgctatctgtagcgccgtgccttctcattgggttccgacctcccggacaacctggagcattcacgctaaacacgagtggatgacgacagaggacatgctggccgtgtggaatagagtctggatccaggaaaacccctggatggaggacaagacccctgtggaatcttgggaggaagttccctatcttggcaagcgggaggatcaatggtgcgggtccctgattggactcaccagcagagctacatgggccaaaaatatccagaccgcgattaaccaggtgcgctccctgatcggcaatgaggaatacacagactatatgccttctatgaagcggttcagaaaagaggaagaggaagccggggtcctgtggtga

SEQ ID NO: 19964 - RNA, 9876 nt, synthetic construct
  misc_feature 1..9876: note = derived and/or modified CDS sequence (opt5) from DENV-2__EU687230__SS-prME
  source 1..9876: mol_type = other RNA
accgccggagtgatcattatgctgatccccaccgctatggccttccacctcacgaccagaaatggggagcctcatatgattgtcggacggcaggaaaagggcaaaagcctgctttttaagacggaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggggcacctcccttagcgtgtctctcgtgctggttggggtcgtgacactgtatctcggagtgatggtccaggccgactccggctgtgtggttagctggaagaataaagaactgaagtgcgggtctggcattttcatcaccgataacgtgcacacatggacggagcagtacaagtttcagcctgaatcccccagcaaacttgcctccgctattcaaaaggcccatgaggaaggaatctgtggcatcagatctgtcacccgcctggagaatctcatgtggaaacagattacaccggagctgaaccacatcctgagcgaaaatgaggtgaaacttaccattatgacaggggacatcaaaggaattatgcaggctggcaagcggtccctcagacctcagcccaccgaactgaaatattcttggaagacgtgggggaaggccaaaatgctgagcaccgagtcccataaccaaacattcctcatcgatggacctgaaaccgcggagtgccccaatacaaaccgcgcctggaatagcctggaggttgaagactacggctttggcgtgttctctaccaacatctggcttaagctgcgggagaaacaggacgtcttttgtgattccaagctcatgagcgctgccattaaagacaatagagctgtgcacgccgatatggggtattggatcgaatctgcgctgaacgacacatggaagatggagaaggcctccttcattgagatcaaaagctgccactggcctaagtctcataccctgtggagcaatggagttcttgaatccgagatgattatccccaaaaacttcgctggcccggtgagccagcacaactaccgccctgggtatcatacgcagacagccggaccctggcacctcggcaagctggaaatggattttgacttctgtgaggggaccaccgtcgtggtgacagaagattgcggaaatcggggcccctctctgagaaccacgacagcttccggcaaactcattaccgagtggtgctgtcggagctgcacactgcctccgcttcgctacagaggggaggacggatgttggtacggcatggaaatccggcccctgaaggagaaggaagagaacctcgtcaattccctggttaccgccgggcatggacaaatcgataacttttctctgggcgtgcttgggatggccctcttcctggaagagatgctgagaacacgcgtgggaaccaaacacgctattctcctggtcgcggtgagctttgttacgcttatcaccggcaatatgtccttccgggacctgggcagagtgatggtcatggtgggggccacaatgaccgatgacattggaatgggcgttacatatctcgctctgctggccgcctttaaggtgcgccctaccttcgctgccgggcttctgctcagaaaactgacgtctaaggagctcatgatggcgacaatcggaattgctctgcttagccagtccaccatccccgaaacaatcctggagctcaccgatgccctggccctgggcatgatggtccttaaaattgtgcggaacatggaaaagtaccagctggctgttaccatcatggccatttcttgcgtgcctaatgcggtcatcctccaaaacgcttggaaggtgagctgtacaattctggccgccgtgtccgtcagccccctcctgcttacgtcttcccagcagaaagctgactggatccctctggccctcaccatcaaggggctgaatcccacagctatttttctgaccacacttagccgcacctctaaaaagagatcctggccgctgaacgaggccgttatggcggtgggaatggtgagcatcctcgcctcttccctgctcaaaaatgacattcctatgacgggccccctggtcgctggcgggcttctgacagtgtgctatgttctgaccggacggagcgccgatctcgaactggagcgcgctgccgacgtgaagtgggaggatcaggccgaaatctccggcagctctcctattcttagcatcaccatttccgaggacgggtctatgagcatcaaaaacgaagaggaggaacacacactgaccatcctcattagaacaggactgctcgtcatctccggcgtgttccccgtttctattccgatcacggctgcggcctggtacctgtgggaggtgaagaagcaacgggctggggtcctttgggatgtgccttctccccctcccgtcggaaaagccgaactggaggacggcgcctatcgcattaagcagagaggcatctttgggtactcccagatcggagctggcgtgtataaagaagggaccttccatacaatgtggcacgttacccggggagccgtgctgatgcatcgcggcaagagaattgagccctcctgggcggatgtcaaaaaggacctcatcagctacgggggaggctggaagctggagggcgaatggaaagagggggaagaggtgcaggttcttgctctggaacctggaaagaatccgcgggccgtgcaaacaaaacccggcctctttaagaccaacacggggaccattggagccgtctccctggatttcagccctggcacatctgggtcccccatcgtggacagaaaaggaaaggtggttggcctctacggcaatggggtcgtgacccgcagcggagcttatgtgtctgccattgcgcagacagagaagtccatcgaggataaccctgaaatcgaggacgatattttccggaaaaagagactgaccatcatggaccttcaccccggcgctgggaaaacaaagcgctacctgcctgccattgtccgggaagccatcaaaagaggactgcgcacgctcattctggctccgacccgggtggttgccgctgagatggaagaggcccttagaggcctgcccatccgctatcagacccctgcgattcgggccgagcataccgggagagaaatcgtggacctcatgtgtcacgctacctttacaatgcggctgctcagccccgtccgcgtgcctaactacaatctgatcattatggatgaggcccacttcacggaccccgcttccatcgccgccagaggctatatttctacccgggttgaaatgggagaggctgcgggcatctttatgacagccaccccgcctgggagccgcgatcccttcccccagtccaacgctcctattatggacgaggaaagagagatccccgaacggagctggaactctggacatgagtgggtgacagattttaagggcaagaccgtctggttcgtgccttccatcaaagccgggaacgacattgccgcttgccttagaaagaatggcaagaaggttatccaactgagccgcaaaacgtttgattctgaatacgtgaagacacgggccaacgactgggatttcgtcgtgaccaccgacattagcgagatgggcgcgaattttagagctgagcgcgtgatcgatccgcggagatgtatgaagcccgtcattctgacagacggggaggaacgcgttatcctcgccggccctatgcccgtgacccactcctctgccgctcagcggagaggacgcatcggcagaaaccctaaaaatgaaaacgaccagtatatttacatgggggagcccctggaaaatgatgaggactgcgcccattggaaggaggcgaaaatgcttctggataacatcaatacaccggaaggaattatccctagcatgttcgagcccgaacgggagaaggtggacgccattgatggcgaataccgcctcagaggggaggctcggaaaacctttgtcgacctgatgcgcagaggagatctgcctgtgtggctcgcctatcgggttgctgccgagggcatcaactacgctgacagacgctggtgtttcgatgggattaagaataaccaaatccttgaagagaacgtggaagtcgagatctggacgaaagagggcgaacggaagaagctgaaacccagatggctggacgcccgcatttattccgatcctctcgcgctgaaggagttcaaagaatttgccgctggacggaagtctcttacactgaatctcatcaccgagatgggcagactgcccacattcatgacccagaaagcccgggacgctctggataacctcgccgtgcttcacacggccgaagttgggggacgcgcttacaatcacgcgctgagcgagctgccggagaccctcgaaacactgcttctgctcaccctgctggccacagtgaccggcgggatttttctcttccttatgtccggaaagggcatcggcaagatgacactggggatgtgctgcattatcaccgctagcatcctgctctggtatgcccagattcagcctcattggatcgccgcttctattatcctggagtttttccttattgtcctgctcatccccgaacccgagaaacaaagaacgcctcaggacaaccagctgacatacgtggtcatcgccattctgaccgtggttgcggccaccatggctaatgaaatgggatttctcgagaagaccaaaaaggaccttggcctggggtccatcaccacacaggagagcgaatccaacattctggatatcgacctccggccggcctctgcttggacgctgtatgccgtggcgaccacattcgtgacccccatgcttcgccacagcattgaaaatagctctgtcaacgttagcctgacagccatcgctaatcaagccaccgtgctcatgggactgggcagagggtggcctctgtccaaaatggatattggagtgcccctccttgctatcggctgttacagccaggtcaaccctatcacgctgaccgccgctctgctcctgcttgtggcccattacgcgattatcggccccgggctgcaggccaaggctacacgggaagcccagaagcgcaccgctgccggaattatgaaaaatcctacagttgacggcatcaccgtgattgatctcgagccgatcccctatgaccctaagtttgaaaaacaactggggcaggtcatgctgctcgtgctttgcgtcacacaggtgctgatgatgagaacaacctgggccctgtgtgaggcgctcacactggctaccggacccatctctaccctttgggagggcaaccctgggcggttctggaatacaacgattgccgtttccatggctaacatctttcgcggaagctacctggccggcgccggcctcctgttctctattatgaagaataccacaaacaccagacgggggacaggaaatatcggcgaaaccctgggggagaaatggaagtccagactcaacgctcttggaaagagcgaatttcagatttataaaaagtctggcatccaagaggtggatcgcacgctggccaaagaggggatcaagcggggagaaacagaccaccatgcggtcagcagaggctccgccaaactgcgctggttcgtggagcggaacatggttacccccgaaggcaaggtggtcgatctcgggtgcggaagaggcgggtggtcttactattgtggaggcctgaaaaatgtgcgcgaggtgaaggggcttaccaagggaggcccgggccacgaggagcctattcccatgagcacatacgggtggaacctggttcggctccagtccggagtcgacgtgttctttacaccccctgagaaatgcgatacactgctgtgtgacatcggcgaaagctcccccaatcctacgattgaggctgggagaaccctccgcgtgcttaacctggtcgaaaattggctgaacaataacacacagttctgcatcaaggttctcaatccgtatatgccctctgtgattgagaaaatggaaaccctgcaacggaagtacggaggcgcccttgtgagaaaccctctgagccgcaattccacacacgagatgtactgggtctctaacgctaccgggaatatcgtgagctccgttaacatgatctctcggatgctcattaatagatttacgatgaaacataagaaggccacctatgagcccgatgtggacctgggaagcggcacacgcaacatcggcattgaaaacgagatccctaatctggacattatcgggaaaagaattgaaaagatcaaacaggagcacgaaacctcctggcattacgatcaggaccacccctataagacatgggcgtaccacggaagctatgagaccaaacagacaggctctgcctccagcatggtcaacggggtggttaagctccttaccaagccgtgggatgtggtccctatggtgacgcaaatggctatgacagacaccacccccttcggacagcagcgggtgtttaaagagaaggtcgatacacgcacgcaggaacctaaagagggcaccaagaaactgatgagaatcacagccgaatggctgtggaaggagctcgggaagaaaaagacaccccggatgtgtacaagagaggagttcacccggaaagttcgctctaatgctgccctgggagctatttttacagacgagaacaagtggaaatccgccagagaagcggtggaggatagccggttctgggaacttgtggaccgcgagagaaatctgcatctcgagggcaagtgcgaaacctgtgtctacaacatgatgggcaaacgggagaagaagctgggggaatttggaaaagccaagggctctcgcgctatctggtatatgtggctgggggccagattcctcgagtttgaagctctgggattccttaatgaggatcactggttttcccggggcaacagcctgtccggggtggagggcgaaggactccataaactgggctacattcttcgcgacgttagcaagaaagaagggggagccatgtacgccgatgacacggcgggctgggacaccagaatcacactggaagatctcaagaatgaggaaatggtgaccaaccacatgaagggggagcataaaaagctggctgaggccattttcaaactgacatatcaaaataaggtcgtgcgggttcagcgccctacccccagaggaacggtgatggacatcatctctcggaaagatcagcgcggcagcgggcaggtcggcacatacggactcaacaccttcacaaatatggaagcccaactgattagacagatggagggcgaagggatctttaagtccattcagcggcttaccgtgacggaggagatcgctgttcaaaactggctggccagagtgggacgcgaacggctctctagaatggctattagcggcgacgattgcgtcgtgaagccgctggacgatcgcttcgcctccgcgcttaccgccctgaatgacatggggaaagtccggaaggatatccagcagtgggagccttctagaggatggaacgactggacacaggtgcccttttgcagccaccacttccatgaactcgttatgaaagatggccgcgtgctggtcgtgccctgtcggaaccaagacgagctgatcgggagagctcgcatttcccagggcgccggatggtctctcaaggaaaccgcttgcctgggcaaaagctatgcccagatgtggacacttatgtactttcaccggagagatctgcgcctcgcggccaatgctatctgttccgccgtgcctagccattgggttccgacctctcggacaacctggtccattcacgctaagcacgagtggatgacgacagaggacatgctggccgtgtggaacagagtctggatccaggaaaatccctggatggaggacaagacccctgtggaaagctgggaggaagttccctatcttgggaaacgggaggatcaatggtgcggatctctgattggcctcacctccagagctacatgggccaagaacatccagaccgcgattaatcaggtgcgcagcctgatcgggaacgaggaatacacagactatatgccttccatgaaacggttcagaaaggaggaagaggaagccggagtcctgtggtga

SEQ ID NO: 19965 - RNA, 9876 nt, synthetic construct
  misc_feature 1..9876: note = derived and/or modified CDS sequence (opt5) from DENV-2__EU687231__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacggaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgagatcaaatcttgccactggcctaagagccataccctgtggtccaatggggttcttgaaagcgagatgattatccccaaaaacttcgctggaccggtgtctcagcacaactaccgccctggctatcatacgcagacagccgggccctggcacctcggaaagctggaaatggattttgacttctgtgagggcaccaccgtcgtggtgacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgtcaattctctggttaccgccggccatgggcaaatcgataactttagcctgggagtgcttggcatggccctcttcctggaagagatgctgagaacacgcgtggggaccaaacacgctattctcctggtcgcggtgtcctttgttacgcttatcaccggaaatatgtctttccgggacctgggcagagtgatggtcatggtgggcgccacaatgaccgatgacattgggatgggagttacatatctcgctctgctggccgcctttaaggtgcgccctaccttcgctgccggccttctgctcagaaaactgacgagcaaggagctcatgatggcgacaatcgggattgctctgctttcccagtctaccatccccgaaacaatcctggagctcaccgatgccctggccctgggaatgatggtccttaaaattgtgcggaacatggaaaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaagggcctgaatcccacagctatttttctgaccacactttctcgcacctccaaaaagagaagctggccgctgaacgaggccgttatggcggtggggatggtgtctatcctcgcctccagcctgctcaaaaatgacattcctatgacgggacccctggtcgctggcggccttctgacagtgtgctatgttctgaccgggcggtccgccgatctcgaactggagcgcgctgccgacgtgaagtgggaggatcaggccgaaatcagcggatctagccctattctttccatcaccatttctgaggacggcagcatgtccatcaaaaacgaagaggaggaacacacactgaccatcctcattagaacagggctgctcgtcatctctggagtgttccccgttagcattccgatcacggctgcggcctggtacctgtgggaggtgaagaagcaacgggctggcgtcctttgggatgtgccttctccccctcccgtcgggaaagccgaactggaggacggagcctatcgcattaagcagagaggcatctttggctacagccagatcggggctggagtgtataaagaaggcaccttccatacaatgtggcacgttaccagaggggccgtgctgatgcatcgcggaaagagaattgagcccagctgggcggatgtcaaaaaggacctcatctcctacggcgggggatggaagctggagggcgaatggaaagagggcgaagaggtgcaggttcttgctctggaacctgggaagaatccgcgggccgtgcaaacaaaacccggactctttaagaccaacacgggcaccattggggccgtcagcctggatttctctcctggaacatccggcagccccatcgtggacagaaaagggaaggtggttggactctacggcaatggcgtcgtgacccgctctggggcttatgtgtccgccattgcgcagacagaaaagagcatcgaggataaccctgaaatcgaggacgatattttccggaaaaagagactgaccatcatggaccttcaccccggagctggcaaaacaaagcgctacctgcctgccattgtccgggaagccatcaaaagagggctgcgcacgctcattctggctccgacccgggtggttgccgctgagatggaagaggcccttagaggactgcccatccgctatcagacccctgcgattcgggccgagcataccggcagagaaatcgtggacctcatgtgtcacgctacctttacaatgcggctgctctcccccgtccgcgtgcctaactacaatctgatcattatggatgaggcccacttcacggaccccgcttctatcgccgccagagggtatattagcacccgggttgaaatgggcgaggctgcgggaatctttatgacagccaccccgcctggctcccgcgatcccttcccccagagcaacgctcctattatggacgaggaaagagagatccccgaacggtcttggaactccgggcatgagtgggtgacagattttaagggaaagaccgtctggttcgtgcctagcatcaaagccggcaacgacattgccgcttgccttagaaagaatgggaaaaaggttatccaactgtctcgcaaaacgtttgatagcgaatacgtgaagacacgggccaacgactgggatttcgtcgtgaccaccgacatttccgagatgggagcgaattttagagctgagcgcgtgatcgatccgcggagatgtatgaagcccgtcattctgacagacggcgaggaacgcgttatcctcgccgggcctatgcccgtgacccactctagcgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaatacaccggaagggattatcccttccatgttcgagcccgaacgggagaaggtggacgccattgatggagaataccgcctcagaggcgaggctcggaaaacctttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacgaaagagggggaacggaagaagctgaaacccagatggctggacgcccgcatttattctgatcctctcgcgctgaaggagttcaaagaatttgccgctggccggaagtcccttacactgaatctcatcaccgagatgggaagactgcccacattcatgacccagaaagcccgggacgctctggataacctcgccgtgcttcacacggccgaagttggcgggcgcgcttacaatcacgcgctgtccgagctgccggagaccctcgaaacactgcttctgctcaccctgctggccacagtgaccggaggcatttttctcttccttatgagcgggaagggaatcggcaagatgacactgggcatgtgctgcattatcaccgcttctatcctgctctggtatgcccagattcagcctcattggatcgccgcttccattatcctggagtttttccttattgtcctgctcatccccgaacccgagaaacaaagaacgcctcaggacaaccagctgacatacgtggtcatcgccattctgaccgtggttgcggccaccatggctaatgaaatggggtttctcgagaagaccaagaaggaccttggactgggcagcatcaccacacaggagtccgaatctaacattctggatatcgacctccggccggccagcgcttggacgctgtatgccgtggcgaccacattcgtgacccccatgcttcgccactccattgaaaattctagcgtcaacgtttccctgacagccatcgctaatcaagccaccgtgctcatggggctgggaagaggctggcctctgagcaaaatggatattggggtgcccctccttgctatcggatgttactctcaggtcaaccctatcacgctgaccgccgctctgctcctgcttgtggcccattacgcgattatcggccccggcctgcaggccaaggctacacgggaagcccagaagcgcaccgctgccgggattatgaaaaatcctacagttgacggaatcaccgtgattgatctcgagccgatcccctatgaccctaagtttgaaaaacaactgggccaggtcatgctgctcgtgctttgcgtcacacaggtgctgatgatgagaacaacctgggccctgtgtgaggcgctcacactggctaccgggcccatctccaccctttgggagggaaaccctggccggttctggaatacaacgattgccgttagcatggctaacatctttcgcgggtcttacctggccggagccggcctcctgttctccattatgaagaataccacaaacaccagacggggcacagggaatatcggagaaaccctgggcgagaaatggaaaagcagactcaacgctcttgggaagtctgaatttcagatttataaaaagagcggaatccaagaggtggatcgcacgctggccaaagagggcatcaagagaggggaaacagaccaccatgcggtctccagaggatctgccaaactgcgctggttcgtggagcggaacatggttacccccgaaggcaaggtggtcgatctcggctgcgggagaggaggctggagctactattgtgggggactgaaaaatgtgcgcgaggtgaagggccttaccaaagggggaccgggccacgaggagcctattcccatgtccacatacggctggaacctggttcggctccagagcggggtcgacgtgttctttacaccccctgagaaatgcgatacactgctgtgtgacatcggagaatcctctcccaatcctacgattgaggctggcagaaccctccgcgtgcttaacctggtcgaaaattggctgaacaataacacacagttctgcatcaaggttctcaatccgtatatgcccagcgtgattgagaaaatggaaaccctgcaacggaagtacgggggagcccttgtgagaaaccctctgtcccgcaattctacacacgagatgtactgggtcagcaacgctaccggcaatatcgtgtcctctgttaacatgatcagccggatgctcattaatagatttacgatgaaacataagaaggccacctatgagcccgatgtggacctggggtccggaacacgcaacatcggcattgaaaacgagatccctaatctggacattatcggcaaaagaattgaaaacatcaagcaggagcacgaaaccagctggcattacgatcaggaccacccctataaaacatgggcgtaccacgggtcttatgagaccaagcagacaggatccgccagctctatggtcaatggcgtggttaaactccttaccaagccgtgggatgtggtccctatggtgacgcaaatggctatgacagacaccacccccttcgggcagcagcgggtgtttaaggagaaagtcgatacacgcacgcaggaacctaaggagggaaccaaaaagctgatgagaatcacagccgaatggctgtggaaagagctcggcaagaagaaaacaccccggatgtgtacaagagaggagttcacccggaaggttcgctccaacgctgccctgggggctatttttacagacgagaataaatggaaaagcgccagagaagcggtggaggattctcggttctgggaacttgtggaccgcgagagaaacctgcatctcgagggaaaatgcgaaacctgtgtctacaatatgatgggcaagcgggagaaaaagctgggcgaatttgggaaggccaaaggatcccgcgctatctggtatatgtggctgggcgccagattcctcgagtttgaagctctggggttccttaacgaggatcactggtttagccggggaaattccctgagcggcgtggagggggaaggcctccataagctgggatacattcttcgcgacgtttctaaaaaggagggcggggccatgtacgccgatgacacggcgggatgggacaccagaatcacactggaagatctcaaaaacgaggaaatggtgaccaatcacatgaagggcgagcataagaaactggctgaggccattttcaagctgacatatcaaaacaaagtcgtgcgggttcagcgccctacccccagagggacggtgatggacatcatcagccggaaggatcagcgcggatccggccaggtcgggacatacggcctcaataccttcacaaacatggaagcccaactgattagacagatggagggagaaggcatctttaaatctattcagcggcttaccgtgacggaggagatcgctgttcaaaattggctggccagagtggggcgcgaacggctcagcagaatggctatttccggagacgattgcgtcgtgaagccgctggacgatcgcttcgcctctgcgcttaccgccctgaacgacatgggcaaggtccggaaagatatccagcagtgggagcctagcagagggtggaacgactggacacaggtgcccttttgctcccaccacttccatgaactcgttatgaaggatggacgcgtgctggtcgtgccctgtcggaatcaagacgagctgatcggcagagctcgcatttctcagggggccggctggagcctcaaagaaaccgcttgcctgggaaagtcctatgcccagatgtggacacttatgtactttcaccggagagatctgcgcctcgcggccaacgctatctgtagcgccgtgccttctcattgggttccgacctcccggacaacctggagcattcacgctaaacacgagtggatgacgacagaggacatgctggccgtgtggaatagagtctggatccaggaaaacccctggatggaggacaagacccctgtggaatcttgggaggaagttccctatcttggcaagcgggaggatcaatggtgcgggtccctgattggactcaccagcagagctacatgggccaaaaatatccagaccgcgattaaccaggtgcgctccctgatcggcaatgaggaatacacagactatatgccttctatgaagcggttcagaaaagaggaagaggaagccggggtcctgtggtga

SEQ ID NO: 19966 - RNA, 9876 nt, synthetic construct
  misc_feature 1..9876: note = derived and/or modified CDS sequence (opt5) from DENV-2__EU687199__SS-prME
  source 1..9876: mol_type = other RNA
accgccggagtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaatgatggatctggagaaacgccatgtcctgggccggctcattaccgtgaaccctatcgttacagaaaaggacagcccggtgaacattgaggccgaacccccttttggggattcttacatcattatcggcgtcgagcccggacagctgaaacttaattggttcaagaagggctccagcatcgggcagatgtttgagaccacaatgagaggagctaaacgcatggccattctgggcgacaccgcctgggatttcgggtctctcggaggcgtgtttacgagcatcgggaaggctctgcaccaagttttcggcgccatttacggagcggctttttccggcgtgtcttggacaatgaaaatcctgattggggtcatcatcacctggattggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggatcttcattacagataacgtgcacacgtggaccgagcagtacaagtttcagcctgaatcccccagcaaacttgcctccgctatccaaaaggcccatgaggaaggcatttgtggaatcagatctgtcacacgcctggagaatctcatgtggaaacagatcaccccggagctgaaccacattctgagcgaaaatgaggtgaaacttacaatcatgaccggcgacattaaagggatcatgcaggctggaaagcggtccctcagacctcagcccacggaactgaaatattcttggaagacctggggcaaggccaaaatgctgagcacagagtcccataaccaaaccttcctcattgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccatcaaagacaatagagctgtgcacgccgatatgggctattggattgaatctgcgctgaacgacacctggaagatggagaaggcctccttcatcgagattaaaagctgccactggcctaagtctcatacgctgtggagcaatggggttcttgaatccgagatgatcattcccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcatcacagagtggtgctgtcggagctgcaccctgcctccgcttcgctacagaggcgaggacgggtgttggtacggaatggaaattcggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctatcctcctggtcgcggtgagctttgttacccttattacaggaaatatgtccttccgggacctgggcagagtgatggtcatggtgggcgccaccatgacagatgacatcgggatgggagttacctatctcgctctgctggccgcctttaaggtgcgccctacgttcgctgccggccttctgctcagaaaactgacatctaaggagctcatgatggcgaccattgggatcgctctgcttagccagtccacaattcccgaaaccatcctggagctcaccgatgccctggccctgggaatgatggtccttaaaatcgtgcggaacatggaaaagtaccagctggctgttacaattatggccatctcttgcgtgcctaatgcggtcattctccaaaacgcttggaaggtgagctgtacgatcctggccgccgtgtccgtcagccccctcctgcttacctcttcccagcagaaagctgactggattcctctggccctcacaatcaagggcctgaatcccaccgctatctttctgacaacccttagccgcacgtctaaaaagagatcctggccgctgaacgaggccgttatggcggtggggatggtgagcattctcgcctcttccctgctcaaaaatgacatccctatgacaggacccctggtcgctggcggccttctgaccgtgtgctatgttctgaccgggcggagcgccgatctcgaactggagcgcgctgccgacgtgaagtgggaggatcaggccgaaatttccggaagctctcctatccttagcattacaatctccgaggacggctctatgagcattaaaaacgaagaggaggaacacaccctgacaatcctcatcagaacggggctgctcgtcatttccggagtgttccccgtttctatcccgattaccgctgcggcctggtacctgtgggaggtgaagaagcaacgggctggcgtcctttgggatgtgccttctccccctcccgtcgggaaagccgaactggaggacggagcctatcgcatcaagcagagaggcatttttggctactcccagatcggggctggagtgtataaagaaggcacattccataccatgtggcacgttacaagaggggccgtgctgatgcatcgcggaaagagaatcgagccctcctgggcggatgtcaaaaaggacctcattagctacggcgggggatggaagctggagggcgaatggaaagagggcgaagaggtgcaggttcttgctctggaacctgggaagaatccgcgggccgtgcaaaccaaacccggactctttaagacgaacaccggcacaatcggggccgtctccctggatttcagccctggaacctctggctcccccattgtggacagaaaagggaaggtggttggactctacggcaatggcgtcgtgacacgcagcggggcttatgtgtctgccatcgcgcagaccgagaagtccattgaggataaccctgaaatcgaggacgatatcttccggaaaaagagactgacaattatggaccttcaccccggagctggcaaaacgaagcgctacctgcctgccatcgtccgggaagccattaaaagagggctgcgcaccctcatcctggctccgacacgggtggttgccgctgagatggaagaggcccttagaggactgcccattcgctatcagacccctgcgatccgggccgagcataccggcagagaaattgtggacctcatgtgtcacgctacatttacgatgcggctgctcagccccgtccgcgtgcctaactacaatctgatcatcatggatgaggcccacttcaccgaccccgcttccattgccgccagagggtatatctctacacgggttgaaatgggcgaggctgcgggaatttttatgaccgccacaccgcctggcagccgcgatcccttcccccagtccaacgctcctatcatggacgaggaaagagagattcccgaacggagctggaactctgggcatgagtgggtgaccgattttaagggaaagacggtctggttcgtgccttccatcaaagccggcaacgacatcgccgcttgccttagaaagaatgggaaaaaggttattcaactgagccgcaaaacatttgattctgaatacgtgaagacccgggccaacgactgggatttcgtcgtgaccacagacatcagcgagatgggagcgaattttagagctgagcgcgtgattgatccgcggagatgtatgaagcccgtcatcctgaccgacggcgaggaacgcgttattctcgccgggcctatgcccgtgacacactcctctgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaataccccggaagggatcattcctagcatgttcgagcccgaacgggagaaggtggacgccatcgatggagaataccgcctcagaggcgaggctcggaaaacgtttgtcgacctgatgcgcagaggggatctgcctgtgtggctcgcctatcgggttgctgccgagggaattaactacgctgacagacgctggtgtttcgatggcatcaagaataaccaaattcttgaagagaacgtggaagtcgagatctggacaaaagagggggaacggaagaagctgaaacccagatggctggacgcccgcatctattccgatcctctcgcgctgaaggagttcaaagaatttgccgctggccggaagtctcttaccctgaatctcattacagagatgggaagactgcccaccttcatgacgcagaaagcccgggacgctctggataacctcgccgtgcttcacaccgccgaagttggcgggcgcgcttacaatcacgcgctgagcgagctgccggagacactcgaaaccctgcttctgctcacactgctggccaccgtgacaggaggcatctttctcttccttatgtccgggaagggaattggcaagatgaccctgggcatgtgctgcatcattacggctagcatcctgctctggtatgcccagatccagcctcattggattgccgcttctatcattctggagtttttccttatcgtcctgctcattcccgaacccgagaaacaaagaacacctcaggacaaccagctgacctacgtggtcatcgccatcctgaccgtggttgcggccacaatggctaatgaaatggggtttctcgagaagaccaaaaaggaccttggactgggctccattacaacgcaggagagcgaatccaacatcctggatattgacctccggccggcctctgcttggaccctgtatgccgtggcgacaaccttcgtgacacccatgcttcgccacagcatcgaaaatagctctgtcaacgttagcctgaccgccattgctaatcaagccacggtgctcatggggctgggaagaggctggcctctgtccaaaatggatatcggggtgcccctccttgctattggatgttacagccaggtcaaccctatcaccctgacagccgctctgctcctgcttgtggcccattacgcgatcattggccccggcctgcaggccaaggctacccgggaagcccagaagcgcacagctgccgggatcatgaaaaatcctaccgttgacggaattacggtgatcgatctcgagccgattccctatgaccctaagtttgaaaaacaactgggccaggtcatgctgctcgtgctttgcgtcacacaggtgctgatgatgagaaccacatgggccctgtgtgaggcgctcaccctggctaccgggcccatctctacactttgggagggaaaccctggccggttctggaatacgaccatcgccgtttccatggctaacatttttcgcgggagctacctggccggagccggcctcctgttctctatcatgaagaatacaaccaacacaagacggggcaccgggaatattggagaaacgctgggcgagaaatggaagtccagactcaacgctcttggaaagagcgaatttcagatctataaaaagtctggcattcaagaggtggatcgcacactggccaaagagggcatcaagagaggggaaaccgaccaccatgcggtcagcagaggatccgccaaactgcgctggttcgtggagcggaacatggttacccccgaaggcaaggtggtcgatctcggctgcgggagaggaggctggtcttactattgtgggggactgaaaaatgtgcgcgaggtgaagggccttacaaaagggggaccgggccacgaggagcctatccccatgagcacctacggctggaacctggttcggctccagtccggggtcgacgtgttctttacaccccctgagaaatgcgatacgctgctgtgtgacattggagaaagctcccccaatcctaccatcgaggctggcagaacactccgcgtgcttaacctggtcgaaaattggctgaacaataacacccagttctgcgttaaggtgctcaatccgtatatgccctctgtgattgagaaaatggaaacactgcaacggaagtacgggggagcccttgtcagaaaccctctgagccgcaattccacccacgagatgtactgggtgtctaacgctacgggcaatatcgttagctccgtgaacatgatttctcggatgctcatcaatagatttaccatgaaacataagaaggccacatatgagcccgatgtcgacctggggagcggaacccgcaacatcggcattgaaaacgagatccctaatctggacattatcggcaaaagaattgaaaagatcaaacaggagcacgaaacatcctggcattacgatcaggaccacccctataagacctgggcgtaccacgggagctatgagacaaaacagaccggatctgcctccagcatggtgaacggcgttgtgaagctccttacgaagccgtgggatgtcgtgcctatggtgacacaaatggctatgaccgacaccacacccttcgggcagcagcgggtctttaaagagaaggttgatacgcgcacccaggaacctaaagagggaacaaagaaactgatgagaattaccgccgaatggctgtggaaggagctcggcaagaaaaagacaccccggatgtgtaccagagaggagttcacacggaaagtgcgctctaatgctgccctgggggctatctttaccgacgagaacaagtggaaatccgccagagaagcggtggaggatagccggttctgggaacttgtcgaccgcgagagaaatctgcatctcgagggaaagtgcgaaacgtgtgtgtacaacatgatgggcaaacgggagaagaagctgggcgaatttgggaaagccaagggatctcgcgctatctggtatatgtggctgggcgccagattcctcgagtttgaagctctggggttccttaatgaggatcactggttttcccggggaaacagcctgtccggcgttgagggggaaggcctccataaactgggatacattcttcgcgacgtgagcaagaaagagggcggggccatgtacgccgatgacaccgcgggatgggacacaagaatcaccctggaagatctcaagaatgaggaaatggtcacaaaccacatgaagggcgagcataaaaagctggctgaggccattttcaaactgacctatcaaaataaggtggttcgggtgcagcgccctacgcccagagggacagtcatggacatcatttctcggaaagatcagcgcggaagcggccaggtggggacctacggcctcaacacattcaccaatatggaagcccaactgatcagacagatggagggagaaggcatctttaagtccattcagcggcttacggttaccgaggagatcgctgtgcaaaactggctggccagagtcgggcgcgaacggctctctagaatggctattagcggagacgattgcgtggtcaagccgctggacgatcgcttcgcctccgcgcttacagccctgaatgacatgggcaaagtgcggaaggatatccagcagtgggagccttctagagggtggaacgactggacccaggttcccttttgcagccaccacttccatgaactcgtgatgaaagatggacgcgtcctggtggtgccctgtcggaaccaagacgagctgattggcagagctcgcatctcccagggggccggctggtctctcaaggaaacagcttgcctgggaaaaagctatgcccagatgtggacccttatgtactttcaccggagagatctgcgcctcgcggccaatgctatctgttccgccgttcctagccattgggtgccgacatctcggaccacgtggtccattcacgctaagcacgagtggatgacaaccgaggacatgctggccgtctggaacagagtgtggatccaggaaaatccctggatggaggacaagacccctgttgaaagctgggaggaagtgccctatcttggcaaacgggaggatcaatggtgcgggtctctgattggactcacatccagagctacctgggccaagaacatccagacagcgattaatcaggtccgcagcctgatcggcaacgaggaatacacggactatatgccttccatgaaacggttcagaaaggaggaagaggaagccggggtgctgtggtga

SEQ ID NO: 19967 - RNA, 9876 nt, synthetic construct
  misc_feature 1..9876: note = derived and/or modified CDS sequence (opt5) from DENV-2__EU687235__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccccttctgcgccaaaacgaacccgaggatatcgactgttggtgcaatagcacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagacagccggtgtccgacccaaggagagccctctctgaatgaggaacaggataaacgctttatttgcaagcattccatggtggacagaggctggggcaacgggtgtggactgttcggcaaaggcgggatcgtgacatgcgccatgtttacgtgcaaaaagaatatggaggggaaagtcgttctccctgaaaacctggagtacaccattgtgatcacaccccacagcggggaagaacatgcggtgggaaatgataccggcaagcacggcaaagagatcaagattacacctcagtcttccatcaccgaagccgagcttacggggtatggaaccgtcacaatggaatgtagcccccggaccggcctggacttcaacgagatggtgctcctgcagatggaagataaggcttggcttgttcaccgccaatggtttctggacctcccgctgccttggctgcccggggccgacacacagggatctaattggattcagaaggagaccctcgtgacgttcaagaaccctcatgctaaaaagcaggatgtcgtggttctgggctcccaagagggggccatgcacacagcccttaccggcgctacagaaatccagatgagctccggaaatctgctctttaccggccatctgaaatgcagacttcggatggacaagctgcagctcaaagggatgtcttacagcatgtgtaccggaaagttcaagattgtgaaagagatcgcggaaacacaacacggcacgatcgtcattagagtgcagtatgagggggatggatccccctgcaagatccccttcgagattatggacctggaaaaacgccatgtcctgggccggctcatcaccgtgaaccctattgttacagagaaggatagcccggtgaacatcgaagccgagcccccttttggggactcttacattatcatcggcgtcgaacccggacagctgaaacttaattggttcaagaagggctccagcattgggcagatgtttgagaccacaatgagaggagctaaacgcatggccatcctgggcgataccgcctgggacttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgataccggatgtgtggttagctggaagaataaagagctgaagtgcggctctgggattttcatcacagacaacgtgcacacgtggaccgaacagtacaagtttcagcctgagtcccccagcaaacttgcctccgctattcaaaaggcccatgaagagggcatctgtggaatcagatctgtcacacgcctggaaaatctcatgtggaaacagattaccccggagctgaaccacatcctgagcgagaatgaagtgaaacttacaattatgaccggcgatatcaaagggattatgcaggctggaaagcggtccctcagacctcagcccacggagctgaaatattcttggaagacctggggcaaggccaaaatgctgagcacagaatcccataaccaaaccttcctcatcgacgggcctgagacagcggaatgccccaataccaaccgcgcctggaatagcctggaggttgaggactacggatttggcgtgttctctacaaacatctggcttaagctgcgggaaaaacaggatgtcttttgtgactccaagctcatgagcgctgccattaaagataatagagctgtgcacgccgacatgggctattggatcgagtctgcgctgaacgatacctggaagatggaaaaggcctccttcattgagatcaaaagctgccactggcctaagtctcatacgctgtggagcaatggggttcttgagtccgaaatgattatccccaaaaacttcgctggaccggtgagccagcacaactaccgccctggctatcatacacagaccgccgggccctggcacctcggaaagctggagatggactttgatttctgtgaaggcaccacagtcgtggtgaccgaggactgcgggaatcggggaccctctctgagaacgacaaccgcttccggcaaactcattacagaatggtgctgtcggagctgcaccctgcctccgcttcgctacagaggcgaggatgggtgttggtacggaatggagatccggcccctgaaggaaaaggaggaaaacctcgtcaattccctggttacagccggccatgggcaaatcgacaacttttctctgggagtgcttggcatggccctcttcctggaggaaatgctgagaacccgcgtggggacgaaacacgctattctcctggtcgcggtgagctttgttacccttatcacaggaaatatgtccttccgggatctgggcagagtgatggtcatggtgggcgccaccatgacagacgatattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgagaccatcctggaactcaccgacgccctggccctgggaatgatggtccttaaaattgtgcggaacatggagaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaagccgttatggcggtggggatggtgagcatcctcgcctcttccctgctcaaaaatgatattcctatgacaggacccctggtcgctggcggccttctgaccgtgtgctatgttctgaccgggcggagcgccgacctcgagctggaacgcgctgccgatgtgaagtgggaggaccaggccgagatctccggaagctctcctattcttagcatcacaatttccgaagatggctctatgagcatcaaaaacgaggaagaggagcacaccctgacaatcctcattagaacggggctgctcgtcatctccggagtgttccccgtttctattccgatcaccgctgcggcctggtacctgtgggaagtgaagaagcaacgggctggcgtcctttgggacgtgccttctccccctctggtcgggaaagccgagctggaagatggagcctatcgcattaagcagagaggcatctttggctactcccagatcggggctggagtgtataaagagggcacattccataccatgtggcacgttacaagaggggccgtgctcatgcatcgcggaaagagaattgaaccctcctgggcggacgtcaaaaaggatctgatcagctacggcgggggatggaaacttgagggcgagtggaaagaaggcgaggaagtgcaggttctggctctcgagcccgggaagaatcctcgggccgtgcaaaccaaaccgggactgtttaagacgaacaccggcacaattggggccgtctccctcgacttcagccccggaacctctggctcccctatcgtggatagaaaagggaaggtggttggactgtacggcaatggcgtcgtgacacgcagcggggcttatgtgtctgccattgcgcagaccgaaaagtccatcgaggacaaccccgagatcgaagatgacattttccggaaaaagagacttacaatcatggacctgcaccctggagctggcaaaacgaagcgctacctgcccgccattgtccgggaggccatcaaaagagggctccgcaccctgattcttgctcctacacgggtggttgccgctgaaatggaggaagccctgagaggactcccgatccgctatcagacccccgcgattcgggccgagcataccggcagagagatcgtggatctgatgtgtcacgctacatttacgatgcggctcctgagccctgtccgcgtgcccaactacaatcttatcattatggacgaagcccacttcaccgatcctgcttccatcgccgccagagggtatatttctacacgggttgagatgggcgaagctgcgggaatctttatgaccgccacacccccgggcagccgcgaccctttcccccagtccaacgctcccattatggatgaggagagagaaatccctgagcggagctggaactctgggcatgaatgggtgaccgactttaagggaaagacggtctggttcgtgccctccatcaaagccggcaacgatattgccgcttgcctgagaaagaatgggaaaaaggttatccaactgagccgcaaaacatttgactctgagtacgtgaagacccgggccaacgattgggacttcgtcgtgaccacagatattagcgaaatgggagcgaattttagagctgagcgcgtgatcgaccctcggagatgtatgaagccggtcattctcaccgacggcgaggaacgcgttatcctggccgggcccatgcctgtgacacactcctctgccgctcagcggagaggccgcatcggaagaaaccccaaaaatgagaacgatcagtatatttacatgggcgaacctcttgagaatgacgaagattgcgcccattggaaggaggcgaaaatgctgctcgacaacatcaatacccccgaggggattatcccgagcatgttcgaacctgagcgggaaaaggtggatgccattgacggagagtaccgcctgagaggcgaagctcggaaaacgtttgtcgatctgatgcgcagaggggacctccccgtgtggcttgcctatcgggttgctgccgagggaatcaactacgctgatagacgctggtgtttcgacggcattaagaataaccaaatcctggaggaaaacgtggaggtcgaaatctggacaaaagagggggagcggaagaagctgaaacctagatggctcgatgcccgcatttattccgaccccctggcgcttaaggagttcaaagagtttgccgctggccggaagtctctgaccctcaatctgatcacagaaatgggaagactgcctaccttcatgacgcagaaagcccgggatgctctcgacaaccttgccgtgctgcacaccgccgaggttggcgggcgcgcttacaatcacgcgctgagcgaactccccgagacactggagacccttctgctcctgacactgctcgccaccgtgacaggaggcatttttcttttcctgatgtccgggaagggaatcggcaagatgaccctgggcatgtgctgcattatcacggctagcatcctcctgtggtatgcccagattcagccgcattggatcgccgcttctattatccttgaatttttcctgattgtcctcctgatccctgagcccgaaaaacaaagaacaccccaggacaaccagctgacctacgtggtcatcgccattctcaccgtggttgcggccacaatggctaatgagatggggtttcttgaaaagaccaaaaaggatctgggactgggctccatcacaacgcaggagagcgagtccaacattctcgacatcgatctgcggcctgcctctgcttggaccctttatgccgtggcgacaaccttcgtgacaccgatgctgcgccacagcattgaaaattcctctgtcaacgttagcctcaccgccatcgctaatcaagccacggtgctgatggggctgggaagaggctggcccctctccaaaatggacattggggtgcctcttctggctatcggatgttacagccaggtcaaccccatcaccctgacagccgctctcctgcttctggtggcccattacgcgattatcggccctggcctccaggccaaggctacccgggaggcccagaagcgcacagctgccgggattatgaaaaatcccaccgttgatggaatcacggtgattgacctggaacctatcccgtatgatcccaagtttgagaaacaactgggccaggtcatgctccttgtgctgtgcgtcacacaggtgctgatgatgagaaccacatgggccctctgtgaagcgctgacccttgctaccgggcctatctctacactgtgggagggaaaccccggccggttctggaatacgaccattgccgtttccatggctaacatctttcgcgggagctacctcgccggagccggcctgctgttctctattatgaagaatacaaccaacacaagacggggcaccgggaatatcggagagacgctcggcgaaaaatggaagtccagacttaacgctctgggaaagagcgagtttcagatttataaaaagtctggaatccaagaagtggaccgcacactggccaaagagggcatcaagagaggggaaaccgatcaccatgcggtcagcagaggatccgccaaactccgctggttcgtggaacggaacatggttacccctgagggcaaggtggtcgacctgggctgcgggagaggaggctggtcttactattgtgggggacttaaaaatgtgcgcgaagtgaagggcctgacaaaagggggacccggccacgaggaaccgattcctatgagcacctacggctggaacctcgttcggctgcagtccggggtcgatgtgttctttacaccgcccgagaaatgcgacacgctgctctgtgatatcggagagagctcccctaatcccaccattgaagctggcagaacacttcgcgtgctgaacctggtcgagaattggctcaacaataacacccagttctgcgttaaggtgctgaatccttatatgccgtctgtgatcgagaagatggagacacttcaacggaagtacgggggagccctggtcagaaaccccctcagccgcaattccacccacgaaatgtactgggtgtctaacgctacgggcaatattgttagctccgtgaacatgatctctcggatgctgatcaatagatttaccatgaaacataagaaggccacatatgagcctgacgtcgacctggggagcggaacccgcaacattggcatcgagaacgaaattcccaatctcgatatcattggcaaaagaatcgagaagattaaacaggaacacgagacatcctggcattacgaccaggatcacccttataagacctgggcgtaccacgggagctatgaaacaaaacagaccggatctgcctccagcatggtgaacggcgttgtgaaacttctgacgaagccctgggacgtcgtgccgatggtgacacaaatggctatgaccgataccacacctttcgggcagcagcgggtctttaaagagaaggttgacacgcgcacccaggagcccaaagaaggaacaaagaaactgatgagaatcaccgccgagtggctctggaaggaactgggcaagaaaaagacacctcggatgtgtaccagagaggagttcacacggaaagtgcgctctaatgctgcccttggggctatctttaccgatgaaaacaagtggaaatccgccagagaggcggtggaagacagccggttctgggagctggtcgatcgcgaaagaaatctccatctggagggaaagtgcgagacgtgtgtgtacaacatgatgggcaaacgggaaaagaagctgggcgagtttgggaaagccaagggatctcgcgctatttggtatatgtggctcggcgccagattcctggaatttgaggctcttgggttcctgaatgaagaccactggttttcccggggaaacagcctctccggcgttgagggggagggcctgcataaacttggatacatcctgcgcgatgtgagcaagaaagaaggcggggccatgtacgccgacgacaccgcgggatgggatacaagaattaccctcgaggacctgaagaatgaagagatggtcacaaaccacatgaagggcgaacataaaaagctggctgaggccatcttcaaactcacctatcaaaataaggtggttcgggtgcagcgccccacgcctagagggacagtcatggatattatctctcggaaagaccagcgcggaagcggccaggtggggacctacggcctgaacacattcaccaatatggaggcccaacttatcagacagatggaaggagagggcatttttaagtccatccagcggctgacggttaccgaagagattgctgtgcaaaactggctcgccagagtcgggcgcgagcggctgtctagaatggctatcagcggagatgactgcgtggtcaagccccttgatgaccgcttcgcctccgcgctgacagccctcaatgatatgggcaaagtgcggaaggacattcagcagtgggaaccgtctagagggtggaacgattggacccaggttcctttttgcagccaccacttccatgagctggtgatgaaagacggacgcgtcctggtggtgccctgtcggaaccaagatgaactcatcggcagagctcgcatctcccagggggccggctggtctctgaaggagacagcttgccttggaaaaagctatgcccagatgtggaccctgatgtactttcaccggagagacctccgcctggcggccaatgctatttgttccgccgttcccagccattgggtgcctacatctcggaccacgtggtccatccacgctaagcacgaatggatgacaaccgaggacatgcttgccgtctggaacagagtgtggattcaggagaatccgtggatggaagataagacccccgttgagagctgggaagaggtgccttatctgggcaaacgggaagaccaatggtgcgggtctctcatcggactgacatccagagctacctgggccaagaacattcagacagcgatcaatcaggtccgcagcctgattggcaacgaggagtacacggattatatgccctccatgaaacggttcagaaaggaagaggaagaggccggggtgctctggtga

SEQ ID NO: 19968 - RNA, 9876 nt, synthetic construct
  misc_feature 1..9876: note = derived and/or modified CDS sequence (opt5) from DENV-2__EU687236__SS-prME
  source 1..9876: mol_type = other RNA
acagccggcgtgatcattatgctgatccccacagctatggccttccacctcacgaccagaaatggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccgttatggcggtggggatggtgagcatcctcgcctcttccctgctcaaaaatgacattcctatgacaggacccctggtcgctggcggccttctgaccgtgtgctatgttctgaccgggcggagcgccgatctcgaactggagaaggctgccgacgtgaaatgggaggatcaggccgaaatctccggaagctctcctattcttagcatcacaatttccgaggacggctctatgagcatcaagaacgaagaggaggaacacaccctgacaatcctcattcgcacggggctgctcgtcatctccggagtgttccccgtttctattccgatcaccgctgcggcctggtacctgtgggaggtgaagaaacaaagagctggcgtcctttgggatgtgccttctccccctcccgtcgggaaggccgaactggaggacggagcctatcggattaaacagcgcggcatctttggctactcccagatcggggctggagtgtataaggaaggcacattccataccatgtggcacgttacaagaggggccgtgctgatgcatcggggaaaacgcattgagccctcctgggcggatgtcaagaaggacctcatcagctacggcgggggatggaaactggagggcgaatggaaggagggcgaagaggtgcaggttcttgctctggaacctgggaaaaatccgagagccgtgcaaaccaagcccggactctttaaaacgaacaccggcacaattggggccgtctccctggatttcagccctggaacctctggctcccccatcgtggaccggaaggggaaggtggttggactctacggcaatggcgtcgtgacaagaagcggggcttatgtgtctgccattgcgcagaccgagaaatccatcgaggataaccctgaaatcgaggacgatattttccgcaagaaacggctgacaatcatggaccttcaccccggagctggcaagacgaaaagatacctgcctgccattgtccgcgaagccatcaagcgggggctgagaaccctcattctggctccgacacgcgtggttgccgctgagatggaagaggcccttcggggactgcccatcagatatcagacccctgcgattcgcgccgagcataccggccgggaaatcgtggacctcatgtgtcacgctacatttacgatgagactgctcagccccgtccgggtgcctaactacaatctgatcattatggatgaggcccacttcaccgaccccgcttccatcgccgcccgcgggtatatttctacaagagttgaaatgggcgaggctgcgggaatctttatgaccgccacaccgcctggcagccgggatcccttcccccagtccaacgctcctattatggacgaggaacgcgagatccccgaaagaagctggaactctgggcatgagtgggtgaccgattttaagggaaaaacggtctggttcgtgccttccatcaaggccggcaacgacattgccgcttgccttcggaaaaatgggaagaaagttatccaactgagcagaaagacatttgattctgaatacgtgaagacccgcgccaacgactgggatttcgtcgtgaccacagacattagcgagatgggagcgaattttcgggctgagagagtgatcgatccgcgccggtgtatgaaacccgtcattctgaccgacggcgaagagagagttatcctcgccgggcctatgcccgtgacacactcctctgccgctcagcgccggggcagaatcggacgcaaccctaagaatgaaaacgaccagtatatttacatgggcgagcccctggaaaatgatgaggactgcgcccattggaaagaggcgaagatgcttctggataacatcaataccccggaagggattatccctagcatgttcgagcccgaaagagagaaagtggacgccattgatggagaataccggctccgcggcgaggctagaaagacgtttgtcgacctgatgcggcgcggggatctgcctgtgtggctcgcctatagagttgctgccgagggaatcaactacgctgaccggagatggtgtttcgatggcattaaaaataaccaaatccttgaagagaacgtggaagtcgagatctggacaaaggagggggaacgcaagaaactgaagccccggtggctggacgccagaatttattccgatcctctcgcgctgaaagagttcaaggaatttgccgctggccgcaaatctcttaccctgaatctcatcacagagatgggacggctgcccaccttcatgacgcagaaggccagagacgctctggataacctcgccgtgcttcacaccgccgaagttggcgggcgggcttacaatcacgcgctgagcgagctgccggagacactcgaaaccctgcttctgctcacactgctggccaccgtgacaggaggcatttttctcttccttatgtccgggaagggaatcggcaaaatgaccctgggcatgtgctgcattatcacggctagcatcctgctctggtatgcccagattcagcctcattggatcgccgcttctattatcctggagtttttccttattgtcctgctcatccccgaacccgagaagcaacgcacacctcaggacaaccagctgacctacgtggtcatcgccattctgaccgtggttgcggccacaatggctaatgaaatggggtttctcgagaaaaccaagaaagaccttggactgggctccatcacaacgcaggagagcgaatccaacattctggatatcgacctcagaccggcctctgcttggaccctgtatgccgtggcgacaaccttcgtgacacccatgcttcggcacagcattgaaaatagctctgtcaacgttagcctgaccgccatcgctaatcaagccacggtgctcatggggctgggacgcggctggcctctgtccaagatggatattggggtgcccctccttgctatcggatgttacagccaggtcaaccctatcaccctgacagccgctctgctcctgcttgtggcccattacgcgattatcggccccggcctgcaggccaaggctaccagagaagcccagaaacggacagctgccgggattatgaagaatcctaccgttgacggaatcacggtgattgatctcgagccgatcccctatgaccctaaatttgaaaagcaactgggccaggtcatgctgctcgtgctttgcgtcacacaggtgctgatgatgcgcaccacatgggccctgtgtgaggcgctcaccctggctaccgggcccatctctacactttgggagggaaaccctggcagattctggaatacgaccattgccgtttccatggctaacatctttcgggggagctacctggccggagccggcctcctgttctctattatgaaaaatacaaccaacacacgcagaggcaccgggaatatcggagaaacgctgggcgagaagtggaagtcccggctcaacgctcttgggaaaagcgaatttcagatttataagaaatctggaatccaagaggtggatagaacactggccaaggagggcatcaaacgcggggaaaccgaccaccatgcggtcagccggggatccgccaagctgagatggttcgtggagcgcaacatggttacccccgaaggcaaagtggtcgatctcggctgcgggcggggaggctggtcttactattgtgggggactgaagaatgtgagagaggtgaagggccttacaaaagggggaccgggccacgaggaacctattcccatgagcacctacggctggaacctggttcgcctccagtccggggtcgacgtgttctttacaccccctgagaagtgcgatacgctgctgtgtgacatcggagaaagctcccccaatcctaccattgaggctggccggacactcagagtgcttaacctggtcgaaaattggctgaacaataacacccagttctgcgttaaagtgctcaatccgtatatgccctctgtgatcgagaagatggaaacactgcaacgcaaatacgggggagcccttgtccggaaccctctgagcagaaattccacccacgagatgtactgggtgtctaacgctacgggcaatattgttagctccgtgaacatgatctctcgcatgctcatcaatcggtttaccatgaagcataagaaagccacatatgagcccgatgtcgacctggggagcggaaccagaaacattggcatcgaaaacgagattcctaatctggacatcattggcaagcgcatcgagaagattaagcaggagcacgaaacatcctggcattacgatcaggaccacccctataaaacctgggcgtaccacgggagctatgagacaaagcagaccggatctgcctccagcatggtgaacggcgttgtgaagctccttacgaaaccgtgggatgtcgtgcctatggtgacacaaatggctatgaccgacaccacacccttcgggcagcagagagtctttaaggagaaagttgatacgcggacccaggaacctaaggagggaaccaaaaagctgatgcgcatcaccgccgaatggctgtggaaggagctcggcaaaaagaaaacacccagaatgtgtacccgggaggagttcacaaagaaagtgagatctaatgctgccctgggggctatctttaccgacgagaacaagtggaaatccgcccgggaagcggtggaggatagccgcttctgggaacttgtcgacagagagcggaatctgcatctcgagggaaagtgcgaaacgtgtgtgtacaacatgatgggcaagcgcgagaaaaagctgggcgaatttgggaaagccaagggatctagagctatttggtatatgtggctgggcgcccggttcctcgagtttgaagctctggggttccttaatgaggatcactggttttcccgcggaaacagcctgtccggcgttgagggggaaggcctccataaactgggatacatccttagagacgtgagcaagaaggagggcggggccatgtacgccgatgacaccgcgggatgggacacacggattaccctggaagatctcaaaaatgaggaaatggtcacaaaccacatgaagggcgagcataaaaagctggctgaggccatcttcaaactgacctatcaaaataaggtggttcgcgtgcagagacctacgccccgggggacagtcatggacattatctctcgcaaggatcagagaggaagcggccaggtggggacctacggcctcaacacattcaccaatatggaagcccaactgatccggcagatggagggagaaggcatttttaaatccatccagcgccttacggttaccgaggagattgctgtgcaaaactggctggccagagtcgggcgggaaagactctctcgcatggctatcagcggagacgattgcgtggtcaagccgctggacgatcggttcgcctccgcgcttacagccctgaatgacatgggcaaagtgagaaaggatattcagcagtgggagccttctcgcgggtggaacgactggacccaggttcccttttgcagccaccacttccatgaactcgtgatgaaagatggacgggtcctggtggtgccctgtagaaaccaagacgagctgatcggccgcgctcggatctcccagggggccggctggtctctcaaggaaacagcttgcctgggaaagagctatgcccagatgtggacccttatgtactttcacagacgcgatctgcggctcgcggccaatgctatttgttccgccgttcctagccattgggtgccgacatctagaaccacgtggtccatccacgctaaacacgagtggatgacaaccgaggacatgctggccgtctggaaccgcgtgtggattcaggaaaatccctggatggaggacaagacccctgttgaaagctgggaggaagtgccctatcttggcaaacgggaggatcaatggtgcgggtctctgatcggactcacatccagagctacctgggccaagaacattcagacagcgatcaatcaggtccggagcctgattggcaacgaggaatacacggactatatgccttccatgaaaagattccgcaaggaggaagaggaagccggggtgctgtggtga

SEQ ID NO: 19969 - RNA, 9876 nt, synthetic construct
  misc_feature 1..9876: note = derived and/or modified CDS sequence (opt5) from DENV-2__EU687237__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccgttatggcggtggggatggtgagcatcctcgcctcttccctgctcaaaaatgacattcctatgacaggacccctggtcgctggcggccttctgaccgtgtgctatgttctgaccgggcggagcgccgatctcgaactggagcgcgctgccgacgtgaagtgggaggatcaggccgaaatctccggaagctctcctattcttagcatcacaatttccgaggacggctctatgagcatcaaaaacgaagaggaggaacacaccctgacaatcctcattagaacggggctgctcgtcatctccggagtgttccccgtttctattccgatcaccgctgcggcctggtacctgtgggaggtgaagaagcaacgggctggcgtcctttgggatgtgccttctccccctcccgtcgggaaagccgaactggaggacggagcctatcgcattaagcagagaggcatctttggctactcccagatcggggctggagtgtataaagaaggcacattccataccatgtggcacgttacaagaggggccgtgctgatgcatcgcggaaagagaattgagccctcctgggcggatgtcaaaaaggacctcatcagctacggcgggggatggaagctggagggcgaatggaaagagggcgaagaggtgcaggttcttgctctggaacctgggaagaatccgcgggccgtgcaaaccaaacccggactctttaagacgaacaccggcacaattggggccgtctccctggatttcagccctggaacctctggctcccccatcgtggacagaaaagggaaggtggttggactctacggcaatggcgtcgtgacacgcagcggggcttatgtgtctgccattgcgcagaccgagaagtccatcgaggataaccctgaaatcgaggacgatattttccggaaaaagagactgacaatcatggaccttcaccccggagctggcaaaacgaagcgctacctgcctgccattgtccgggaagccatcaaaagagggctgcgcaccctcattctggctccgacacgggtggttgccgctgagatggaagaggcccttagaggactgcccatccgctatcagacccctgcgattcgggccgagcataccggcagagaaatcgtggacctcatgtgtcacgctacatttacgatgcggctgctcagccccgtccgcgtgcctaactacaatctgatcattatggatgaggcccacttcaccgaccccgcttccatcgccgccagagggtatatttctacacgggttgaaatgggcgaggctgcgggaatctttatgaccgccacaccgcctggcagccgcgatcccttcccccagtccaacgctcctattatggacgaggaaagagagatccccgaacggagctggaactctgggcatgagtgggtgaccgattttaagggaaagacggtctggttcgtgccttccatcaaagccggcaacgacattgccgcttgccttagaaagaatgggaaaaaggttatccaactgagccgcaaaacatttgattctgaatacgtgaagacccgggccaacgactgggatttcgtcgtgaccacagacattagcgagatgggagcgaattttagagctgagcgcgtgatcgatccgcggagatgtatgaagcccgtcattctgaccgacggcgaggaacgcgttatcctcgccgggcctatgcccgtgacacactcctctgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaataccccggaagggattatccctagcatgttcgagcccgaacgggagaaggtggacgccattgatggagaataccgcctcagaggcgaggctcggaaaacgtttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacaaaagagggggaacggaagaagctgaaacccagatggctggacgcccgcatttattccgatcctctcgcgctgaaggagttcaaagaatttgccgctggccggaagtctcttaccctgaatctcatcacagagatgggaagactgcccaccttcatgacgcagaaagcccgggacgctctggataacctcgccgtgcttcacaccgccgaagttggcgggcgcgcttacaatcacgcgctgagcgagctgccggagacactcgaaaccctgcttctgctcacactgctggccaccgtgacaggaggcatttttctcttccttatgtccgggaagggaatcggcaagatgaccctgggcatgtgctgcattatcacggctagcatcctgctctggtatgcccagattcagcctcattggatcgccgcttctattatcctggagtttttccttattgtcctgctcatccccgaacccgagaaacaaagaacacctcaggacaaccagctgacctacgtggtcatcgccattctgaccgtggttgcggccacaatggctaatgaaatggggtttctcgagaagaccaaaaaggaccttggactgggctccatcacaacgcaggagagcgaatccaacattctggatatcgacctccggccggcctctgcttggaccctgtatgccgtggcgacaaccttcgtgacacccatgcttcgccacagcattgaaaatagctctgtcaacgttagcctgaccgccatcgctaatcaagccacggtgctcatggggctgggaagaggctggcctctgtccaaaatggatattggggtgcccctccttgctatcggatgttacagccaggtcaaccctatcaccctgacagccgctctgctcctgcttgtggcccattacgcgattatcggccccggcctgcaggccaaggctacccgggaagcccagaagcgcacagctgccgggattatgaaaaatcctaccgttgacggaatcacggtgattgatctcgagccgatcccctatgaccctaagtttgaaaaacaactgggccaggtcatgctgctcgtgctttgcgtcacacaggtgctgatgatgagaaccacatgggccctgtgtgaggcgctcaccctggctaccgggcccatctctacactttgggagggaaaccctggccggttctggaatacgaccattgccgtttccatggctaacatctttcgcgggagctacctggccggagccggcctcctgttctctattatgaagaatacaaccaacacaagacggggcaccgggaatatcggagaaacgctgggcgagaaatggaagtccagactcaacgctcttggaaagagcgaatttcagatttataaaaagtctggaatccaagaggtggatcgcacactggccaaagagggcatcaagagaggggaaaccgaccaccatgcggtcagcagaggatccgccaaactgcgctggttcgtggagcggaacatggttacccccgaaggcaaggtggtcgatctcggctgcgggagaggaggctggtcttactattgtgggggactgaaaaatgtgcgcgaggtgaagggccttacaaaagggggaccgggccacgaggagcctattcccatgagcacctacggctggaacctggttcggctccagtccggggtcgacgtgttctttacaccccctgagaaatgcgatacgctgctgtgtgacatcggagaaagctcccccaatcctaccattgaggctggcagaacactccgcgtgcttaacctggtcgaaaattggctgaacaataacacccagttctgcgttaaggtgctcaatccgtatatgccctctgtgatcgagaaaatggaaacactgcaacggaagtacgggggagcccttgtcagaaaccctctgagccgcaattccacccacgagatgtactgggtgtctaacgctacgggcaatattgttagctccgtgaacatgatctctcggatgctcatcaatagatttaccatgaaacataagaaggccacatatgagcccgatgtcgacctggggagcggaacccgcaacattggcatcgaaaacgagattcctaatctggacatcattggcaaaagaatcgaaaagattaaacaggagcacgaaacatcctggcattacgatcaggaccacccctataagacctgggcgtaccacgggagctatgagacaaaacagaccggatctgcctccagcatggtgaacggcgttgtgaagctccttacgaagccgtgggatgtcgtgcctatggtgacacaaatggctatgaccgacaccacacccttcgggcagcagcgggtctttaaagagaaggttgatacgcgcacccaggaacctaaagagggaacaaagaaactgatgagaatcaccgccgaatggctgtggaaggagctcggcaagaaaaagacaccccggatgtgtaccagagaggagttcacacggaaagtgcgctctaatgctgccctgggggctatctttaccgacgagaacaagtggaaatccgccagagaagcggtggaggatagccggttctgggaacttgtcgaccgcgagagaaatctgcatctcgagggaaagtgcgaaacgtgtgtgtacaacatgatgggcaaacgggagaagaagctgggcgaatttgggaaagccaagggatctcgcgctatttggtatatgtggctgggcgccagattcctcgagtttgaagctctggggttccttaatgaggatcactggttttcccggggaaacagcctgtccggcgttgagggggaaggcctccataaactgggatacatccttcgcgacgtgagcaagaaagagggcggggccatgtacgccgatgacaccgcgggatgggacacaagaattaccctggaagatctcaagaatgaggaaatggtcacaaaccacatgaagggcgagcataaaaagctggctgaggccatcttcaaactgacctatcaaaataaggtggttcgggtgcagcgccctacgcccagagggacagtcatggacattatctctcggaaagatcagcgcggaagcggccaggtggggacctacggcctcaacacattcaccaatatggaagcccaactgatcagacagatggagggagaaggcatttttaagtccatccagcggcttacggttaccgaggagattgctgtgcaaaactggctggccagagtcgggcgcgaacggctctctagaatggctatcagcggagacgattgcgtggtcaagccgctggacgatcgcttcgcctccgcgcttacagccctgaatgacatgggcaaagtgcggaaggatattcagcagtgggagccttctagagggtggaacgactggacccaggttcccttttgcagccaccacttccatgaactcgtgatgaaagatggacgcgtcctggtggtgccctgtcggaaccaagacgagctgatcggcagagctcgcatctcccagggggccggctggtctctcaaggaaacagcttgcctgggaaaaagctatgcccagatgtggacccttatgtactttcaccggagagatctgcgcctcgcggccaatgctatttgttccgccgttcctagccattgggtgccgacatctcggaccacgtggtccatccacgctaagcacgagtggatgacaaccgaggacatgctggccgtctggaacagagtgtggattcaggaaaatccctggatggaggacaagacccctgttgaaagctgggaggaagtgccctatcttggcaaacgggaggatcaatggtgcgggtctctgatcggactcacatccagagctacctgggccaagaacattcagacagcgatcaatcaggtccgcagcctgattggcaacgaggaatacacggactatatgccttccatgaaacggttcagaaaggaggaagaggaagccggggtgctgtggtga

SEQ ID NO: 19970 - RNA, 9876 nt, synthetic construct
  misc_feature 1..9876: note = derived and/or modified CDS sequence (opt5) from DENV-2__EU687238__SS-prME
  source 1..9876: mol_type = other RNA
accgccggagtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcaccatcacctggattggaatgaacagccggtccacaagcctttctgtgtccctcgtgctggttggcgtcgtgaccctgtatctcggggtgatggtccaggccgacacaggatgtgtggttagctggaagaataaagaactgaagtgcggctctgggatcttcattacggataacgtgcacacctggacagagcagtacaagtttcagcctgaatcccccagcaaacttgcctccgctatccaaaaggcccatgaggaaggcatttgtggaatcagatctgtcacccgcctggagaatctcatgtggaaacagatcacaccggagctgaaccacattctgagcgaaaatgaggtgaaacttaccatcatgacgggcgacattaaagggatcatgcaggctggaaagcggtccctcagacctcagcccaccgaactgaaatattcttggaagacatggggcaaggccaaaatgctgagcaccgagtcccataaccaaacattcctcattgatgggcctgaaaccgcggagtgccccaatacaaaccgcgcctggaatagcctggaggttgaagactacggatttggcgtgttctctaccaacatctggcttaagctgcgggagaaacaggacgtcttttgtgattccaagctcatgagcgctgccatcaaagacaatagagctgtgcacgccgatatgggctattggattgaatctgcgctgaacgacacgtggaagatggagaaggcctccttcatcgagattaaaagctgccactggcctaagtctcatacactgtggagcaatggggttcttgaatccgagatgatcattcccaaaaacttcgctggaccggtgagccagcacaactaccgccctggctatcatacccagaccgccgggccctggcacctcggaaagctggaaatggattttgacttctgtgagggcacaaccgtcgtggtgacggaagattgcgggaatcggggaccctctctgagaacaaccacagcttccggcaaactcatcaccgagtggtgctgtcggagctgcacactgcctccgcttcgctacagaggcgaggacgggtgttggtacggaatggaaattcggcccctgaaggagaaggaagagaacctcgtcaattccctggttaccgccggccatgggcaaatcgataacttttctctgggagtgcttggcatggccctcttcctggaagagatgctgagaacgcgcgtggggaccaaacacgctatcctcctggtcgcggtgagctttgttacacttattaccggaaatatgtccttccgggacctgggcagagtgatggtcatggtgggcgccacaatgaccgatgacatcgggatgggagttacgtatctcgctctgctggccgcctttaaggtgcgccctacattcgctgccggccttctgctcagaaaactgacctctaaggagctcatgatggcgacaattgggatcgctctgcttagccagtccaccattcccgaaaccatcctggagctcacagatgccctggccctgggaatgatggtccttaaaatcgtgcggaacatggaaaagtaccagctggctgttacgattatggccatctcttgcgtgcctaatgcggtcattctccaaaacgcttggaaggtgagctgtaccatcctggccgccgtgtccgtcagccccctcctgcttacatcttcccagcagaaagctgactggattcctctggccctcaccatcaagggcctgaatcccacagctatctttctgaccacgcttagccgcacatctaaaaagagatcctggccgctgaacgaggccgttatggcggtggggatggtgagcattctcgcctcttccctgctcaaaaatgacatccctatgaccggacccctggtcgctggcggccttctgaccgtgtgctatgttctgacagggcggagcgccgatctcgaactggagcgcgctgccgacgtgaagtgggaggatcaggccgaaatttccggaagctctcctatccttagcattaccatctccgaggacggctctatgagcattaaaaacgaagaggaggaacacacactgacgatcctcatcagaaccgggctgctcgtcatttccggagtgttccccgtttctatcccgattacagctgcggcctggtacctgtgggaggtgaagaagcaacgggctggcgtcctttgggatgtgccttctccccctcccgtcgggaaagccgaactggaggacggagcctatcgcatcaagcagagaggcatttttggctactcccagatcggggctggagtgtataaagaaggcaccttccatacaatgtggcacgttaccagaggggccgtgctgatgcatcgcggaaagagaatcgagccctcctgggcggatgtcaaaaaggacctcattagctacggcgggggatggaagctggagggcgaatggaaagagggcgaagaggtgcaggttcttgctctggaacctgggaagaatccgcgggccgtgcaaacgaaacccggactctttaagaccaacacaggcaccatcggggccgtctccctggatttcagccctggaacatctggctcccccattgtggacagaaaagggaaggtggttggactctacggcaatggcgtcgtgacccgcagcggggcttatgtgtctgccatcgcgcagacagagaagtccattgaggataaccctgaaatcgaggacgatatcttccggaaaaagagactgacgattatggaccttcaccccggagctggcaaaaccaagcgctacctgcctgccatcgtccgggaagccattaaaagagggctgcgcacactcatcctggctccgacccgggtggttgccgctgagatggaagaggcccttagaggactgcccattcgctatcagacccctgcgatccgggccgagcatacaggcagagaaattgtggacctcatgtgtcacgctacgtttaccatgcggctgctcagccccgtccgcgtgcctaactacaatctgatcatcatggatgaggcccacttcacagaccccgcttccattgccgccagagggtatatctctacccgggttgaaatgggcgaggctgcgggaatttttatgacagccaccccgcctggcagccgcgatcccttcccccagtccaacgctcctatcatggacgaggaaagagagattcccgaacggagctggaactctgggcatgagtgggtgacggattttaagggaaagacagtctggttcgtgccttccatcaaagccggcaacgacatcgccgcttgccttagaaagaatgggaaaaaggttattcaactgagccgcaaaacctttgattctgaatacgtgaagacccgggccaacgactgggatttcgtcgtgacaaccgacatcagcgagatgggagcgaattttagagctgagcgcgtgattgatccgcggagatgtatgaagcccgtcatcctgacagacggcgaggaacgcgttattctcgccgggcctatgcccgtgacccactcctctgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacgccggaagggatcattcctagcatgttcgagcccgaacgggagaaggtggacgccatcgatggagaataccgcctcagaggcgaggctcggaaaacatttgtcgacctgatgcgcagaggggatctgcctgtgtggctcgcctatcgggttgctgccgagggaattaactacgctgacagacgctggtgtttcgatggcatcaagaataaccaaattcttgaagagaacgtggaagtcgagatctggaccaaagagggggaacggaagaagctgaaacccagatggctggacgcccgcatctattccgatcctctcgcgctgaaggagttcaaagaatttgccgctggccggaagtctcttacactgaatctcattaccgagatgggaagactgcccacgttcatgacccagaaagcccgggacgctctggataacctcgccgtgcttcacacagccgaagttggcgggcgcgcttacaatcacgcgctgagcgagctgccggagaccctcgaaacactgcttctgctcaccctgctggccacagtgaccggaggcatctttctcttccttatgtccgggaagggaattggcaagatgacgctgggcatgtgctgcatcattacagctagcatcctgctctggtatgcccagatccagcctcattggattgccgcttctatcattctggagtttttccttatcgtcctgctcattcccgaacccgagaaacaaagaacccctcaggacaaccagctgacctacgtggtcatcgccatcctgacagtggttgcggccaccatggctaatgaaatggggtttctcgagaagaccaagaaggaccttggactgggctccattacgacccaggagagcgaatccaacatcctggatattgacctccggccggcctctgcttggacactgtatgccgtggcgaccacattcgtgacccccatgcttcgccacagcatcgaaaatagctctgtcaacgttagcctgacggccattgctaatcaagccaccgtgctcatggggctgggaagaggctggcctctgtccaaaatggatatcggggtgcccctccttgctattggatgttacagccaggtcaaccctatcacactgaccgccgctctgctcctgcttgtggcccattacgcgatcattggccccggcctgcaggccaaggctacacgggaagcccagaagcgcaccgctgccgggatcatgaaaaatcctacggttgacggaattacagtgatcgatctcgagccgattccctatgaccctaagtttgaaaaacaactgggccaggtcatgctgctcgtgctttgcgtcacccaggtgctgatgatgagaacaacctgggccctgtgtgaggcgctcaccctggctacagggcccatctctacgctttgggagggaaaccctggccggttctggaataccacaatcgccgtttccatggctaacatttttcgcgggagctacctggccggagccggcctcctgttctctatcatgaagaataccacaaacaccagacggggcacggggaatattggagaaacactgggcgagaaatggaagtccagactcaacgctcttggaaagagcgaatttcagatctataaaaagtctggcattcaagaggtggatcgcaccctggccaaagagggcatcaagagaggggaaaccgaccaccatgcggtcagcagaggatccgccaaactgcgctggttcgtggagcggaacatggttacacccgaaggcaaggtggtcgatctcggctgcgggagaggaggctggtcttactattgtgggggactgaaaaatgtgcgcgaggtgaagggccttaccaaagggggaccgggccacgaggagcctatccccatgagcacatacggctggaacctggttcggctccagtccggggtcgacgtgttctttacgccccctgagaaatgcgataccctgctgtgtgacattggagaaagctcccccaatcctacaatcgaggctggcagaaccctccgcgtgcttaacctggtcgaaaattggctgaacaataacacacagttctgcgttaaggtgctcaatccgtatatgccctctgtgattgagaaaatggaaaccctgcaacggaagtacgggggagcccttgtcagaaaccctctgagccgcaattccacgcacgagatgtactgggtgtctaacgctaccggcaatatcgttagctccgtgaacatgatttctcggatgctcatcaatagatttacaatgaaacataagaaggccacctatgagcccgatgtcgacctggggagcggaacacgcaacatcggcattgaaaacgagatccctaatctggacattatcggcaaaagaattgaaaagatcaaacaggagcacgaaacctcctggcattacgatcaggaccacccctataagacatgggcgtaccacgggagctatgagaccaaacagacgggatctgcctccagcatggtgaacggcgttgtgaagctccttacaaagccgtgggatgtcgtgcctatggtgacccaaatggctatgaccgacacaacgcccttcgggcagcagcgggtctttaaagagaaggttgatacccgcacacaggaacctaaagagggaaccaagaaactgatgagaattacagccgaatggctgtggaaggagctcggcaagaaaaagacaccccggatgtgtacaagagaggagttcacccggaaagtgcgctctaatgctgccctgggggctatctttacggacgagaacaagtggaaatccgccagagaagcggtggaggatagccggttctgggaacttgtcgaccgcgagagaaatctgcatctcgagggaaagtgcgaaacctgtgtgtacaacatgatgggcaaacgggagaagaagctgggcgaatttgggaaagccaagggatctcgcgctatctggtatatgtggctgggcgccagattcctcgagtttgaagctctggggttccttaatgaggatcactggttttcccggggaaacagcctgtccggcgttgagggggaaggcctccataaactgggatacattcttcgcgacgtgagcaagaaagagggcggggccatgtacgccgatgacacagcgggatgggacaccagaatcacactggaagatctcaagaatgaggaaatggtcaccaaccacatgaagggcgagcataaaaagctggctgaggccattttcaaactgacgtatcaaaataaggtggttcgggtgcagcgccctacacccagagggaccgtcatggacatcatttctcggaaagatcagcgcggaagcggccaggtggggacatacggcctcaacaccttcacgaatatggaagcccaactgatcagacagatggagggagaaggcatctttaagtccattcagcggcttaccgttacagaggagatcgctgtgcaaaactggctggccagagtcgggcgcgaacggctctctagaatggctattagcggagacgattgcgtggtcaagccgctggacgatcgcttcgcctccgcgcttaccgccctgaatgacatgggcaaagtgcggaaggatatccagcagtgggagccttctagagggtggaacgactggacacaggttcccttttgcagccaccacttccatgaactcgtgatgaaagatggacgcgtcctggtggtgccctgtcggaaccaagacgagctgattggcagagctcgcatctcccagggggccggctggtctctcaaggaaaccgcttgcctgggaaaaagctatgcccagatgtggacacttatgtactttcaccggagagatctgcgcctcgcggccaatgctatctgttccgccgttcctagccattgggtgccgacctctcggacgacatggtccattcacgctaagcacgagtggatgaccaccgaggacatgctggccgtctggaacagagtgtggatccaggaaaatccctggatggaggacaagacacctgttgaaagctgggaggaagtgccctatcttggcaaacgggaggatcaatggtgcgggtctctgattggactcacctccagagctacatgggccaagaacatccagacggcgattaatcaggtccgcagcctgatcggcaacgaggaatacaccgactatatgccttccatgaaacggttcagaaaggaggaagaggaagccggggtgctgtggtga

SEQ ID NO: 19971 - RNA, 9876 nt, synthetic construct
  misc_feature 1..9876: note = derived and/or modified CDS sequence (opt5) from DENV-2__EU687240__SS-prME
  source 1..9876: mol_type = other RNA
accgtgggcgtcatcattatgctgatccccaccgccatggctttccacctcacgacccggaatggggagcctcatatgattgttggacggcaggaaaagggcaagagcctgctttttaagacggaggacggggtgaatatgtgcaccctgatggccatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtcgcgctcgtgcctcatgttggaatgggcctggagaccagaacggaaacatggatgtcctctgagggcgcttggaagcacgtgcagcggatcgagacctggattctgcgccatcccgggttcacaatcatggccgccattctcgcttacaccatcggaaccacacactttcagagagccctgattttcatccttctgacggctgtcgcccctagcatgaccatgcggtgcattggcatctccaaccgcgattttgtggaaggggtttctggaggcagctgggtggacatcgtcctcgagcacgggtcctgtgtgacaaccatggcgaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtcacatgcgctatgtttacgtgcaaaaagaatatggaaggcaaagttgtgctccctgagaacctggaatacaccattgtgatcacaccccacagcggggaggagcatgccgtcggaaatgacaccggcaagcacggcaaagaaatcaagattacacctcagtcttccatcaccgaggcggaacttacggggtatggaaccgtgacaatggagtgtagcccccggaccggcctggatttcaacgaaatggttctcctgcagatggaggacaaagcctggcttgtgcaccgccaatggtttctggatctcccgctgccttggctgcccggggctgacacacagggatctaattggattcagaaggagaccctcgtcacgttcaagaaccctcatgccaaaaagcaggacgtggttgtgctgggctcccaagaaggggctatgcacacagcccttaccggcgccacagagatccagatgagctccggaaatctgctctttaccggccatctgaaatgcagacttcggatggataagctgcagctcaaagggatgtcttacagcatgtgtaccggaaagttcaagattgtcaaagaaatcgctgagacacaacacggcacgatcgtgattagagtccagtatgagggggacggatccccctgcaagatccccttcgaaattatggatctggagaaacgccatgtgctgggccggctcatcaccgttaaccctattgtgacagaaaaggacagcccggtcaacatcgaggcggaacccccttttggggattcttacattatcatcggcgtggagcccggacagctgaaacttaattggttcaagaagggctccagcattgggcagatgtttgagaccacaatgagaggagccaaacgcatggctatcctgggcgacaccgcctgggatttcgggtctctcggaggcgtttttacgagcattgggaaggccctgcaccaagtgttcggcgctatctacggagccgcgttttccggcgtctcttggacaatgaaaattctgatcggggtgatcattacctggatcggaatgaacagccggtccaccagcctttctgtgtccctcgttctggtcggcgtggtgacactgtatctcggggtcatggtgcaggctgacagcggatgtgttgtgtcttggaagaataaagaactgaagtgcggctccgggattttcatcaccgataacgtccacacatggacggagcagtacaagtttcagcctgaaagcccctccaaacttgcctctgccattcaaaaggctcatgaggaaggcatctgtggaatcagaagcgtgacccgcctggagaatctcatgtggaaacagattacaccggagctgaaccacatcctgtccgaaaatgaggccaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgagatcaaatcttgccactggcctaagagccataccctgtggtccaatggggttcttgaaagcgagatgattatccccaaaaacttcgctggaccggtgtctcagcacaactaccgccctggctatcatacgcagacagccgggccctggcacctcggaaagctggaaatggattttgacttctgtgagggcaccaccgtcgtggtgacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgtcaattctctggttaccgccggccatgggcaaatcgataactttagcctgggagtgcttggcatggccctcttcctggaagagatgctgagaacacgcgtggggaccaaacacgctattctcctggtcgcggtgtcctttgttacgcttatcaccggaaatatgtctttccgggacctgggcagagtgatggtcatggtgggcgccacaatgaccgatgacattgggatgggagttacatatctcgctctgctggccgcctttaaggtgcgccctaccttcgctgccggccttctgctcagaaaactgacgagcaaggagctcatgatggcgacaatcgggattgctctgctttcccagtctaccatccccgaaacaatcctggagctcaccgatgccctggccctgggaatgatggtccttaaaattgtgcggaacatggaaaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaagggcctgaatcccacagctatttttctgaccacactttctcgcacctccaaaaagagaagctggccgctgaacgaggccgttatggcggtggggatggtgtctatcctcgcctccagcctgctcaaaaatgacattcctatgacgggacccctggtcgctggcggccttctgacagtgtgctatgttctgaccgggcggtccgccgatctcgaactggagcgcgctgccgacgtgaagtgggaggatcaggccgaaatcagcggatctagccctattctttccatcaccatttctgaggacggcagcatgtccatcaaaaacgaagaggaggaacacacactgaccatcctcattagaacagggctgctcgtcatctctggagtgttccccgttagcattccgatcacggctgcggcctggtacctgtgggaggtgaagaagcaacgggctggcgtcctttgggatgtgccttctccccctcccgtcgggaaagccgaactggaggacggagcctatcgcattaagcagagaggcatctttggctacagccagatcggggctggagtgtataaagaaggcaccttccatacaatgtggcacgttaccagaggggccgtgctgatgcatcgcggaaagagaattgagcccagctgggcggatgtcaaaaaggacctcatctcctacggcgggggatggaagctggagggcgaatggaaagagggcgaagaggtgcaggttcttgctctggaacctgggaagaatccgcgggccgtgcaaacaaaacccggactctttaagaccaacacgggcaccattggggccgtcagcctggatttctctcctggaacatccggcagccccatcgtggacagaaaagggaaggtggttggactctacggcaatggcgtcgtgacccgctctggggcttatgtgtccgccattgcgcagacagaaaagagcatcgaggataaccctgaaatcgaggacgatattttccggaaaaagagactgaccatcatggaccttcaccccggagctggcaaaacaaagcgctacctgcctgccattgtccgggaagccatcaaaagagggctgcgcacgctcattctggctccgacccgggtggttgccgctgagatggaagaggcccttagaggactgcccatccgctatcagacccctgcgattcgggccgagcataccggcagagaaatcgtggacctcatgtgtcacgctacctttacaatgcggctgctctcccccgtccgcgtgcctaactacaatctgatcattatggatgaggcccacttcacggaccccgcttctatcgccgccagagggtatattagcacccgggttgaaatgggcgaggctgcgggaatctttatgacagccaccccgcctggctcccgcgatcccttcccccagagcaacgctcctattatggacgaggaaagagagatccccgaacggtcttggaactccgggcatgagtgggtgacagattttaagggaaagaccgtctggttcgtgcctagcatcaaagccggcaacgacattgccgcttgccttagaaagaatgggaaaaaggttatccaactgtctcgcaaaacgtttgatagcgaatacgtgaagacacgggccaacgactgggatttcgtcgtgaccaccgacatttccgagatgggagcgaattttagagctgagcgcgtgatcgatccgcggagatgtatgaagcccgtcattctgacagacggcgaggaacgcgttatcctcgccgggcctatgcccgtgacccactctagcgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaatacaccggaagggattatcccttccatgttcgagcccgaacgggagaaggtggacgccattgatggagaataccgcctcagaggcgaggctcggaaaacctttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacgaaagagggggaacggaagaagctgaaacccagatggctggacgcccgcatttattctgatcctctcgcgctgaaggagttcaaagaatttgccgctggccggaagtcccttacactgaatctcatcaccgagatgggaagactgcccacattcatgacccagaaagcccgggacgctctggataacctcgccgtgcttcacacggccgaagttggcgggcgcgcttacaatcacgcgctgtccgagctgccggagaccctcgaaacactgcttctgctcaccctgctggccacagtgaccggaggcatttttctcttccttatgagcgggaagggaatcggcaagatgacactgggcatgtgctgcattatcaccgcttctatcctgctctggtatgcccagattcagcctcattggatcgccgcttccattatcctggagtttttccttattgtcctgctcatccccgaacccgagaaacaaagaacgcctcaggacaaccagctgacatacgtggtcatcgccattctgaccgtggttgcggccaccatggctaatgaaatggggtttctcgagaagaccaagaaggaccttggactgggcagcatcaccacacaggagtccgaatctaacattctggatatcgacctccggccggccagcgcttggacgctgtatgccgtggcgaccacattcgtgacccccatgcttcgccactccattgaaaattctagcgtcaacgtttccctgacagccatcgctaatcaagccaccgtgctcatggggctgggaagaggctggcctctgagcaaaatggatattggggtgcccctccttgctatcggatgttactctcaggtcaaccctatcacgctgaccgccgctctgctcctgcttgtggcccattacgcgattatcggccccggcctgcaggccaaggctacacgggaagcccagaagcgcaccgctgccgggattatgaaaaatcctacagttgacggaatcaccgtgattgatctcgagccgatcccctatgaccctaagtttgaaaaacaactgggccaggtcatgctgctcgtgctttgcgtcacacaggtgctgatgatgagaacaacctgggccctgtgtgaggcgctcacactggctaccgggcccatctccaccctttgggagggaaaccctggccggttctggaatacaacgattgccgttagcatggctaacatctttcgcgggtcttacctggccggagccggcctcctgttctccattatgaagaataccacaaacaccagacggggcacagggaatatcggagaaaccctgggcgagaaatggaaaagcagactcaacgctcttgggaagtctgaatttcagatttataaaaagagcggaatccaagaggtggatcgcacgctggccaaagagggcatcaagagaggggaaacagaccaccatgcggtctccagaggatctgccaaactgcgctggttcgtggagcggaacatggttacccccgaaggcaaggtggtcgatctcggctgcgggagaggaggctggagctactattgtgggggactgaaaaatgtgcgcgaggtgaagggccttaccaaagggggaccgggccacgaggagcctattcccatgtccacatacggctggaacctggttcggctccagagcggggtcgacgtgttctttacaccccctgagaaatgcgatacactgctgtgtgacatcggagaatcctctcccaatcctacgattgaggctggcagaaccctccgcgtgcttaacctggtcgaaaattggctgaacaataacacacagttctgcatcaaggttctcaatccgtatatgcccagcgtgattgagaaaatggaaaccctgcaacggaagtacgggggagcccttgtgagaaaccctctgtcccgcaattctacacacgagatgtactgggtcagcaacgctaccggcaatatcgtgtcctctgttaacatgatcagccggatgctcattaatagatttacgatgaaacataagaaggccacctatgagcccgatgtggacctggggtccggaacacgcaacatcggcattgaaaacgagatccctaatctggacattatcggcaaaagaattgaaaagatcaaacaggagcacgaaaccagctggcattacgatcaggaccacccctataagacatgggcgtaccacgggtcttatgagaccaaacagacaggatccgccagctctatggtcaacggcgtggttaagctccttaccaagccgtgggatgtggtccctatggtgacgcaaatggctatgacagacaccacccccttcgggcagcagcgggtgtttaaagagaaggtcgatacacgcacgcaggaacctaaagagggaaccaagaaactgatgagaatcacagccgaatggctgtggaaggagctcggcaagaaaaagacaccccggatgtgtacaagagaggagttcacccggaaagttcgctccaatgctgccctgggggctatttttacagacgagaacaagtggaaaagcgccagagaagcggtggaggattctcggttctgggaacttgtggaccgcgagagaaatctgcatctcgagggaaagtgcgaaacctgtgtctacaacatgatgggcaaacgggagaagaagctgggcgaatttgggaaagccaagggatcccgcgctatctggtatatgtggctgggcgccagattcctcgagtttgaagctctggggttccttaatgaggatcactggtttagccggggaaactccctgagcggcgtggagggggaaggcctccataaactgggatacattcttcgcgacgtttctaagaaagagggcggggccatgtacgccgatgacacggcgggatgggacaccagaatcacactggaagatctcaagaatgaggaaatggtgaccaaccacatgaagggcgagcataaaaagctggctgaggccattttcaaactgacatatcaaaataaggtcgtgcgggttcagcgccctacccccagagggacggtgatggacatcatcagccggaaagatcagcgcggatccggccaggtcgggacatacggcctcaacaccttcacaaatatggaagcccaactgattagacagatggagggagaaggcatctttaagtctattcagcggcttaccgtgacggaggagatcgctgttcaaaactggctggccagagtggggcgcgaacggctcagcagaatggctatttccggagacgattgcgtcgtgaagccgctggacgatcgcttcgcctctgcgcttaccgccctgaatgacatgggcaaagtccggaaggatatccagcagtgggagcctagcagagggtggaacgactggacacaggtgcccttttgctcccaccacttccatgaactcgttatgaaagatggacgcgtgctggtcgtgccctgtcggaaccaagacgagctgatcggcagagctcgcatttctcagggggccggctggagcctcaaggaaaccgcttgcctgggaaaatcctatgcccagatgtggacacttatgtactttcaccggagagatctgcgcctcgcggccaatgctatctgtagcgccgtgccttctcattgggttccgacctcccggacaacctggagcattcacgctaagcacgagtggatgacgacagaggacatgctggccgtgtggaacagagtctggatccaggaaaatccctggatggaggacaagacccctgtggaatcttgggaggaagttccctatcttggcaaacgggaggatcaatggtgcgggtccctgattggactcaccagcagagctacatgggccaagaacatccagaccgcgattaatcaggtgcgctccctgatcggcaacgaggaatacacagactatatgccttctatgaaacggttcagaaaggaggaagaggaagccggggtcctgtggtga

SEQ ID NO: 19972 - RNA, 9876 nt, synthetic construct
  misc_feature 1..9876: note = derived and/or modified CDS sequence (opt5) from DENV-2__EU687241__SS-prME
  source 1..9876: mol_type = other RNA
accgccggagtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacagcatcggaaccacccactttcagagagctctgattttcatccttctgacagccgtggcgccttccatgacgatgcggtgcattggcatctctaaccgcgattttgtcgaaggggtgagcggaggctcctgggttgacatcgtgctcgagcacgggagctgtgtcaccacaatggccaagaataagcccaccctggatttcgaacttacaaaaaccgaggctaagcagcctgccacgctgagaaaatattgcattgaagctaagctcacaaacaccaccacagagtctcggtgtccgacccaaggagagccctccctgaatgaagaacaggacaaacgctttatctgcaagcatagcatggtggatagaggctggggcaacgggtgtggactgttcggcaaagggggaattgtgacatgcgccatgtttacgtgcaaaaagaatatggaaggcaaagtcgttctccctgagaacctggaatacaccatcgtgattacaccccactctggggaggagcatgcggtgggaaatgacaccggcaagcacggcaaagaaatcaagatcacacctcagtccagcattaccgaggccgaacttacggggtatggaaccgtcacaatggagtgttctccccggaccggcctggatttcaacgaaatggtgctcctgcagatggaggacaaggcttggcttgttcaccgccaatggtttctggatctcccgctgccttggctgcccggggccgacacacagggatccaattggatccagaaggagaccctcgtgacgttcaagaaccctcatgctaaaaagcaggacgtcgtggttctgggcagccaagaaggggccatgcacacagcccttaccggcgctacagagattcagatgtcctctggaaatctgctctttaccggccatctgaaatgcagacttcggatggataagctgcagctcaaagggatgagctactccatgtgtaccggaaagttcaagatcgtgaaagaaattgcggagacacaacacggcacgatcgtcatcagagtgcagtatgagggggacggaagcccctgcaagattcccttcgaaatcatggatctggagaaacgccatgtcctgggccggctcattaccgtgaaccctatcgttacagaaaaggactctccggtgaacattgaggccgaacccccttttggggattcctacatcattatcggcgtcgagcccggacagctgaaacttaattggttcaagaagggcagctctatcgggcagatgtttgagaccacaatgagaggagctaaacgcatggccattctgggcgacaccgcctgggatttcgggagcctcggaggcgtgtttacgtccatcgggaaggctctgcaccaagttttcggcgccatttacggagcggctttttctggcgtgagctggacaatgaaaatcctgattggggtcatcatcacctggattggaatgaactcccggagcacctctctttccgtgagcctcgtgctggttggcgtcgtgacactgtatctcggggtgatggtccaggccgacaccggatgtgtggtttcttggaagaataaagaactgaagtgcggctccgggatcttcattacagataacgtgcacacgtggaccgagcagtacaagtttcagcctgaaagcccctccaaacttgcctctgctatccaaaaggcccatgaggaaggcatttgtggaatcagaagcgtcacacgcctggagaatctcatgtggaaacagatcaccccggagctgaaccacattctgtccgaaaatgaggtgaaacttacaatcatgaccggcgacattaaagggatcatgcaggctggaaagcggtctctcagacctcagcccacggaactgaaatatagctggaagacctggggcaaggccaaaatgctgtccacagagagccataaccaaaccttcctcattgatgggcctgaaacagcggagtgccccaataccaaccgcgcctggaactctctggaggttgaagactacggatttggcgtgttctccacaaacatctggcttaagctgcgggagaaacaggacgtcttttgtgatagcaagctcatgtctgctgccatcaaagacaatagagctgtgcacgccgatatgggctattggattgaatccgcgctgaacgacacctggaagatggagaaggccagcttcatcgagattaaatcttgccactggcctaagagccatacgctgtggtccaatggggttcttgaaagcgagatgatcattcccaaaaacttcgctggaccggtgtctcagcacaactaccgccctggctatcatacacagaccgccgggccctggcacctcggaaagctggaaatggattttgacttctgtgagggcaccacagtcgtggtgaccgaagattgcgggaatcggggaccctccctgagaacgacaaccgctagcggcaaactcatcacagagtggtgctgtcggtcctgcaccctgcctccgcttcgctacagaggcgaggacgggtgttggtacggaatggaaattcggcccctgaaggagaaggaagagaacctcgtcaattctctggttacagccggccatgggcaaatcgataactttagcctgggagtgcttggcatggccctcttcctggaagagatgctgagaacccgcgtggggacgaaacacgctatcctcctggtcgcggtgtcctttgttacccttattacaggaaatatgtctttccgggacctgggcagagtgatggtcatggtgggcgccaccatgacagatgacatcgggatgggagttacctatctcgctctgctggccgcctttaaggtgcgccctacgttcgctgccggccttctgctcagaaaactgacaagcaaggagctcatgatggcgaccattgggatcgctctgctttcccagtctacaattcccgaaaccatcctggagctcaccgatgccctggccctgggaatgatggtccttaaaatcgtgcggacaatggaaaagtaccagctggctgttacgattatggccatcagctgcgtgcctaacgcggtcattctccaaaatgcttggaaggtgtcctgtaccatcctggccgccgtgagcgtctctcccctcctgcttacatccagccagcagaaagctgactggattcctctggccctcaccatcaagggcctgaaccccacagctatctttctgaccacgctttctcgcacatccaaaaagagaagctggccgctgaatgaggccgttatggcggtggggatggtgtctattctcgcctccagcctgctcaaaaacgacatccctatgaccggacccctggtcgctggcggccttctgaccgtgtgctatgttctgacagggcggtccgccgatctcgaactggagcgcgctgccgacgtgaagtgggaggatcaggccgaaattagcggatctagccctatcctttccattaccatctctgaggacggcagcatgtccattaaaaatgaagaggaggaacacacactgacgatcctcatcagaaccgggctgctcgtcatttctggagtgttccccgttagcatcccgattacagctgcggcctggtacctgtgggaggtgaagaagcaacgggctggcgtcctttgggatgtgccttctccccctcccgtcgggaaagccgaactggaggacggagcctatcgcatcaagcagagaggcatttttggctacagccagatcggggctggagtgtataaagaaggcaccttccatacaatgtggcacgttaccagaggggccgtgctgatgcatcgcggaaagagaatcgagcccagctgggcggatgtcaaaaaggacctcatttcctacggcgggggatggaagctggagggcgaatggaaagagggcgaagaggtgcaggttcttgctctggaacctgggaagaacccgcgggccgtgcaaacgaaacccggactctttaagaccaatacaggcaccatcggggccgtcagcctggatttctctcctggaacatccggcagccccattgtggacagaaaagggaaggtggttggactctacggcaacggcgtcgtgacccgctctggggcttatgtgtccgccatcgcgcagacagaaaagagcattgaggataatcctgaaatcgaggacgatatcttccggaaaaagagactgacgattatggaccttcaccccggagctggcaaaaccaagcgctacctgcctgccatcgtccgggaagccattaaaagagggctgcgcacactcatcctggctccgacccgggtggttgccgctgagatggaagaggcccttagaggactgcccattcgctatcagacccctgcgatccgggccgagcatacaggcagagaaattgtggacctcatgtgtcacgctacgtttaccatgcggctgctctcccccgtccgcgtgcctaactacaacctgatcatcatggatgaggcccacttcacagaccccgcttctattgccgccagagggtatatcagcacccgggttgaaatgggcgaggctgcgggaatttttatgacagccaccccgcctggctcccgcgatcccttcccccagagcaatgctcctatcatggacgaggaaagagagattcccgaacggtcttggaactccgggcatgagtgggtgacggattttaagggaaagacagtctggttcgtgcctagcatcaaagccggcaatgacatcgccgcttgccttagaaagaacgggaaaaaggttattcaactgtctcgcaaaacctttgatagcgaatacgtgaagacccgggccaatgactgggatttcgtcgtgacaaccgacatctccgagatgggagcgaactttagagctgagcgcgtgattgatccgcggagatgtatgaagcccgtcatcctgacagacggcgaggaacgcgttattctcgccgggcctatgcccgtgacccactctagcgccgctcagcggagaggccgcatcggaagaaatcctaaaaacgaaaatgaccagtatatctacatgggcgagcccctggaaaacgatgaggactgcgcccattggaaggaggcgaaaatgcttctggataatattaacacgccggaagggatcattccttccatgttcgagcccgaacgggagaaggtggacgccatcgatggagaataccgcctcagaggcgaggctcggaaaacatttgtcgacctgatgcgcagaggggatctgcctgtgtggctcgcctatcgggttgctgccgagggaattaattacgctgacagacgctggtgtttcgatggcatcaagaacaatcaaattcttgaagagaacgtggaagtcgagatctggaccaaagagggggaacggaagaagctgaaacccagatggctggacgcccgcatctattctgatcctctcgcgctgaaggagttcaaagaatttgccgctggccggaagtcccttacactgaacctcattaccgagatgggaagactgcccacgttcatgacccagaaagcccgggacgctctggataatctcgccgtgcttcacacagccgaagttggcgggcgcgcttacaaccacgcgctgtccgagctgccggagaccctcgaaacactgcttctgctcaccctgctggccacagtgaccggaggcatctttctcttccttatgagcgggaagggaattggcaagatgacgctgggcatgtgctgcatcattacagcttctatcctgctctggtatgcccagatccagcctcattggattgccgcttccatcattctggagtttttccttatcgtcctgctcattcccgaacccgagaaacaaagaacccctcaggacaatcagctgacctacgtggtcatcgccatcctgacagtggttgcggccaccatggctaacgaaatggggtttctcgagaagaccaagaaggaccttggactgggcagcattacgacccaggagtccgaatctaatatcctggatattgacctccggccggccagcgcttggacactgtatgccgtggcgaccacattcgtgacccccatgcttcgccactccatcgagaactctagcgtcaatgtttccctgacggccattgctaaccaagccaccgtgctcatggggctgggaagaggctggcctctgagcaaaatggatatcggggtgcccctccttgctattggatgttactctcaggtcaatcctatcacactgaccgccgctctgctcctgcttgtggcccattacgcgatcattggccccggcctgcaggccaaggctacacgggaagcccagaagcgcaccgctgccgggatcatgaaaaaccctacggttgacggaattacagtgatcgatctcgagccgattccctatgaccctaagtttgaaaaacaactgggccaggtcatgctgctcgtgctttgcgtcacccaggtgctgatgatgagaacaacctgggccctgtgtgaggcgctcaccctggctacagggcccatctccacgctttgggagggaaatcctggccggttctggaacaccacaatcgccgttagcatggctaatatttttcgcgggtcttacctggccggagccggcctcctgttctccatcatgaagaacaccacaaataccagacggggcacggggaacattggagaaacactgggcgagaaatggaaaagcagactcaatgctcttgggaagtctgaatttcagatctataaaaagagcggcattcaagaggtggatcgcaccctggccaaagagggcatcaagagaggggaaaccgaccaccatgcggtctccagaggatctgccaaactgcgctggttcgtggagcggaacatggttacacccgaaggcaaggtggtcgatctcggctgcgggagaggaggctggagctactattgtgggggactgaaaaacgtgcgcgaggtgaagggccttaccaaagggggaccgggccacgaggagcctatccccatgtccacatacggctggaatctggttcggctccagagcggggtcgacgtgttctttacgccccctgagaaatgcgataccctgctgtgtgacattggagaatcctctcccaaccctacaatcgaggctggcagaaccctccgcgtgcttaatctggtcgaaaactggctgaataacaatacacagttctgcgttaaggtgctcaacccgtatatgcccagcgtgattgagaaaatggaaaccctgcaacggaagtacgggggagcccttgtcagaaatcctctgtcccgcaactctacgcacgagatgtactgggtgagcaatgctaccggcaacatcgtttcctctgtgaatatgattagccggatgctcatcaacagatttacaatgaaacataagaaggccacctatgagcccgatgtcgacctggggtccggaacacgcaatatcggcattgaaaacgagatccctaacctggacattatcggcaaaagaattgaaaagatcaaacaggagcacgaaaccagctggcattacgatcaggaccacccctataagacatgggcgtaccacgggtcttatgagaccaaacagacgggatccgccagctctatggtgaatggcgttgtgaagctccttacaaagccgtgggatgtcgtgcctatggtgacccaaatggctatgaccgacacaacgcccttcgggcagcagcgggtctttaaagagaaggttgatacccgcacacaggaacctaaagagggaaccaagaaactgatgagaattacagccgaatggctgtggaaggagctcggcaagaaaaagacaccccggatgtgtacaagagaggagttcacccggaaagtgcgctccaacgctgccctgggggctatctttacggacgagaataagtggaaaagcgccagagaagcggtggaggattctcggttctgggaacttgtcgaccgcgagagaaacctgcatctcgagggaaagtgcgaaacctgtgtgtacaatatgatgggcaaacgggagaagaagctgggcgaatttgggaaagccaagggatcccgcgctatctggtatatgtggctgggcgccagattcctcgagtttgaagctctggggttccttaacgaggatcactggtttagccggggaaattccctgagcggcgttgagggggaaggcctccataaactgggatacattcttcgcgacgtgtctaagaaagagggcggggccatgtacgccgatgacacagcgggatgggacaccagaatcacactggaagatctcaagaacgaggaaatggtcaccaatcacatgaagggcgagcataaaaagctggctgaggccattttcaaactgacgtatcaaaacaaggtggttcgggtgcagcgccctacacccagagggaccgtcatggacatcattagccggaaagatcagcgcggatccggccaggtggttacatacgggctcaataccttcacgaacatggaagcccaactgatcagacagatggagggcgaaggaatctttaagtctattcagcggcttaccgtgacagaggagatcgctgtccaaaattggctggccagagtgggccgcgaacggctcagcagaatggctatttccggggacgattgcgtcgtgaagccgctggacgatcgcttcgcctctgcgcttaccgccctgaacgacatgggaaaagttcggaaggatatccagcagtgggagcctagcagaggctggaatgactggacacaggtgcccttttgctcccaccacttccatgaactcgtcatgaaagatgggcgcgtgctggtggttccctgtcggaaccaagacgagctgattggacgggctcgcatctctcagggcgccgggtggagcctcaaggaaaccgcttgcctgggcaaatcctatgcccagatgtggacacttatgtactttcaccggagagatctgcgcctcgcggccaacgctatctgtagcgccgtgccttctcattgggtcccgacctcccggacgacatggagcattcacgctaagcacgagtggatgaccaccgaggacatgctggccgtgtggaatagagtttggatccaggaaaacccctggatggaggacaagacacctgtggaatcttgggaggaagtcccctatcttggaaaacgggaggatcaatggtgcggctccctgattgggctcaccagcagagctacatgggccaagaatatccagacggcgattaaccaggtgcgctccctgatcggaaatgaggaatacaccgactatatgccttctatgaaacggttcagaaaggaggaagaggaagccggcgtcctgtggtga

SEQ ID NO: 19973 - RNA, 9876 nt, synthetic construct
  misc_feature 1..9876: note = derived and/or modified CDS sequence (opt5) from DENV-2__EU687242__SS-prME
  source 1..9876: mol_type = other RNA
acagccggcgtgatcattatgctgatccccacagctatggccttccacctcacgacccggaatggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatccgggggattatgcaggctggaaaaagatccctccgccctcagcccacggaactgaagtattcttggaaaacctggggcaaggccaagatgctgagcacagagtcccataaccaaaccttcctcatcgatgggcctgaaacagcggagtgccccaataccaaccgggcctggaatagcctggaggttgaagactacggatttggcgtgttctctacaaacatctggcttaaactgagagagaagcaggacgtcttttgtgattccaaactcatgagcgctgccattaaggacaatcgcgctgtgcacgccgatatgggctattggatcgaatctgcgctgaacgacacctggaaaatggagaaggcctccttcattgagatcaagagctgctactggcctaaatctcacacgctgtggagcaatggggttcttgaatccgagatgattatccccaagaacttcgctggaccggtgagccagcataactatcggcctggctaccacacacagaccgccgggccctggcatctcggaaaactggaaatggattttgacttctgtgagggcaccacagtcgtggtgaccgaagattgcgggaatagaggaccctctctgcggacgacaaccgcttccggcaagctcattacagagtggtgctgtcgcagctgcaccctgcctccgcttagataccggggcgaggacgggtgttggtatggaatggaaatcagacccctgaaagagaaggaagagaacctcgtcaattccctggttacagccggccacgggcaaatcgataacttttctctgggagtgcttggcatggccctcttcctggaagagatgctgcgcacccgggtggggacgaagcatgctattctcctggtcgcggtgagctttgttacccttatcacaggaaatatgtccttcagagacctgggccgcgtgatggtcatggtgggcgccaccatgacagatgacattgggatgggagttacctacctcgctctgctggccgcctttaaagtgagacctacgttcgctgccggccttctgctccggaagctgacatctaaagagctcatgatggcgaccatcgggattgctctgcttagccagtccacaatccccgaaaccatcctggagctcaccgatgccctggccctgggaatgatggtccttaagattgtgcgcaacatggaaaaatatcagctggctgttacaatcatggccatttcttgcgtgcctaatgcggtcatcctccaaaacgcttggaaggtgagctgtacgattctggccgccgtgtccgtcagccccctcctgcttacctcttcccagcagaaggctgactggatccctctggccctcacaatcaaaggcctgaatcccaccgctatttttctgacaacccttagcagaacgtctaagaaacggtcctggccgctgaacgaggccgttatggcggtggggatggtgagcatcctcgcctcttccctgctcaagaatgacattcctatgacaggacccctggtcgctggcggccttctgaccgtgtgctacgttctgaccgggcgcagcgccgatctcgaactggagagagctgccgacgtgaaatgggaggatcaggccgaaatctccggaagctctcctattcttagcatcacaatttccgaggacggctctatgagcatcaagaacgaagaggaggaacacaccctgacaatcctcattcggacggggctgctcgtcatctccggagtgttccccgtttctattccgatcaccgctgcggcctggtatctgtgggaggtgaaaaagcaacgcgctggcgtcctttgggatgtgccttctccccctcccgtcgggaaggccgaactggaggacggagcctacagaattaaacagcggggcatctttggctattcccagatcggggctggagtgtacaaggaaggcacattccacaccatgtggcatgttacacgcggggccgtgctgatgcacagaggaaaacggattgagccctcctgggcggatgtcaagaaagacctcatcagctacggcgggggatggaagctggagggcgaatggaaggagggcgaagaggtgcaggttcttgctctggaacctgggaaaaatccgagagccgtgcaaaccaagcccggactctttaaaacgaacaccggcacaattggggccgtctccctggatttcagccctggaacctctggctcccccatcgtggaccgcaaggggaaagtggttggactctatggcaatggcgtcgtgacacggagcggggcttacgtgtctgccattgcgcagaccgagaagtccatcgaggataaccctgaaatcgaggacgatattttcagaaagaaacgcctgacaatcatggaccttcatcccggagctggcaagacgaaacggtatctgcctgccattgtcagagaagccatcaagcgcgggctgcggaccctcattctggctccgacaagagtggttgccgctgagatggaagaggcccttcgcggactgcccatccggtaccagacccctgcgattagagccgagcacaccggccgggaaatcgtggacctcatgtgtcatgctacatttacgatgcgcctgctcagccccgtcagagtgcctaactataatctgatcattatggatgaggcccacttcaccgaccccgcttccatcgccgcccgggggtacatttctacacgcgttgaaatgggcgaggctgcgggaatctttatgaccgccacaccgcctggcagcagagatcccttcccccagtccaacgctcctattatggacgaggaacgggagatccccgaaagaagctggaactctgggcacgagtgggtgaccgattttaaaggaaagacggtctggttcgtgccttccatcaaggccggcaacgacattgccgcttgccttcgcaaaaatgggaagaaagttatccaactgagccggaagacatttgattctgaatatgtgaaaaccagagccaacgactgggatttcgtcgtgaccacagacattagcgagatgggagcgaattttcgcgctgagcgggtgatcgatccgagacgctgtatgaagcccgtcattctgaccgacggcgaagaacgggttatcctcgccgggcctatgcccgtgacacattcctctgccgctcagagacgcggcagaatcggacggaaccctaagaatgaaaacgaccagtacatttacatgggcgagcccctggaaaatgatgaggactgcgcccactggaaagaggcgaagatgcttctggataacatcaataccccggaagggattatccctagcatgttcgagcccgaacgcgagaaagtggacgccattgatggagaatatagactccggggcgaggctcgcaagacgtttgtcgacctgatgagaagaggggatctgcctgtgtggctcgcctacagagttgctgccgagggaatcaactatgctgaccgccggtggtgtttcgatggcattaaaaataaccaaatccttgaagagaacgtggaagtcgagatctggacaaaggagggggaacgcaagaagctgaagccccgctggctggacgcccggatttactccgatcctctcgcgctgaaagagttcaaggaatttgccgctggcagaaaatctcttaccctgaatctcatcacagagatgggacggctgcccaccttcatgacgcagaaggcccgcgacgctctggataacctcgccgtgcttcataccgccgaagttggcgggagagcttataatcacgcgctgaacgagctgccggagacactcgaaaccctgcttctgctcacactgctggccaccgtgacaggaggcatttttctcttccttatgagcgggaaaggaatcggcaagatgaccctgggcatgtgctgcattatcacggcttccatcctgctctggtacgcccagattcagcctcactggatcgccgctagcattatcctggagtttttccttattgtcctgctcatccccgaacccgagaagcaacggacacctcaggacaatcagctgacctatgtggtcatcgccattctgaccgtggttgcggccacaatggctaacgaaatggggtttctcgagaaaaccaagaaagaccttggactgggctctatcacaacgcaggagtccgaaagcaatattctggatatcgacctccgcccggcctccgcttggaccctgtacgccgtggcgacaaccttcgtgacacccatgcttagacattctattgagaacagctccgtcaatgtttctctgaccgccatcgctaaccaagccacggtgctcatggggctgggacggggctggcctctgagcaagatggatattggggtgcccctccttgctatcggatgttactcccaggtcaatcctatcaccctgacagccgctctgctcctgcttgtggcccactatgcgattatcggccccggcctgcaggccaaagctacccgcgaagcccagaagagaacagctgccgggattatgaagaaccctaccgttgacggaatcacggtgattgatctcgagccgatcccctacgaccctaaatttgaaaagcaactgggccaggtcatgctgctcgtgctttgcgtcacacaggtgctgatgatgcggaccacatgggccctgtgtgaggcgctcaccctggctaccgggcccatcagcacactttgggagggaaatcctggccgcttctggaacacgaccattgccgtttctatggctaatatctttagagggtcctatctggccggagccggcctcctgttcagcattatgaaaaacacaaccaatacacggagaggcaccgggaacatcggagaaacgctgggcgagaagtggaaatctcgcctcaacgctcttgggaagtccgaatttcagatttacaagaaaagcggaatccaagaggtggatcggacactggccaaggagggcatcaaaagaggggaaaccgaccatcacgcggtctctcgcggaagcgccaagctgcggtggttcgtggagagaaatatggttacccccgaaggcaaagtggtcgatctcggctgcgggcgcggaggctggtcctattactgtgggggactgaagaacgtgcgggaggtgaaaggccttacaaaagggggaccgggccatgaggaacctattcccatgtctacctatggctggaatctggttagactccagagcggggtcgacgtgttctttacaccccctgagaagtgcgatacgctgctgtgtgacatcggagaatccagccccaaccctaccattgaggctggccgcacactccgggtgcttaatctggtcgaaaactggctgaataacaatacccagttctgcgttaaagtgctcaacccgtacatgccctccgtgatcgagaagatggaaacactgcaaagaaaatacgggggagcccttgtccgcaatcctctgtctcggaacagcacccacgagatgtattgggtgtccaatgctacgggcaacattgtttctagcgtgaatatgatctccagaatgctcatcaaccgctttaccatgaagcacaaaaaggccacatacgagcccgatgtcgacctggggtctggaaccagaaacattggcatcgaaaatgagattcctaacctggacatcattggcaagcggatcgagaagattaagcaggagcatgaaacaagctggcactatgatcaggaccatccctacaaaacctgggcgtatcacgggtcctacgagacaaagcagaccggaagcgcctcttccatggtgaatggcgttgtgaaactccttacgaagccgtgggatgtcgtgcctatggtgacacaaatggctatgaccgacaccacacccttcgggcagcagcgcgtctttaaggagaaagttgatacgagaacccaggaacctaaggagggaaccaaaaagctgatgcggatcaccgccgaatggctgtggaaagagctcggcaagaagaaaacacccagaatgtgtacccgggaggagttcacacgcaaggtgagaagcaacgctgccctgggggctatctttaccgacgagaataaatggaagtctgcccgggaagcggtggaggattcccgcttctgggaacttgtcgacagagagcggaacctgcacctcgagggaaaatgcgaaacgtgtgtgtataatatgatgggcaagcgcgagaaaaagctgggcgaatttgggaaggccaaaggaagcagagctatttggtacatgtggctgggcgcccggttcctcgagtttgaagctctggggttccttaacgaggatcattggttttctcgcggaaattccctgagcggcgttgagggggaaggcctccacaagctgggatacatccttagagacgtgtccaaaaaggagggcggggccatgtatgccgatgacaccgcgggatgggacacacggattaccctggaagatctcaaaaacgaggaaatggtcacaaatcatatgaagggcgagcacaagaaactggctgaggccatcttcaagctgacctaccaaaacaaagtggttcgcgtgcagagacctacgccccgggggacagtcatggacattatcagccgcaaggatcagagaggatctggccaggtggggacctatggcctcaatacattcaccaacatggaagcccaactgatccggcagatggagggagaaggcatttttaaaagcatccagagacttacggttaccgaggagattgctgtgcaaaattggctggcccgcgtcgggcgggaaagactctcccgcatggctatctctggagacgattgcgtggtcaagccgctggacgatcggttcgccagcgcgcttacagccctgaacgacatgggcaaggtgagaaaagatattcagcagtgggagccttcccgcgggtggaacgactggacccaggttcccttttgctctcatcacttccacgaactcgtgatgaaggatggacgggtcctggtggtgccctgtagaaatcaagacgagctgatcggccgcgctcggatcagccagggggccggctggtccctcaaagaaacagcttgcctgggaaagtcttacgcccagatgtggacccttatgtattttcatagacgcgatctgcggctcgcggccaacgctatttgtagcgccgttccttcccactgggtgccgacaagcagaaccacgtggtctatccatgctaaacacgagtggatgacaaccgaggacatgctggccgtctggaatcgggtgtggattcaggaaaacccctggatggaggacaagacccctgttgaatcctgggaggaagtgccctaccttggcaagagagaggatcaatggtgcgggagcctgatcggactcacatctcgcgctacctgggccaaaaatattcagacagcgatcaaccaggtccggtccctgattggcaatgaggaatatacggactacatgcctagcatgaagagattccgcaaagaggaagaggaagccggggtgctgtggtga

SEQ ID NO: 19974 - RNA, 9876 nt, synthetic construct
  misc_feature 1..9876: note = derived and/or modified CDS sequence (opt5) from DENV-2__EU687243__SS-prME
  source 1..9876: mol_type = other RNA
acagccggcgtgatcattatgctgatccccacagctatggccttccacctcacgacccggaatggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatccgggggattatgcaggctggaaaaagatccctccgccctcagcccacggaactgaagtattcttggaaaacctggggcaaggccaagatgctgagcacagagtcccataaccaaaccttcctcatcgatgggcctgaaacagcggagtgccccaataccaaccgggcctggaatagcctggaggttgaagactacggatttggcgtgttctctacaaacatctggcttaaactgagagagaagcaggacgtcttttgtgattccaaactcatgagcgctgccattaaggacaatcgcgctgtgcacgccgatatgggctattggatcgaatctgcgctgaacgacacctggaaaatggagaaggcctccttcattgagatcaagagctgccactggcctaaatctcatacgctgtggagcaatggggttcttgaatccgagatgattatccccaagaacttcgctggaccggtgagccagcacaactaccggcctggctatcatacacagaccgccgggccctggcacctcggaaaactggaaatggattttgacttctgtgagggcaccacagtcgtggtgaccgaagattgcgggaatagaggaccctctctgcggacgacaaccgcttccggcaagctcattacagagtggtgctgtcgcagctgcaccctgcctccgcttagataccggggcgaggacgggtgttggtacggaatggaaatcagacccctgaaagagaaggaagagaacctcgtcaattccctggttacagccggccatgggcaaatcgataacttttctctgggagtgcttggcatggccctcttcctggaagagatgctgcgcacccgggtggggacgaagcacgctattctcctggtcgcggtgagctttgttacccttatcacaggaaatatgtccttcagagacctgggccgcgtgatggtcatggtgggcgccaccatgacagatgacattgggatgggagttacctatctcgctctgctggccgcctttaaagtgagacctacgttcgctgccggccttctgctccggaagctgacatctaaagagctcatgatggcgaccatcgggattgctctgcttagccagtccacaatccccgaaaccatcctggagctcaccgatgccctggccctgggaatgatggtccttaagattgtgcgcaacatggaaaaataccagctggctgttacaatcatggccatttcttgcgtgcctaatgcggtcatcctccaaaacgcttggaaggtgagctgtacgattctggccgccgtgtccgtcagccccctcctgcttacctcttcccagcagaaggctgactggatccctctggccctcacaatcaaaggcctgaatcccaccgctatttttctgacaacccttagcagaacgtctaagaaacggtcctggccgctgaacgaggccgttatggcggtggggatggtgagcatcctcgcctcttccctgctcaagaatgacattcctatgacaggacccctggtcgctggcggccttctgaccgtgtgctatgttctgaccgggcgcagcgccgatctcgaactggagagagctgccgacgtgaaatgggaggatcaggccgaaatctccggaagctctcctattcttagcatcacaatttccgaggacggctctatgagcatcaagaacgaagaggaggaacacaccctgacaatcctcattcggacggggctgctcgtcatctccggagtgttccccgtttctattccgatcaccgctgcggcctggtacctgtgggaggtgaaaaagcaacgcgctggcgtcctttgggatgtgccttctccccctcccgtcgggaaggccgaactggaggacggagcctatagaattaaacagcggggcatctttggctactcccagatcggggctggagtgtataaggaaggcacattccataccatgtggcacgttacacgcggggccgtgctgatgcatagaggaaaacggattgagccctcctgggcggatgtcaagaaagacctcatcagctacggcgggggatggaagctggagggcgaatggaaggagggcgaagaggtgcaggttcttgctctggaacctgggaaaaatccgagagccgtgcaaaccaagcccggactctttaaaacgaacaccggcacaattggggccgtctccctggatttcagccctggaacctctggctcccccatcgtggaccgcaaggggaaagtggttggactctacggcaatggcgtcgtgacacggagcggggcttatgtgtctgccattgcgcagaccgagaagtccatcgaggataaccctgaaatcgaggacgatattttcagaaagaaacgcctgacaatcatggaccttcaccccggagctggcaagacgaaacggtacctgcctgccattgtcagagaagccatcaagcgcgggctgcggaccctcattctggctccgacaagagtggttgccgctgagatggaagaggcccttcgcggactgcccatccggtatcagacccctgcgattagagccgagcataccggccgggaaatcgtggacctcatgtgtcacgctacatttacgatgcgcctgctcagccccgtcagagtgcctaactacaatctgatcattatggatgaggcccacttcaccgaccccgcttccatcgccgcccgggggtatatttctacacgcgttgaaatgggcgaggctgcgggaatctttatgaccgccacaccgcctggcagcagagatcccttcccccagtccaacgctcctattatggacgaggaacgggagatccccgaaagaagctggaactctgggcatgagtgggtgaccgattttaaaggaaagacggtctggttcgtgccttccatcaaggccggcaacgacattgccgcttgccttcgcaaaaatgggaagaaagttatccaactgagccggaagacatttgattctgaatacgtgaaaaccagagccaacgactgggatttcgtcgtgaccacagacattagcgagatgggagcgaattttcgcgctgagcgggtgatcgatccgagacgctgtatgaagcccgtcattctgaccgacggcgaagaacgggttatcctcgccgggcctatgcccgtgacacactcctctgccgctcagagacgcggcagaatcggacggaaccctaagaatgaaaacgaccagtatatttacatgggcgagcccctggaaaatgatgaggactgcgcccattggaaagaggcgaagatgcttctggataacatcaataccccggaagggattatccctagcatgttcgagcccgaacgcgagaaagtggacgccattgatggagaatacagactccggggcgaggctcgcaagacgtttgtcgacctgatgagaagaggggatctgcctgtgtggctcgcctatagagttgctgccgagggaatcaactacgctgaccgccggtggtgtttcgatggcattaaaaataaccaaatccttgaagagaacgtggaagtcgagatctggacaaaggagggggaacgcaagaagctgaagccccgctggctggacgcccggatttattccgatcctctcgcgctgaaagagttcaaggaatttgccgctggcagaaaatctcttaccctgaatctcatcacagagatgggacggctgcccaccttcatgacgcagaaggcccgcgacgctctggataacctcgccgtgcttcacaccgccgaagttggcgggagagcttacaatcacgcgctgaacgagctgccggagacactcgaaaccctgcttctgctcacactgctggccaccgtgacaggaggcatttttctcttccttatgagcgggaaaggaatcggcaagatgaccctgggcatgtgctgcattatcacggcttccatcctgctctggtatgcccagattcagcctcattggatcgccgctagcattatcctggagtttttccttattgtcctgctcatccccgaacccgagaagcaacggacacctcaggacaatcagctgacctacgtggtcatcgccattctgaccgtggttgcggccacaatggctaacgaaatggggtttctcgagaaaaccaagaaagaccttggactgggctctatcacaacgcaggagtccgaaagcaatattctggatatcgacctccgcccggcctccgcttggaccctgtatgccgtggcgacaaccttcgtgacacccatgcttagacactctattgagaacagctccgtcaatgtttctctgaccgccatcgctaaccaagccacggtgctcatggggctgggacggggctggcctctgagcaagatggatattggggtgcccctccttgctatcggatgttactcccaggtcaatcctatcaccctgacagccgctctgctcctgcttgtggcccattacgcgattatcggccccggcctgcaggccaaagctacccgcgaagcccagaagagaacagctgccgggattatgaagaaccctaccgttgacggaatcacggtgattgatctcgagccgatcccctatgaccctaaatttgaaaagcaactgggccaggtcatgctgctcgtgctttgcgtcacacaggtgctgatgatgcggaccacatgggccctgtgtgaggcgctcaccctggctaccgggcccatcagcacactttgggagggaaatcctggccgcttctggaacacgaccattgccgtttctatggctaatatctttagagggtcctacctggccggagccggcctcctgttcagcattatgaaaaacacaaccaatacacggagaggcaccgggaacatcggagaaacgctgggcgagaagtggaaatctcgcctcaacgctcttgggaagtccgaatttcagatttataagaaaagcggaatccaagaggtggatcggacactggccaaggagggcatcaaaagaggggaaaccgaccaccatgcggtctctcgcggaagcgccaagctgcggtggttcgtggagagaaatatggttacccccgaaggcaaagtggtcgatctcggctgcgggcgcggaggctggtcctactattgtgggggactgaagaacgtgcgggaggtgaaaggccttacaaaagggggaccgggccacgaggaacctattcccatgtctacctacggctggaatctggttagactccagagcggggtcgacgtgttctttacaccccctgagaagtgcgatacgctgctgtgtgacatcggagaatccagccccaaccctaccattgaggctggccgcacactccgggtgcttaatctggtcgaaaactggctgaataacaatacccagttctgcgttaaagtgctcaacccgtatatgccctccgtgatcgagaagatggaaacactgcaaagaaaatacgggggagcccttgtccgcaatcctctgtctcggaacagcacccacgagatgtactgggtgtccaatgctacgggcaacattgtttctagcgtgaatatgatctccagaatgctcatcaaccgctttaccatgaagcataaaaaggccacatatgagcccgatgtcgacctggggtctggaaccagaaacattggcatcgaaaatgagattcctaacctggacatcattggcaagcggatcgagaagattaagcaggagcacgaaacaagctggcattacgatcaggaccacccctataaaacctgggcgtaccacgggtcctatgagacaaagcagaccggaagcgcctcttccatggtgaatggcgttgtgaaactccttacgaagccgtgggatgtcgtgcctatggtgacacaaatggctatgaccgacaccacacccttcgggcagcagcgcgtctttaaggagaaagttgatacgagaacccaggaacctaaggagggaaccaaaaagctgatgcggatcaccgccgaatggctgtggaaagagctcggcaagaagaaaacacccagaatgtgtacccgggaggagttcacacgcaaggtgagaagcaacgctgccctgggggctatctttaccgacgagaataaatggaagtctgcccgggaagcggtggaggattcccgcttctgggaacttgtcgacagagagcggaacctgcatctcgagggaaaatgcgaaacgtgtgtgtacaatatgatgggcaagcgcgagaaaaagctgggcgaatttgggaaggccaaaggaagcagagctatttggtatatgtggctgggcgcccggttcctcgagtttgaagctctggggttccttaacgaggatcactggttttctcgcggaaattccctgagcggcgttgagggggaaggcctccataagctgggatacatccttagagacgtgtccaaaaaggagggcggggccatgtacgccgatgacaccgcgggatgggacacacggattaccctggaagatctcaaaaacgaggaaatggtcacaaatcacatgaagggcgagcataagaaactggctgaggccatcttcaagctgacctatcaaaacaaagtggttcgcgtgcagagacctacgccccgggggacagtcatggacattatcagccgcaaggatcagagaggatctggccaggtggggacctacggcctcaatacattcaccaacatggaagcccaactgatccggcagatggagggagaaggcatttttaaaagcatccagagacttacggttaccgaggagattgctgtgcaaaattggctggcccgcgtcgggcgggaaagactctcccgcatggctatctctggagacgattgcgtggtcaagccgctggacgatcggttcgccagcgcgcttacagccctgaacgacatgggcaaggtgagaaaagatattcagcagtgggagccttcccgcgggtggaacgactggacccaggttcccttttgctctcaccacttccatgaactcgtgatgaaggatggacgggtcctggtggtgccctgtagaaatcaagacgagctgatcggccgcgctcggatcagccagggggccggctggtccctcaaagaaacagcttgcctgggaaagtcttatgcccagatgtggacccttatgtactttcacagacgcgatctgcggctcgcggccaacgctatttgtagcgccgttccttcccattgggtgccgacaagcagaaccacgtggtctatccacgctaaacacgagtggatgacaaccgaggacatgctggccgtctggaatcgggtgtggattcaggaaaacccctggatggaggacaagacccctgttgaatcctgggaggaagtgccctatcttggcaagagagaggatcaatggtgcgggagcctgatcggactcacatctcgcgctacctgggccaaaaatattcagacagcgatcaaccaggtccggtccctgattggcaatgaggaatacacggactatatgcctagcatgaagagattccgcaaagaggaagaggaagccggggtgctgtggtga

SEQ ID NO: 19975 - RNA, 9876 nt, synthetic construct
  misc_feature 1..9876: note = derived and/or modified CDS sequence (opt5) from DENV-2__EU687245__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagaccgaggacggggttaatatgtgcaccctgatggcgatcgatctcggagaactgtgtgaggacacaattacctacaagtgcccgcttctgcgccaaaacgaacccgaggatatcgactgttggtgcaatagcacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccgttatggcggtggggatggtgagcatcctcgcctcttccctgctcaaaaatgacattcctatgacaggacccctggtcgctggcggccttctgaccgtgtgctatgttctgaccgggcggagcgccgatctcgaactggagcgcgctgccgacgtgaagtgggaggatcaggccgaaatctccggaagctctcctattcttagcatcacaatttccgaggacggctctatgagcatcaaaaacgaagaggaggaacacaccctgacaatcctcattagaacggggctgctcgtcatctccggagtgttccccgtttctattccgatcaccgctgcggcctggtacctgtgggaggtgaagaagcaacgggctggcgtcctttgggatgtgccttctccccctcccgtcgggaaagccgaactggaggacggagcctatcgcattaagcagagaggcatctttggctactcccagatcggggctggagtgtataaagaaggcacattccataccatgtggcacgttacaagaggggccgtgctgatgcatcgcggaaagagaattgagccctcctgggcggatgtcaaaaaggacctcatcagctacggcgggggatggaagctggagggcgaatggaaagagggcgaagaggtgcaggttcttgctctggaacctgggaagaatccgcgggccgtgcaaaccaaacccggactctttaagacgaacaccggcacaattggggccgtctccctggatttcagccctggaacctctggctcccccatcgtggacagaaaagggaaggtggttggactctacggcaatggcgtcgtgacacgcagcggggcttatgtgtctgccattgcgcagaccgagaagtccatcgaggataaccctgaaatcgaggacgatattttccggaaaaagagactgacaatcatggaccttcaccccggagctggcaaaacgaagcgctacctgcctgccattgtccgggaagccatcaaaagagggctgcgcaccctcattctggctccgacacgggtggttgccgctgagatggaagaggcccttagaggactgcccatccgctatcagacccctgcgattcgggccgagcataccggcagagaaatcgtggacctcatgtgtcacgctacatttacgatgcggctgctcagccccgtccgcgtgcctaactacaatctgatcattatggatgaggcccacttcaccgaccccgcttccatcgccgccagagggtatatttctacacgggttgaaatgggcgaggctgcgggaatctttatgaccgccacaccgcctggcagccgcgatcccttcccccagtccaacgctcctattatggacgaggaaagagagatccccgaacggagctggaactctgggcatgagtgggtgaccgattttaagggaaagacggtctggttcgtgccttccatcaaagccggcaacgacattgccgcttgccttagaaagaatgggaaaaaggttatccaactgagccgcaaaacatttgattctgaatacgtgaagacccgggccaacgactgggatttcgtcgtgaccacagacattagcgagatgggagcgaattttagagctgagcgcgtgatcgatccgcggagatgtatgaagcccgtcattctgaccgacggcgaggaacgcgttatcctcgccgggcctatgcccgtgacacactcctctgccgctcagcggagaggccgcatcggaagaaaccctaaaaatgaaaacgaccagtatatttacatgggcgagcccctggaaaatgatgaggactgcgcccattggaaggaggcgaaaatgcttctggataacatcaataccccggaagggattatccctagcatgttcgagcccgaacgggagaaggtggacgccattgatggagaataccgcctcagaggcgaggctcggaaaacgtttgtcgacctgatgcgcagaggggatctgcctgtgtggctcgcctatcgggttgctgccgagggaatcaactacgctgacagacgctggtgtttcgatggcattaagaataaccaaatccttgaagagaacgtggaagtcgagatctggacaaaagagggggaacggaagaagctgaaacccagatggctggacgcccgcatttattccgatcctctcgcgctgaaggagttcaaagaatttgccgctggccggaagtctcttaccctgaatctcatcacagagatgggaagactgcccaccttcatgacgcagaaagcccgggacgctctggataacctcgccgtgcttcacaccgccgaagttggcgggcgcgcttacaatcacgcgctgaacgagctgccggagacactcgaaaccctgcttctgctcacactgctggccaccgtgacaggaggcatttttctcttccttatgagcgggaagggaatcggcaagatgaccctgggcatgtgctgcattatcacggcttccatcctgctctggtatgcccagattcagcctcattggatcgccgctagcattatcctggagtttttccttattgtcctgctcatccccgaacccgagaaacaaagaacacctcaggacaatcagctgacctacgtggtcatcgccattctgaccgtggttgcggccacaatggctaacgaaatggggtttctcgagaagaccaaaaaggaccttggactgggctctatcacaacgcaggagtccgaaagcaatattctggatatcgacctccggccggcctccgcttggaccctgtatgccgtggcgacaaccttcgtgacacccatgcttcgccactctattgagaacagctccgtcaatgtttctctgaccgccatcgctaaccaagccacggtgctcatggggctgggaagaggctggcctctgagcaaaatggatattggggtgcccctccttgctatcggatgttactcccaggtcaatcctatcaccctgacagccgctctgctcctgcttgtggcccattacgcgattatcggccccggcctgcaggccaaggctacccgggaagcccagaagcgcacagctgccgggattatgaaaaaccctaccgttgacggaatcacggtgattgatctcgagccgatcccctatgaccctaagtttgaaaaacaactgggccaggtcatgctgctcgtgctttgcgtcacacaggtgctgatgatgagaaccacatgggccctgtgtgaggcgctcaccctggctaccgggcccatcagcacactttgggagggaaatcctggccggttctggaacacgaccattgccgtttctatggctaatatctttcgcgggtcctacctggccggagccggcctcctgttcagcattatgaagaacacaaccaatgctagacggggcacagggaacatcggagaaaccctgggcgagaaatggaagtctagactcaacgcccttgggaagtccgaatttcagatttataaaaagagcggaatccaagaggtggatcgcacgctggcgaaagagggcatcaagagaggggaaacagaccaccatgccgtctctagaggaagcgctaaactgcgctggttcgtggagcggaatatggttacccccgaaggcaaggtggtcgatctcggctgcgggagaggaggctggtcctactattgtgggggactgaaaaacgtgcgcgaggtgaagggccttaccaaagggggaccgggccacgaggaacctattcccatgtctacatacggctggaatctggttcggctccagagcggggtcgacgtgttctttacaccccctgagaaatgcgatacactgctgtgtgacatcggagaatccagccccaaccctacgattgaggccggcagaaccctccgcgtgcttaatctggtcgaaaactggctgaataacaatacacagttctgcgttaaggtgctcaacccgtatatgccctccgtgatcgagaaaatggaaaccctgcaacggaagtacgggggagctcttgtcagaaatcctctgtctcgcaacagcacacacgagatgtactgggtgtccaatgccaccggcaacattgtttctagcgtgaatatgatctcccggatgctcatcaacagatttacgatgaaacataagaaggcgacctatgagcccgatgtcgacctggggtctggaacacgcaacattggcatcgaaaatgagattcctaacctggacatcattggcaaaagaatcgaaaagattaaacaggagcacgaaaccagctggcattacgatcaggaccacccctataagacatgggcctaccacgggtcctatgagaccaaacagacaggaagcgcttcttccatggtgaatggcgttgtgaagctccttaccaagccgtgggatgtcgtgcctatggtgacgcaaatggccatgacagacaccacccccttcgggcagcagcgggtctttaaagagaaggttgatacacgcacgcaggaacctaaagagggaaccaagaaactgatgagaatcacagctgaatggctgtggaaggagctcggcaagaaaaagacaccccggatgtgtacaagagaggagttcacccggaaagtgcgcagcaacgccgctctgggggccatctttacagacgagaataagtggaaatctgcgagagaagccgtggaggattcccggttctgggaacttgtcgaccgcgagagaaacctgcatctcgagggaaagtgcgaaacctgtgtgtacaatatgatgggcaaacgggagaagaagctgggcgaatttgggaaagctaagggaagccgcgccatttggtatatgtggctgggcgctagattcctcgagtttgaagccctggggttccttaacgaggatcactggttttctcggggaaattccctgagcggcgttgagggggaaggcctccataaactgggatacatccttcgcgacgtgtccaagaaagagggcggggccatgtacgcggatgacacggctggatgggacaccagaattacactggaagatctcaagaacgaggaaatggtcaccaatcacatgaagggcgagcataaaaagctggccgaggccatcttcaaactgacatatcaaaacaaggtggttcgggtgcagcgccctaccagcagagggacggtcatggacattatctctcggaaagatcagcgcggaagcggccaggtggggacatacggcctcaataccttcacaaacatggaagctcaactgatcagacagatggagggagaaggcatttttaagtccatccagcggcttaccgttacggaggagattgccgtgcaaaattggctggctagagtcgggcgcgaacggctctctagaatggccatcagcggagacgattgcgtggtcaagcccctggacgatcgcttcgcgtccgcccttaccgctctgaacgacatgggcaaagtgcggaaggatattcagcagtgggagccgtctagagggtggaacgactggacacaggttcctttttgcagccaccacttccatgaactcgtgatgaaagatggacgcgtcctggtggtgccctgtcggaatcaagacgagctgatcggcagagcccgcatctcccagggggctggctggtctctcaaggaaaccgcctgcctgggaaaaagctatgcgcagatgtggacacttatgtactttcaccggagagatctgcgcctcgccgctaacgccatttgttccgctgttcccagccattgggtgcctacctctcggacaacctggtccatccacgccaagcacgagtggatgacgacagaggacatgctggctgtctggaatagagtgtggattcaggaaaacccgtggatggaggacaagacccccgttgaaagctgggaggaagtgccttatcttggcaaacgggaggatcaatggtgcgggtctctgatcggactcacctccagagccacatgggcgaagaatattcagaccgccgtcaaccaggtgcgcagcctgatcggcaatgaggaatacacagactatatgccctccatgaaacggttcagaaaggaggaagaggaagctggggtcctgtggtga

SEQ ID NO: 19976 - RNA, 9873 nt, synthetic construct
  misc_feature 1..9873: note = derived and/or modified CDS sequence (opt5) from DENV-2__HQ541798__SS-prME
  source 1..9873: mol_type = other RNA
accgccggcatgatcttcatgctgattcccacagtgatggcttttcacctcacgaccagaaacggggagcctcatatgatcgtgagccggcaggaaaagggaaagtccctgcttttcaagacaggcgacggggttaatatgtgcaccctgatggccatggatctcggagagctgtgtgaagacacaattacctacaagtgcccgcttctgcgccaaaacgagcccgaagatatcgactgttggtgcaattctacaagcacctgggtgacgtatggcacctgtacaaccacaggggagcaccggcgggagaagcgctccgtggcgctcgtccctcatgtgggaatgggcctggaaaccagaacggagacatggatgtctagcgaaggcgcttggaaacacgcccagcggattgagacctggatcctgcgccatcccgggtttacaatcatggccgctattctcgcctacaccatcggaaccacacacttccagagagctctgatttttatccttctgacggccgttgcgccttccatgaccatgcggtgcattggcatctctaaccgcgatttcgtggagggggtcagcggaggctcctgggtggacattgttctcgaacacgggagctgtgtgacaaccatggccaagaataagcccacactggattttgagcttatcaaaaccgaagctaagcagtctgccacgctgagaaaatattgcatcgaggctaagctcacaaacaccaccacagaatcccggtgtcctacccaaggagagccgagcctgaatgaggaacaggacaaacgcttcgtctgcaagcattctatggtggatagaggctggggcaacgggtgtggactgtttggcaaaggagggattgtgacatgcgccatgttcacgtgcaaaaaggacatgaaaggcgaggtcgttcagcccgaaaatctcgagtacaccatcgtgattacacctcactccggggaagaacatgcggtgggaaacgataccggcaagcacggcaaagagatcaagattacaccccagagctctatcaccgaagccgagctgacggggtatggaaccgtcacaatggaatgttcccctcggaccggccttgactttaatgagatggtgctgctccaaatggaaaacaaggcttggctggttcaccgccagtggttccttgatctgcccctcccgtggctgcctggggccgacacacagggaagcaattggatccagaaggagaccctggtgacgtttaagaacccccatgctaaaaagcaagacgtcgtggttctcggctcccaggagggggccatgcacacagccctgaccggcgctacagaaattcagatgtctagcggaaatcttctgttcaccggccatctcaaatgcagactgcggatggataaacttcaactgaaagggatgtcctacagcatgtgtaccggaaagttcaaggtggtcaaagagatcgcggaaacacagcacggcacgattgtgatcagagtccagtatgagggggacggatctccttgcaagattccctttgagatcatggatctcgaaaaacgccatgtgctgggccggctgatcaccgttaaccccattgtgacagagaaggactcccctgtcaacatcgaagccgagccgcccttcggggatagctacattatcattggcgtggaacctggacagctcaaactgaattggtttaagaagggctctagcatcgggcaaatgcttgagaccacaatgagaggagctaaacgcatggccattctgggcgacaccgcctgggatttcgggtccctcggaggcgtttttacgtctatcgggaaggctctgcaccaggtgttcggcgccatctacggagcggcttttagcggcgtctcctggacaatgaaaattctgatcggggtgattatcacctggattggaatgaacagccggtctacctcccttagcgtgtctctcgttctggtcggcgtggtgacactgtatctcggggtcatggtgcaggccgactccggatgtgttgtgagctggaagaataaagagctgaagtgcggctccgggatcttcatcaccgataacgtccacacatggacggaacagtacaagtttcaacccgagtctcctagcaaacttgcctccgctattcagaaggcccatgaagagggcatctgtggaattagatctgtgacccgcctggaaaatctcatgtggaaacagatcacacccgagctgaaccacattctgagcgagaatgaagttaaacttaccatcatgacaggcgacatcaaagggattatgcaggctggaaagcggtccctcagaccgcaacctaccgagctgaaatatagctggaagacgtggggcaaggccaaaatgctgtctaccgaatcccataaccagacattcctcatcgatgggcccgagaccgcggaatgccctaatacaaaccgcgcctggaatagcctggaggtggaggactacggatttggcgtcttcaccacaaacatttggcttaagctgcgggaaaaacaggacgtgttttgtgattctaagctcatgtccgctgccatcaaagacaatagagctgttcacgccgatatgggctattggattgagagcgcgctgaacgacacctggaagatcgaaaaggcctctttcatcgaggtgaaaagctgccactggcccaagcctcatacgctgtggtccaatgaggtccttgaaagcgagatgattatccccaaaaacttcgctgggccggtgtctcagcacaactaccgccctggatatcatacacaaaccgccggcccctggcacctcgggaagctggaaatggattttgacttctgtgagggaaccacagtggtcgttaccgaagattgcggcaatcgggggccctccctgagaacgacaaccgctagcggaaaactcattacagagtggtgctgtcggtcctgcaccctgcctccgcttcgctacagaggcgaggacggctgttggtacgggatggaaatccggcccctgaaggagaaggaagagaacctcgtcaattctctggtgacagccggacatggccagattgataactttagcctgggggtccttggaatggccctcttcctggaagagatgctgagaacccgcgtgggcacgaaacacgctatcctcctggttgcggtgtcctttgtcacccttattacagggaatatgtctttccgggacctgggaagagtgatggttatggtgggcgccaccatgacagatgacatcggcatgggggtcacctatctcgctctgctggccgcctttaaggtgcgccctacgttcgctgccggacttctgctcagaaaactgacaagcaaggagctcatgatgaccacaatcggcattgttctgctttcccagtctaccatccccgaaaccattctggagctcacagatgcgctggctctggggatgatggtgcttaaaatggtccggaagatggaaaagtaccaactggccgtgacgatcatggccattctctgcgtgcctaacgctgtcatcctgcagaatgcctggaaagttagctgtaccatcctcgcggtggtgtccgtcagccccctgtttcttacatcttcccagcagaaggctgactggattcctctggccctcaccatcaaaggactgaaccccacagccattttcctgaccacgcttagccgcacaaataagaaaagatcttggccgctgaacgaggctatcatggccgtgggcatggtttccattctcgctagctctctgctcaagaatgacatccctatgaccgggcccctggtggccggaggccttctgaccgtctgctatgtgctgacaggccggtccgcggatctcgaactggagcgcgccgctgacgttaaatgggaggatcaagccgaaatcagcgggtccagccctattctttctatcaccattagcgaggacggatccatgtctatcaagaacgaagaggaggaacagacactgacgattctcatcagaaccggcctgctcgtgattagcgggctgtttcccgtctcccttccgatcacagctgccgcctggtacctgtgggaggtgaagaaacagcgggctggagtcctgtgggatgtgccttctccccctcccgttggcaaggcggaactcgaggacggggcctatcgcatcaaacagaaggggattctgggctacagccaaatcggcgctggggtgtataaagaaggaaccttccacacaatgtggcatgtcaccagaggcgccgtgcttatgcacaaggggaagcggattgagccctcctgggccgatgttaaaaaggacctgatctcttacggaggcgggtggaaactcgagggagaatggaaggagggcgaagaggtgcaggtcctggctctcgaacctggcaaaaatccgcgcgccgtgcagacgaagcccgggctgtttaagaccaacgcgggaacaattggcgctgtgagccttgatttctcccctgggaccagcggatctcccatcatcgacaaaaagggcaaagttgtcgggctgtacggaaatggcgtggtgacaagatccggcgcctatgtcagcgccattgctcagaccgagaagtctatcgaggataaccctgaaattgaggacgatatcttccggaaaagaaagctgacaattatggacctccatcccggggccggaaagacgaaacgctacctgcctgcgatcgtgcgggaagctatcaagagaggccttcgcaccctgattctcgccccgacacgggttgtggccgctgagatggaagaggccctgagagggctccccatccgctatcaaacccctgctattcgggccgagcacaccggaagagaaatcgtcgacctgatgtgtcatgcgacatttacgatgcgccttctgtcccccgtgcgggttcctaactacaatctgattatcatggatgaggcccacttcaccgaccccgctagcattgccgctagaggctatatctccacacgggtggaaatgggggaggccgccggcatctttatgaccgctacaccgcctggatctcgcgatcccttcccccagagcaacgcgcctattatggacgaggaaagagagatccccgaacggtcctggagctctggccacgagtgggtcaccgattttaaagggaagacggtgtggttcgttccttccattaaagccggaaatgacatcgctgcctgcctccgcaagaacggcaagaaagtgattcagctgagcagaaagacatttgattctgaatacgtcaaaacccggaccaatgactgggatttcgtggtgacaaccgacatcagcgagatgggggccaactttaaggctgagagagtcatcgatccgcgccggtgtatgaaacccgttattcttacagacggagaagagagagtgatcctggccggccctatgcccgtgacccattcctctgcggctcaacgccgggggagaattggccgcaatcctaagaacgaaaatgaccagtatatctacatgggagagcccctcgaaaacgatgaggactgcgcccactggaaagaggccaagatgctgctggataatattaacacgccggaaggcatcatccctagcatgttcgagcccgaacgggagaaggtcgacgctattgatggggaatacagactccgcggagaggccagaaaaacatttgtggaccttatgcggcgcggcgatctgcctgtttggctggcgtatagagtggccgctgaggggatcaattacgccgaccggcgctggtgtttcgatggaattaagaacaatcagatcctcgaagagaacgtcgaagtggagatttggaccaaagagggcgaaagaaagaaactgaagccccggtggcttgacgctagaatctattccgatcctctggccctcaaggagttcaaagaatttgctgccgggcgcaagtctctgacactgagcctcattaccgagatgggccggcttcccacgttcatgacccagaaagcgagagacgccctggataacctggctgttctccatacagccgaagctggaggccgcgcctacaatcacgccctgtccgagcttccggagaccctggaaacactcctgctgctcacccttctggctacagtgaccgggggaatctttctgttcctcatgagcggccgggggatcggaaagatgacgctgggcatgtgctgcattatcacagcgtctattcttctgtggtatgcccaaatccagcctcactggattgctgcctccatcatcctcgagtttttcctgattgtcctgctcatccccgaacccgagaaacagagaacccctcaggacaaccaacttacctacgtggtcattgccatcctgacagtggttgctgccaccatggcgaatgaaatgggctttctggagaagacaaagaaagacctcgggctgggaagcattacgacccagcagccggagtccaacatccttgatatcgacctgcggcccgcctctgcttggacactctatgccgtggctaccacattcgtgacccctatgctgcgccatagcattgaaaattcctctgtcaacgttagcctgacggccatcgcgaatcaggccaccgtgctcatgggccttgggaagggatggcccctgtccaaaatggatattggcgtgcctctgctcgctatcgggtgttacagccaagtcaaccccattacactgaccgccgctctttttctgctcgtggcccactacgctatcattggacctggcctgcaggccaaggcgacaagagaggcccagaaacgggctgccgctggcatcatgaagaatccgaccgttgacgggatcacggtgattgatctggaccccatcccttatgatcccaagttcgaaaaacagctcggacaagtcatgcttctggtgctgtgcgtcacacaggtgctcatgatgcgcaccacatgggccctgtgtgaggcccttaccctggcgaccggccctatttctacactctgggaagggaaccccggaagattttggaatacgaccatcgctgtttccatggccaacattttccggggcagctacctggctggggccggactgctcttttctatcatgaagaatacaaccaacacacgcagaggcaccggcaatatcggggagacgcttggagagaaatggaagtcccggctgaacgccctgggcaaaagcgagttccagatttataagaaatctgggatccaagaggtggaccgcacactcgctaaggaaggaattaagagaggcgagaccgatcatcacgccgtcagccgggggtccgcgaaactgagatggttcgtggagcgcaatatggttaccccggaaggaaaggtggtcgaccttggctgcggcagaggcgggtggtcttactattgtggagggctgaaaaacgtgagagaggtgaaggggctcacaaaaggcgggcctggacatgaagaacccatccccatgagcacctacggctggaacctggttcgcctgcagtccggcgtcgatgtgtttttcacacctcccgaaaagtgcgacacgctcctttgtgatattggggagagctcccctaatccgaccgtggaggccggacggacactgagagtcctgaacctcgttgaaaattggctgaacaataacacccagttttgcatcaaggtgcttaatccctatatgccttctgtgatcgagaaaatggaagctctgcagcgcaagtacggcggggccctcgtccggaaccccctgagcagaaattccacacacgagatgtactgggtgtctaacgctagcggaaatattgtttcctctgtgaacatgatcagccgcatgctgattaatcggttcaccatgagacacaaaaaggccacgtatgaacctgacgtcgacctcggctccgggacccgcaacatcggaattgagagcgagatccccaatcttgatatcattggcaaacggatcaagattaagcaagaacatgagacatcttggcactacgaccaggatcatccgtataaaacctgggcgtaccacggctcctatgaaacaaagcagaccgggagcgcctcttccatggtgaacggagttgtgagactgctgacaaaaccttgggacgtcgtgcccatggtgacccagatggctatgacggatacaaccccttttggccaacagcgcgtcttcaaggagaaagttgacaccagaacacaggaacccaaggaggggacgaagaaactcatgaagatcaccgccgagtggctgtggaaagaacttggaaagaaaaagacacctcggatgtgtacccgcgaggaatttacaagaaaagtgcggagcaacgctgccctgggcgctattttcaccgatgagaataagtggaagtctgccagagaggcggtggaagactcccggttttgggagctcgtcgataaagaacgcaacctgcacctggaggggaagtgcgaaacatgtgtgtacaatatgatgggaaaaagagagaagaaactcggcgagttcggcaaggccaaggggagccgggctatctggtatatgtggctgggagcccgctttcttgagttcgaggctctgggctttctcaacgaagaccattggttctccagagagaatagcctgtctggggttgaaggagagggccttcacaaactggggtacattctccgggatgtgagcaagaaagagggcggagccatgtacgccgacgacaccgcgggctgggatacgcgcatcaccctggaagacctgaagaacgaggaaatggtcacaaatcatatggagggggaacacaaaaagctcgctgaggccatcttcaagctgacctatcagaacaaagtggttagagtgcaacggcccacaccgcgcggaaccgtcatggatattatctccagacgggaccagcgcggctctggacaggtgggaacgtacggccttaatacatttaccaacatggaggcccaactgattagacagatggaaggggagggcgttttcaagagcatccagcatctcacagtgaccgaagagattgctgtccagaattggctggcccgggtgggacgcgagagactttcccggatggctatctctggcgatgactgcgtcgtgaaacctctggatgacagatttgccagcgcgctcacggccctgaacgatatggggaaggttcgcaaagacatccaacagtgggaaccctcccggggatggaatgattggacccaggtgcccttctgctctcaccactttcatgagctgattatgaaggacggcagagtcctcgtggtgccttgtcgcaaccaggatgaactgatcgggcgggctagaattagccaaggagccggctggtcccttcgcgagacagcttgcctgggaaagagctatgcccagatgtggtctctcatgtacttccaccggagagacctgcgccttgcggccaatgctatctgttccgccgttccgagccattgggtgcccacctctcggacaacctggtccattcacgctaaacacgaatggatgacagccgaggacatgctgaccgtctggaacagagtgtggatccaggagaacccttggatggaagataagacgcccgttgagagctgggaagagatcccttatctcggcaaacgcgaagaccagtggtgcggatccctgattggcctgacatctcgggctacctgggccaagaatatccaaaccgcgattaaccaggtgagaagcctcatcgggaatgaggagtacacagattatatgccctccatgaaacggtttagacgcgaagaggaagaggccggagtcctgtggtga

SEQ ID NO: 19977 - RNA, 9876 nt, synthetic construct
  misc_feature 1..9876: note = derived and/or modified CDS sequence (opt5) from DENV-2__JF730053__SS-prME
  source 1..9876: mol_type = other RNA
accgccggaatgatcattatgctgatccccaccgtgatggctttccacctcacgaccagaaacggggaacctcatatgattgtgagccggcaggaaaagggaaaatccctgctttttaagacaggcgacggggttaatatgtgcaccctgatggccatggatctcggagaactgtgtgaagacacaatcacctacaaatgcccgcttctgagacaaaacgaacccgaagatattgactgttggtgcaattctacaagcacctgggtgacgtatggcacctgtacaaccacaggggagcaccggcgggagaagcgctccgtggcgctcgtccctcatgtgggaatgggcctggaaaccagaacggagacatggatgtctagcgaaggcgcttggaaacacgcccagcggatcgagacctggatcctgcgccatcccgggttcacaattatggccgctatcctcgcctacaccattggaaccacacactttcagagagctctgatcttcattcttctgacggccgttgcgccttccatgaccatgcggtgcatcggcatttctaaccgcgattttgtggagggggtcagcggaggctcctgggtggacatcgttctcgaacacgggagctgtgtgacaaccatggccaagaataagcccacactggatttcgagcttatcaaaaccgaagctaagcagtctgccacgctgagaaaatattgcattgaggctaagctcacaaacaccaccacagaatcccggtgtcctacccaaggagagccgagcctgaatgaggaacaggacaaacgctttgtctgcaagcattctatggtggatagaggctggggcaacgggtgtggactgttcggcaaaggcgggatcgtgacatgcgccatgtttacgtgcaaaaagaatatgaaagggaaggtcgttcagcccgagaacctcgaatacaccattgtgatcacacctcactccggggaggaacatgcggtgggaaatgacaccggcaaacacggcaaggagattaaaatcacaccccagagctctatcaccgaggccgaactgacggggtatggaaccgtcacaatggagtgttcccctcggaccggccttgatttcaacgaaatggtgctgctccaaatggagaataaggcttggctggttcaccgccagtggtttcttgacctgcccctcccgtggctgcctggggccgatacacagggaagcaactggattcagaaggaaaccctggtgacgttcaaaaatccccatgctaagaaacaagacgtcgtggttctcggctcccaggagggggccatgcacacagccctgaccggcgctacagagatccagatgtctagcggaaaccttctgtttaccggccatctcaagtgcagactgcggatggacaaacttcaactgaaggggatgtcctacagcatgtgtaccggaaagttcaaagtggtcaaggaaattgcggagacacagcacggcacgatcgtgattagagtccagtatgaaggggatggatctccttgcaaaatccccttcgagatcatggacctcgagaagcgccatgtgctgggccggctgattaccgttaaccccatcgtgacagaaaaagattcccctgtcaatattgaggccgaaccgccctttggggacagctacatcattatcggcgtggagcctggacagctcaagctgaactggttcaagaaaggctctagcattgggcaaatgcttgaaaccacaatgagaggagctaagcgcatggccatcctgggcgataccgcctgggactttgggtccctcggaggcgttttcacgtctatcgggaaagctctgcaccaggtgtttggcgccatttacggagcggctttcagcggcgtctcctggacaatgaagatcctgattggggtgatcattacctggatcggaatgaatagccggtctacctcccttagcgtgtctctcgttctggtcggcgtggtgacactgtatctcggggtcatggtgcaggccgattccggatgtgttgtgagctggaaaaacaaggagctgaagtgcggctccgggatctttattaccgacaatgtccacacatggacggagcagtacaaattccaacccgaatctcctagcaaacttgcctccgctatccagaaagcccatgaggaaggcatttgtggaatcagatctgtgacccgcctggagaacctcatgtggaagcagattacacccgaactgaatcacatcctgagcgagaacgaggttaaacttaccatcatgacaggcgatattaaggggatcatgcaggctggaaaacggtccctcagaccgcaacctaccgaactgaagtatagctggaagacgtggggcaaagccaagatgctgtctaccgagtcccataatcagacatttctcattgacgggcccgaaaccgcggagtgccctaacacaaatcgcgcctggaacagcctggaagtggaggattacggattcggcgtctttaccacaaatatctggcttaaactgcgggagaagcaggacgtgttctgtgactctaaactcatgtccgctgccattaaggataacagagctgttcacgccgacatgggctattggatcgaaagcgcgctgaatgatacctggaagatcgagaaagcctcttttattgaagtcaagagctgccactggcccaaatcccatacgctgtggagcaacgaggtccttgagtctgaaatgatcattcctaagaacttcgctgggcccgtgtcccagcacaattaccgcccgggatatcatacacaaaccgccggcccttggcacctcgggaaactggagatggacttcgatttttgtgaaggaaccacagtggtcgttaccgaggactgcggcaaccgggggcccagcctgagaacgacaaccgcttccggaaagctcatcacagaatggtgctgtcggtcttgcaccctgccccctcttcgctacagaggcgaggatggctgttggtacgggatggagattcggccgctgaaggaaaaagaggaaaatctcgtgaacagcctggtgacagccggacatggccagatcgacaatttctccctgggggtccttggaatggccctctttctggaggaaatgctgagaacccgcgtgggcacgaagcacgctattctcctggttgcggtgtctttcgtcacccttatcacagggaacatgagctttcgggatctgggaagagtgatggttatggtgggcgccaccatgacagacgatatcggcatgggggtcacctatctcgctctgctggccgccttcaaagtgcgccccacgtttgctgccggacttctgctcagaaagctgacatccaaagagctcatgatgaccacaattggcatcgttctgctttctcagagcaccattcctgagaccatcctggaactcacagacgcgctggctctggggatgatggtgcttaagatggtccggaagatggagaaataccaactggccgtgacgattatggccatcctctgcgtgcccaatgctgtcatcctgcagaacgcctggaaggtttcctgtaccattctcgcggtggtgagcgtctctcctctgttccttacatccagccagcagaaagctgattggatccccctggccctcaccattaagggactgaatcctacagccatctttctgaccacgctttctcgcacaaacaaaaagagatcctggcccctgaatgaagctattatggccgtgggcatggttagcatcctcgcttcttccctgctcaaaaacgacatcccgatgaccgggcctctggtggccggaggccttctgaccgtctgctatgtgctgacaggccggagcgcggacctcgagctggaacgcgccgctgatgttaagtgggaggaccaagccgagatttccgggagctctcccatccttagcattaccatctccgaagatggatctatgagcattaagaatgaggaagaggagcagacactgacgatcctcattagaaccggcctgctcgtgatctccgggctgttccctgtctctcttcccatcacagctgccgcctggtacctgtgggaagtgaaaaagcagcgggctggagtcctgtgggacgtgccgagccctccccctgttggcaaagcggagctcgaagatggggcctatcgcattaagcagaaaggaatcctgggctactcccaaattggcgctggggtgtataaggagggaacctttcacacaatgtggcatgtcaccagaggcgccgtgcttatgcacaaggggaaacggatcgaaccctcttgggccgacgttaagaaagatctgattagctacggaggcgggtggaagctcgagggagagtggaaagaaggcgaggaagtgcaggtcctggctctcgagcccggcaagaaccctcgcgccgtgcagacgaagccggggctgttcaaaaccaatgcgggaacaatcggcgctgtgtcccttgactttagccccgggacctctggatcccctatcattgataagaaaggcaaggttgtcgggctgtacggaaacggcgtggtgacaagaagcggcgcctatgtctctgccatcgctcagaccgaaaaatccattgaggacaaccccgagatcgaagatgacattttccggaagagaaagctgacaatcatggatctccatcctggggccggaaaaacgaagcgctacctgcccgcgatcgtgcgggaggctattaaaagaggccttcgcaccctgatcctcgcccctacacgggttgtggccgctgaaatggaggaagccctgagagggctcccgattcgctatcaaacccccgctatccgggccgagcacaccggaagagagattgtcgacctgatgtgtcatgcgacattcacgatgcgccttctgagccctgtgcgggttcccaattacaacctgatcattatggacgaagcccactttaccgatcctgcttccatcgccgctagaggctatatctctacacgggtggagatgggggaagccgccggcattttcatgaccgctacacccccgggaagccgcgacccttttccccagtccaatgcgcccatcatggatgaggagagagaaattcctgagcggagctggtcttccggccacgaatgggtcaccgacttcaaggggaaaacggtgtggtttgttcccagcatcaaggccggaaacgatattgctgcctgcctccgcaagaatggcaaaaaggtgatccagctgtctagaaaaacattcgacagcgagtacgtcaagacccggaccaacgattgggactttgtggtgacaaccgatatctccgaaatgggggccaatttcaaagctgagagagtcattgaccctcgccggtgtatgaagccggttatccttacagatggagaggaaagagtgattctggccggccccatgcctgtgacccattctagcgcggctcaacgccgggggagaatcggccgcaaccccaaaaatgagaacgaccagtatatttacatgggagaacctctcgagaatgacgaagattgcgcccactggaaggaggccaagatgctgctggacaacatcaatacgcccgagggcatcattccgtccatgtttgaacctgagcgggaaaaagtcgatgctatcgacggggagtacagactccgcggagaagccagaaagacattcgtggatcttatgcggcgcggcgacctgcccgtttggctggcgtatagagtggccgctgaggggattaactacgccgatcggcgctggtgttttgacggaatcaaaaataaccagattctcgaggaaaacgtcgaggtggaaatctggaccaaggagggcgagcgcaagaagctgaagcctcggtggcttgatgctagaatttattctgaccccctggccctcaaagagttcaaggagttcgctgccgggcgcaaaagcctgacactgtccctcatcaccgaaatgggccggcttcctacgtttatgacccagaaggcgagagatgccctggacaatctggctgttctccatacagccgaggctggaggccgcgcctacaaccacgccctgagcgaacttcccgagaccctggagacactcctgctgctcacccttctggctacagtgaccgggggaatcttcctgtttctcatgtctggccgggggattggaaaaatgacgctgggcatgtgctgcatcattacagcgtccatccttctgtggtatgcccaaattcagccgcactggatcgctgccagcatcattctcgagttctttctgatcgtcctgctcattcctgagcccgaaaagcagagaacaccccaggataatcaacttacctacgtggtcatcgccattctgacagtggttgctgccaccatggcgaacgagatgggcttcctggaaaagacaaagaaggacctcgggctgggatccatcacgacccagcagcctgagtctaatatccttgacattgatctgcggccggccagcgcttggacactctatgccgtggctaccacatttgtgacccccatgctgcgccattccatcgagaactctagcgtcaatgtttccctgacggccattgcgaaccaggccaccgtgctcatgggccttgggaaaggatggcctctgagcaagatggacatcggcgtgcccctgctcgctattgggtgttactctcaagtcaatcctatcacactgaccgccgctcttttcctgctcgtggcccactacgctattatcggacccggcctgcaggccaaagcgacaagagaagcccagaagcgggctgccgctggcatcatgaagaaccctaccgttgatgggattacggtgatcgacctggatccgattccctatgaccctaaatttgagaagcagctcggacaagtcatgcttctggtgctgtgcgtcacacaggtgctcatgatgcgcaccacatgggccctgtgtgaagcccttaccctggcgaccggccccatctccacactctgggaggggaatcctggaagattctggaacacgaccattgctgttagcatggccaatatctttcggggctcttacctggctggggccggactcctgttctccatcatgaaaaacacaaccaatacacgcagaggcaccggcaacattggggaaacgcttggagagaagtggaaaagccggctgaatgccctgggcaagtctgagtttcagatctataaaaagagcgggattcaagaagtggatcgcacactcgctaaggagggaatcaaaagaggcgaaaccgaccatcacgccgtctcccgggggtctgcgaagctgagatggttcgtggagcgcaacatggttacccccgagggaaaagtggtcgatcttggctgcggcagagggggatggagctactattgtggcgggctgaagaacgtgagagaagtgaaaggactcacaaagggcgggccgggacatgaggaacctattcccatgtccacctacggctggaatctggttcgcctgcagagcggcgtcgacgtgttctttacaccccctgagaagtgcgatacgctcctttgtgacatcggggaatcctctcccaaccctaccgtggaggccggacggacactgagagtcctgaatctcgttgagaactggctgaataacaatacccagttctgcatcaaagtgcttaacccgtatatgcccagcgtgattgaaaagatggaggctctgcagcgcaaatacggcggggccctcgtccggaatcctctgtccagaaactctacacacgaaatgtactgggtgagcaatgcttccggaaacatcgtttctagcgtgaatatgatttcccgcatgctgatcaaccggtttaccatgagacacaagaaagccacgtatgagcccgatgtcgacctcggcagcgggacccgcaatattggaatcgaatctgagatccctaaccttgacattatcggcaagcggattgagaagatcaaacaagaacatgagacatcctggcactacgatcaggaccatccctataagacctgggcgtaccacggcagctatgaaacaaaacagaccgggtctgcctccagcatggtgaacggagttgtgagactgctgacaaagccgtgggatgtcgtgcctatggtgacccagatggctatgacggacacaacccccttcggccaacagcgcgtctttaaagagaaggttgataccagaacacaggaacctaaggaggggacgaaaaagctcatgaaaattaccgccgagtggctgtggaaggaacttggcaaaaagaaaacaccccggatgtgtacccgcgaggagttcacaagaaaggtgcggtctaatgctgccctgggcgctatctttaccgacgagaacaagtggaaatccgccagagaggcggtggaagatagccggttctgggagctcgtcgacaaggaacgcaatctgcacctggaggggaaatgcgaaacatgtgtgtacaacatgatgggaaagagagagaaaaagctcggcgagtttggcaaggccaaagggtcccgggctatttggtatatgtggctgggagcccgcttccttgaatttgaggctctgggcttcctcaatgaagatcattggtttagcagagagaactctctgagcggggttgaaggagagggccttcacaagctggggtacatcctccgggacgtgtccaaaaaggagggcggagccatgtacgccgatgacaccgcgggctgggacacgcgcatcaccctggaagatctgaaaaatgaggaaatggtcacaaaccatatggagggggaacacaagaagctcgctgaggccattttcaaactgacctatcagaataaggtggttagagtgcaacggcctacaccccgcggaaccgtcatggacatcatttctagacgggatcagcgcggcagcggacaggtgggaacgtacggccttaacacattcaccaatatggaggcccaactgatcagacagatggaaggggagggcgtttttaaatccattcagcatctcacagtgaccgaagagatcgctgtccagaactggctggcccgggtgggacgcgagagactttctcggatggctatcagcggcgacgattgcgtcgtgaagccgctggacgatagattcgcctccgcgctcacggccctgaatgacatggggaaagttcgcaaggatattcaacagtgggaaccttctcggggatggaacgactggacccaggtgcccttttgcagccaccacttccatgagctgatcatgaaggatggcagagtcctcgtggtgccctgtcgcaatcaggacgaactgattgggcgggctagaatctcccaaggagccggctggagccttcgcgagacagcttgcctggggaaatcttatgcccagatgtggtccctcatgtactttcaccggagagatctgcgccttgcggccaacgctatttgtagcgccgttccttctcattgggtgccgacctcccggacaacctggagcatccacgctaagcacgaatggatgacagccgaggacatgctgaccgtctggaacagagtgtggatccaggagaatccctggatggaagacaaaacgcctgttgagtcctgggaagagattccctatctcggcaagcgcgaagatcagtggtgcggatctctgatcggcctgacaagccgggctacctgggccaaaaacattcaaaccgcgatcaatcaggtgagatccctcattgggaacgaggagtacacagactatatgcctagcatgaagcggttcagacgcgaagaggaagaggccggagtcctgtggtga

SEQ ID NO: 19978 - RNA, 9876 nt, synthetic construct
  misc_feature 1..9876: note = derived and/or modified CDS sequence (opt5) from DENV-2__EU529706__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattatggatctcgagaaacgccatgtcctgggccggctgatcaccgtgaaccctattgttacagaaaaggacagcccggtgaacatcgaggccgaacccccttttggggattcttacattatcatcggcgtcgagcccggacagctcaaactgaattggttcaagaagggctccagcattgggcaaatgtttgagaccacaatgagaggagctaaacgcatggccatccttggcgacaccgcctgggatttcgggtctctgggaggcgtgtttacgagcattgggaaggctctccaccaggttttcggcgccatctacggagcggctttttccggcgtgtcttggacaatgaaaattctgatcggggtcatcattacctggatcggaatgaacagccggtccaccagcctgtctgtgtcccttgtgctcgttggcgtcgtgacactgtatctgggggtgatggtccaggccgacaccggatgtgtggttagctggaagaataaagaactcaagtgcggctctgggattttcatcacagataacgtgcacacgtggaccgagcagtacaagtttcaacctgaatcccccagcaaactggcctccgctattcagaaggcccatgaggaaggcatctgtggaatcagatctgtcacacgccttgagaatctgatgtggaaacagattaccccggagctcaaccacatcctgagcgaaaatgaggtgaagctgacaattatgaccggcgacatcaaagggattatgcaggctggaaagcggtcccttagacctcaacccacggaactcaaatattcttggaagacctggggcaaggccaaaatgctgagcacagagtcccataaccagaccttcctgatcgatgggcctgaaacagcggagtgccccaataccaaccgcgcctggaatagcctcgaggttgaagactacggatttggcgtgttctctacaaacatctggctgaaacttcgggagaaacaggacgtcttttgtgattccaagctgatgagcgctgccattaaagacaatagagctgtgcacgccgatatgggctattggatcgaatctgcgctcaacgacacctggaagatggagaaggcctccttcattgagatcaaaagctgccactggcctaagtctcatacgctgtggagcaatggggttctggaatccgagatgattatccccaaaaacttcgctggaccggtgagccagcacaactaccgccctggctatcatacacaaaccgccgggccctggcaccttggaaagctcgaaatggattttgacctgtgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcagatcgataacttctctctgggagtgcttggcatggccctctttctggaagagatgctgagaacccgcattgggacgaaacacgctatcctcctggtggcggtcagcttcgtgacccttattacaggaaatatgtcctttcgggacctgggcagagttatggtgatggtcggcgccaccatgacagatgacatcgggatgggagtgacctatctcgctctgctggccgccttcaaggttcgccctacgtttgctgccggccttctgctcagaaaactgacatctaaggagctcatgatggcgaccattgggatcgctctgcttagccagtccacaatccccgaaaccattctggagctcaccgatgccctggccctgggaatgatggtgcttaaaatcgtccggaacatggaaaagtaccaactggctgtgacaattatggccatctcttgcgttcctaatgcggtgattctccagaacgcttggaaggtcagctgtacgatcctggccgccgtgtccgtgagccccctcctgcttacctcttcccagcagaaagctgactggatccctctggccctcacaattaagggcctgaatcccaccgctatcttcctgacaacccttagccgcacgtctaaaaagagatcctggccgctgaacgaggccgtcatggcggttgggatggtgagcattctcgcctcttccctgctcaaaaatgacatccctatgacaggacccctggtggctggcggccttctgaccgtctgctatgtgctgaccgggcggagcgccgatctcgaactggagcgcgctgccgacgttaagtgggaggatcaagccgaaatttccggaagctctcctatccttagcattacaatctccgaggacggctctatgagcatcaaaaacgaagaggaggaacacaccctgacaattctcatcagaacggggctgctcgtgatttccggagtctttcccgtgtctatcccgattaccgctgcggcctggtacctgtgggaggttaagaagcagcgggctggcgtgctttgggatgtcccttctccccctcccgtggggaaagccgaactggaggacggagcctatcgcatcaagcagagaggcatcttcggctactcccagattggggctggagtctataaagaaggcacatttcataccatgtggcacgtgacaagaggggccgttctgatgcatcgcggaaagagaatcgagccctcctgggcggatgtgaaaaaggacctcattagctacggcgggggatggaagctggagggcgaatggaaagagggcgaagaggtccaagtgcttgctctggaacctgggaagaatccgcgggccgttcagaccaaacccggactcttcaagacgaacaccggcacaatcggggccgtgtccctggattttagccctggaacctctggctcccccattgtcgacagaaaagggaaggtggtgggactctacggcaatggcgttgtcacacgcagcggggcttatgtgtctgccatcgcgcagaccgagaagtccatcgaggataaccctgaaattgaggacgatatcttccggaaaaagagactgacaattatggaccttcaccccggagctggcaaaacgaagcgctacctgcctgccatcgtgcgggaagccattaaaagagggctgcgcaccctcatcctggctccgacacgggtcgtggccgctgagatggaagaggcccttagaggactgcccattcgctatcagacccctgcgatccgggccgagcataccggcagagaaatcgttgacctcatgtgtcacgctacattcacgatgcggctgctcagccccgtgcgcgtccctaactacaatctgattatcatggatgaggcccactttaccgaccccgcttccattgccgccagagggtatatctctacacgggtggaaatgggcgaggctgcgggaattttcatgaccgccacaccgcctggcagccgcgatccctttccccaatccaacgctcctatcatggacgaggaaagagagatccccgaacggagctggaactctgggcatgagtgggttaccgatttcaagggaaagacggtgtggtttgtcccttccattaaagccggcaacgacatcgccgcttgccttagaaagaatgggaaaaaggtgattcagctgagccgcaaaacattcgattctgaatacgttaagacccgggccaacgactgggattttgtggtcaccacagacatcagcgagatgggagcgaatttcagagctgagcgcgtgattgatccgcggagatgtatgaagcccgtgatcctgaccgacggcgaagaacgcgtcatcctcgccgggcctatgcccgttacacactcctctgccgctcagcggagaggccgcattggaagaaaccctaaaaatgaaaacgaccaatatatctacatgggcgagcccctggaaaatgatgaggactgcgcccattggaaggaggcgaaaatgcttctggataacattaataccccggaagggatcattcctagcatgtttgagcccgaacgggagaaggtggacgccatcgatggagaataccgcctcagaggcgaggctcggaaaacgttcgtggacctgatgcgcagaggggatctgcctgtctggctcgcctatcgggtggctgccgagggaattaactacgctgacagacgctggtgttttgatggcatcaagaataaccagatccttgaagagaacgttgaagtggagatttggacaaaagagggggaacggaagaagctgaaacccagatggctggacgcccgcatctattccgatcctctcgcgctgaaggagttcaaagagttcgccgctggccggaagtctcttaccctgaatctcattacagagatgggaagactgcccacctttatgacgcagaaagcccgggacgctctggataacctcgccgtccttcacaccgccgaagtgggcgggcgcgcttacaatcacgcgctgagcgagctgccggagacactcgaaaccctgcttctgctcacactgctggccaccgttacaggaggcatcttcctctttcttatgtccgggaagggaattggcaagatgaccctgggcatgtgctgcatcatcacggctagcattctgctctggtatgcccagatccaacctcattggattgccgcttctatcattctggagttctttcttatcgtgctgctcatccccgaacccgagaaacagagaacacctcaggacaaccagctgacctacgtcgtgattgccatcctgaccgtcgtggcggccacaatggctaatgaaatggggttcctcgagaagaccaaaaaggaccttggactgggctccattacaacgcaagagagcgaatccaacatcctggatattgacctccggccggcctctgcttggaccctgtatgccgttgcgacaacctttgtgacacccatgcttcgccacagcatcgaaaatagctctgtgaacgtcagcctgaccgccattgctaatcaggccacggttctcatggggctgggaagaggctggcctctgtccaaaatggatatcggggtgcccctccttgctatcggatgttacagccaggtgaaccctattaccctgacagccgctctgctcctgcttgtcgcccattacgcgatcattggccccggcctgcaggccaaggctacccgggaagcccaaaagcgcacagctgccgggatcatgaaaaatcctaccgtggacggaattacggttatcgatctcgagccgatcccctatgaccctaagttcgaaaaacagctgggccaggtgatgctgctcgtcctttgcgtgacacaggtcctgatgatgagaaccacatgggccctgtgtgaggcgctcaccctggctaccgggcccatttctacactttgggagggaaaccctggccggttttggaatacgaccatcgccgtgtccatggctaacattttccgcgggagctacctggccggagccggcctcctgttttctatcatgaagaatacaaccaacacaagacggggcaccgggaatattggagaaacgctgggcgagaaatggaagtccagactcaacgctcttggaaagagcgagttccaaatctataaaaagtctggaatccaggaggttgatcgcacactggccaaagagggcattaagagaggggaaaccgaccaccatgcggtgagcagaggatccgccaaactgcgctggtttgtcgagcggaacatggtgacccccgaaggcaaggttgtggatctcggctgcgggagaggaggctggtcttactattgtgggggactgaaaaatgtccgcgaggtgaagggccttacaaaagggggaccgggccacgaggaacctatccccatgagcacctacggctggaacctggtgcggctccagtccggggttgacgtcttcttcacaccccctgagaaatgcgatacgctgctgtgtgacattggagaaagctcccccaatcctaccgtggaggctggcagaacactccgcgtgcttaacctggtcgaaaattggctgaacaataacacccaattttgcgttaaggtgctcaatccgtatatgccctctgtgatcgagaaaatggaagccctgcagcggaagtacgggggagctcttgtcagaaaccctctgagccgcaattccacacacgagatgtactgggtgtctaacgccaccggcaatattgttagctccgtgaacatgatctctcggatgctcatcaatagattcacgatgaaacataagaaggcgacctatgagcccgatgtcgacctggggagcggaacacgcaacattggcatcgaatccgagattcctaacctggacatcattggcaaaagaatcgaaaagattaaacaggagcacgaaaccagctggcattacgatcaggaccacccctataagacatgggcctaccacgggtcttatgagaccaaacaaacaggatccgctagctctatggtgaatggcgttgtgaagctccttaccaagccgtgggatgtcgtgcctatggtgacgcagatggccatgacagacaccaccccctttgggcagcagcgggtcttcaaagagaaggttgatacacgcacgcaagaacctaaagagggaaccaagaaactgatgagaatcacagctgaatggctgtggaaggagctcggccggaagaaaacccccagaatgtgtacacgggaggaatttacccgcaaggtgagatccaacgccgctctgggggccatcttcacagacgagaataaatggaaaagcgcgcgggaagccgtggaggattctcgcttttgggaacttgtcgacagagagcggaacctgcatctcgagggaaaatgcgaaacctgtgtgtacaatatgatgggcaagcgcgagaaaaagctgggcgagttcgggaaggctaaaggatccagagccatttggtatatgtggctgggcgctcggtttctcgagttcgaagccctggggtttcttaacgaggatcactggttcagccgcggaaattccctgagcggcgttgagggggaaggcctccataagctgggatacatccttagagacgtgtctaaaaaggagggcggggccatgtacgcggatgacacggctggatgggacacccggattacactggaagatctcaaaaacgaggaaatggtcaccaatcacatgaagggcgagcataagaaactggccgaggccatctttaagctgacatatcagaacaaagtggttcgcgtgcagagacctacaccccgggggacggtcatggacattatcagccgcaaggatcagagaggatccggccaagtggggacatacggcctcaataccttcacaaacatggaagctcagctgatccggcagatggagggagaaggcattttcaaatctatccaaagacttaccgttacggaggagattgccgtgcagaattggctggctcgcgtcgggcgggaaagactcagccgcatggccatctccggagacgattgcgtggtcaagccgctggacgatcggtttgcgtctgcccttaccgctctgaacgacatgggcaaggtgagaaaagatattcagcagtgggagcctagccgcgggtggaatgactggacacaagttcccttctgctcccaccactttcatgaactcgtgatgaaggatggacgggtcctggtggtgccctgtagaaaccaggacgagctgatcggccgcgcccggatctctcagggggctggctggagcctcaaagaaaccgcctgcctgggaaagtcctatgcgcagatgtggacacttatgtacttccacagacgcgatctgcggctcgccgctaacgccatttgtagcgctgttccttctcattgggtgccgacctccagaacaacctggagcatccacgccaaacacgagtggatgacgacagaggacatgctggctgtctggaatcgggtgtggattcaagaaaacccctggatggaggacaagacccctgttgaatcttgggaggaagtgccctatcttggcaagagagaggatcagtggtgcgggtccctgatcggactcaccagccgcgccacatgggcgaaaaatattcagaccgccatcaaccaggtccggtccctgattggcaatgaggaatacacagactatatgccttctatgaagagatttcgcaaagaggaagaggaagctggggtgctgtggtga

SEQ ID NO: 19979 - RNA, 9876 nt, synthetic construct
  misc_feature 1..9876: note = derived and/or modified CDS sequence (opt5) from DENV-2__EU482720__SS-prME
  source 1..9876: mol_type = other RNA
accgccggagtgatcattatgctgatccccaccgctatggccttccacctcacgaccagaaatggggagcctcatatgattgttggacggcaggaaaagggcaaaagcctgctttttaagaccgaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaaccatggccgctatcctcgcctacaccattggaacaacgcactttcagagagctctgatcttcattcttctgaccgccgtggcgcctagcatgacaatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacggaggctaagcagcctgccacactgagaaaatattgcattgaagctaagctcaccaacaccacaaccgagagccggtgtccgacacaaggagagccctctctgaatgaggaacaggacaaacgctttatctgcaagcattccatggtggatagaggctggggcaacgggtgtggactgttcggcaaagggggaattgtgacgtgcgccatgtttacctgcaaaaagaatatggaaggcaaagtcgttctccctgagaacctggaatacacaatcgtgattacaccccacagcggggaggagcatgcggtgggaaatgacacaggcaagcacggcaaagaaatcaagatcacccctcagtcttccattacggaggccgaacttaccgggtatggaacagtcaccatggagtgtagcccccggacaggcctggatttcaacgaaatggtgctcctgcagatggaggacaaggcttggcttgttcaccgccaatggtttctggatctcccgctgccttggctgcccggggccgacacccagggatctaattggatccagaaggagacgctcgtgacattcaagaaccctcatgctaaaaagcaggacgtcgtggttctgggctcccaagaaggggccatgcacaccgcccttacaggcgctaccgagattcagatgagctccggaaatctgctctttaccggccatctgaaatgcagacttcggatggataagctgcagctcaaagggatgtcttacagcatgtgtacaggaaagttcaagatcgtgaaagaaattgcggagacgcaacacggcaccatcgtcatcagagtgcagtatgagggggacggatccccctgcaagattcccttcgaaatcatggatctggagaaacgccatgtcctgggccggctcattacagtgaaccctatcgccaccgaaaaggacagcccggttaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacggcttgggatttcgggtctctcggaggcgtctttacaagcatcgggaaggccctgcaccaagtgttcggcgcgatttacggagctgccttttccggcgtttcttggaccatgaaaatcctgattggggtgatcatcacctggattggaatgaacagccggtccacaagcctttctgtctccctcgtgctggtgggcatcgttaccctgtatctcggggtcatggtgcaggccgacacaggatgtgtggtcagctggaagaataaagaactgaagtgcggctctgggattttcatcacggataacgtgcacacctggacagagcagtacaagtttcagcctgaatcccccagcaaacttgcttccgccattcaaaaggctcatgaggaaggcatctgtggaatcagatctgttacccgcctggagaatctcatgtggaaacagattacaccggagctgaaccacatcctgagcgaaaatgaggtgaaacttaccattatgacgggcgacatcaaagggattatgcaggccggaaagcggtccctcagacctcagcccaccgaactgaaatattcttggaagacatggggcaaggcgaaaatgctgagcaccgagtcccataaccaaacattcctcatcgatgggcctgaaaccgccgagtgccccaatacaaaccgcgcttggaatagcctggaggtcgaagactacggatttggcgtgttctctaccaacatctggcttaagctgcgggagaaacaggacgtcttttgtgattccaagctcatgagcgccgctattaaagacaatagagccgtgcacgcggatatgggctattggatcgaatctgccctgaacgacacgtggaagatggagaaggcttccttcattgagatcaaaagctgccactggcctaagtctcatacactgtggagcaatggggtccttgaatccgagatgattatccccaaaaacttcgccggaccggtgagccagcacaactaccgccctggctatcatacccagaccgctgggccctggcacctcggaaagctggaaatggattttgacttctgtgagggcacaaccgttgtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgtgaatagcctggtgaccgccggccatgggcaaatcgataacttttctctgggagtccttggcatggctctcttcctggaagagatgctgagaacgcgcgttgggaccaaacacgcgattctcctggtggccgtgagctttgtcacacttatcaccggaaatatgtccttccgggacctgggcagagtgatggttatggtgggcgctacaatgaccgatgacattgggatgggagtcacgtatctcgccctgctggccgcttttaaggtgcgccctacattcgccgcgggccttctgctcagaaaactgacctctaaggagctcatgatggctacaatcgggattgccctgcttagccagtccaccatccccgaaaccatcctggagctcacagatgccctggctctgggaatgatggttcttaaaattgtgcggaacatggaaaagtaccagctggccgtcacgatcatggcgatttcttgcgtgcctaatgctgttatcctccaaaacgcctggaaggtgagctgtaccattctggccgctgtctccgtgagccccctcctgcttacatcttcccagcagaaagccgactggatccctctggctctcaccatcaagggcctgaatcccacagccatttttctgaccacgcttagccgcacatctaaaaagagatcctggccgctgaacgaggcggtgatggccgtcgggatggttagcatcctcgcttcttccctgctcaaaaatgacattcctatgaccggacccctggtggccggcggccttctgaccgtgtgctatgtcctgacagggcggagcgctgatctcgaactggagaaggccgccgacgtgaaatgggaggatcaggctgaaatctccggaagctctcctattcttagcatcaccatttccgaggacggctctatgagcatcaagaacgaagaggaggaacacacactgacgatcctcattcgcaccgggctgctcgttatctccggagtgttccccgtctctattccgatcacagcggccgcttggtacctgtgggaggtgaagaaacaaagagccggcgttctttgggatgtgccttctccccctcccgtcgggaaggccgaactggaggacggagcttatcggattaaacagcgcggcatctttggctactcccagatcggggccggagtgtataaggaaggcaccttccatacaatgtggcacgtcaccagaggggcggtgctgatgcatcggggaaaacgcattgagccctcctgggctgatgttaagaaggacctcatcagctacggcgggggatggaaactggagggcgaatggaaggagggcgaagaggtgcaggtccttgccctggaacctgggaaaaatccgagagccgtgcaaacgaagcccggactctttaaaaccaacacaggcaccattggggctgtttccctggatttcagccctggaacatctggctcccccatcgtggaccggaaggggaaggtcgtgggactctacggcaatggcgtggttaccagaagcggggcctatgtctctgcgattgctcagacagagaaatccatcgaggataaccctgaaatcgaggacgatattttccgcaagaaacggctgacgatcatggaccttcaccccggagccggcaagaccaaaagatacctgcctgccattgtgcgcgaagctatcaagcgggggctgagaacactcattctggccccgacccgcgtggtcgctgccgagatggaagaggcgcttcggggactgcccatcagatatcagacccctgccattcgcgctgagcatacaggccgggaaatcgtggacctcatgtgtcacgccacgtttaccatgagactgctcagccccgttcgggtgcctaactacaatctgatcattatggatgaggctcacttcacagaccccgcctccatcgccgctcgcgggtatatttctaccagagtcgaaatgggcgaggcggccggaatctttatgacagctaccccgcctggcagccgggatcccttcccccagtccaacgcccctattatggacgaggaacgcgagatccccgaaagaagctggaactctgggcatgagtgggtgacggattttaagggaaaaacagtttggttcgtgccttccatcaaggccggcaacgacattgctgcctgccttcggaaaaatgggaagaaagtcatccaactgagcagaaagacctttgattctgaatacgtgaagacccgcgcgaacgactgggatttcgttgtgacaaccgacattagcgagatgggagctaattttcgggccgagagagtcatcgatccgcgccggtgtatgaaacccgtgattctgacagacggcgaagagagagtgatcctcgccgggcctatgcccgtcacccactcctctgctgcccagcgccggggcagaatcggacgcaaccctaagaatgaaaacgaccagtatatttacatgggcgagcccctggaaaatgatgaggactgcgcgcattggaaagaggccaagatgcttctggataacatcaatacgccggaagggattatccctagcatgttcgagcccgaaagagagaaagttgacgctattgatggagaataccggctccgcggcgaggccagaaagacatttgtggacctgatgcggcgcggggatctgcctgtgtggctcgcttatagagtcgccgctgagggaatcaactacgccgaccggagatggtgtttcgatggcattaaaaataaccaaatccttgaagagaacgtggaagttgagatctggaccaaggagggggaacgcaagaaactgaagccccggtggctggacgcgagaacatattccgatcctctcgccctgaaagagttcaaggaatttgctgccggccgcaaatctcttaccctgaatctcattacggagatgggacggctgcccaccttcatgacacagaaggctagagacgccctggataacctcgccgtgcttcacaccgctgaagtcggcgggcgggcgtacaatcacgccctgagcgagctgccggagacactcgaaaccctgcttctgctcacactgctggctaccgtgacgggaggcatctttctcttccttatgtccgggaagggaattggcaaaatgacactgggcatgtgctgcatcattaccgccagcatcctgctctggtatgcccagatccagcctcattggattgctgcctctatcattctggagtttttccttatcgttctgctcattcccgaacccgagaagcaacgcacccctcaggacaaccagctgacatacgtggtcatcgcgatcctgaccgtggtcgccgctacaatggccaatgaaatggggtttctcgagaaaacgaagaaagaccttggactgggctccattaccacacaggagagcgaatccaacatcctggatattgacctcagaccggcttctgcctggaccctgtatgcggtggccacaaccttcgttacgcccatgcttcggcacagcatcgaaaattcctctgtgaacgtgagcctgaccgctattgccaatcaagctacagtcctcatggggctgggacgcggctggcctctgtccaagatggatatcggggttcccctccttgccattggatgttacagccaggtgaaccctatcaccctgacagctgccctgctcctgcttgtggcgcattacgccatcattggccccggcctgcaggctaaggccaccagagaagctcagaaacggacggccgccgggatcatgaagaatcctacagtcgacggaattaccgtgatcgatctcgagccgattccctatgaccctaaatttgaaaagcaactgggccaggttatgctgctcgtgctttgcgtcacacaggtgctgatgatgcgcaccacctgggcgctgtgtgaggctctcacactggccacggggcccatctctaccctttgggagggaaaccctggcagattctggaatacaaccatcgctgtctccatggccaacatttttcgggggagctacctggccggagctggcctcctgttctctatcatgaaaaatacaaccaacacgcgcagaggcacagggaatattggagaaaccctgggcgagaagtggaagtcccggctcaacgcccttgggaaaagcgaatttcagatctataagaaatctggcattcaagaggtggatagaaccctggcgaaggagggcatcaaacgcggggaaacagaccaccatgccgttagccggggatccgctaagctgagatggttcgtggagcgcaacatggtcacccccgaaggcaaagtggttgatctcggctgcgggcggggaggctggtcttactattgtgggggactgaagaatgtgagagaggtcaagggccttacaaaagggggaccgggccacgaagaacctatccccatgagcacgtacggctggaacctggtgcgcctccagtccggggtggacgttttctttacaccccctgagaagtgcgatacactgctgtgtgacattggagaaagctcccccaatcctaccatcgaggccggccggacactcagagtccttaacctggtggaaaattggctgaacaataacacccagttctgcgtgaaagtcctcaatccgtatatgccctctgttattgagaagatggaaacgctgcaacgcaaatacgggggagctcttgtgcggaaccctctgagcagaaattccacccacgagatgtactgggtgtctaacgccacaggcaatatcgtcagctccgtgaacatgatttctcgcatgctcatcaatcggtttaccatgaagcataagaaagcgacatatgagcccgatgttgacctggggagcggaaccagaaacatcggcattgaaaacgagatccctaatctggacattatcggcaagcgcattgagaagatcaagcaggagcacgaaacatcctggcattacgatcaggaccacccctataaaacctgggcctaccacgggagctatgagacgaagcagacaggatctgcttccagcatggtgaacggcgtcgtgaagctccttaccaaaccgtgggatgttgtgcctatggtcacccaaatggccatgacagacacgacccccttcgggcagcagagagtgtttaaggagaaagtggatacacggacccaggaacctaaggagggaaccaaaaagctgatgcgcattaccgctgaatggctgtggaaggagctcggcaaaaagaaaacacccagaatgtgtacccgggaggagttcacgagaaaggtccggtctaatgccgctctgggggccatctttaccgacgagaacaaatggaagtccgcgcgcgaagccgttgaggatagcagattctgggaacttgtggaccgggagcgcaatctgcatctcgagggaaaatgcgaaacatgtgtgtacaacatgatgggcaagagagagaagaaactgggcgaatttgggaaggctaaaggatctcgggccatctggtatatgtggctgggcgctcgcttcctcgagtttgaagccctggggttccttaatgaggatcactggttttccagaggaaacagcctgtccggcgtcgagggggaaggcctccataagctgggatacattcttcgggacgtgagcaaaaaggagggcggggccatgtacgcggatgacaccgctggatgggacacacgcatcaccctggaagatctcaagaatgaggaaatggttacgaaccacatgaaaggcgagcataagaaactggccgaggccattttcaagctgacatatcaaaataaagtggtcagagtgcagcggcctacaccccgcgggacagttatggacatcatttctagaaaggatcagcggggaagcggccaggtggggacctacggcctcaacacgttcaccaatatggaagctcaactgatccgccagatggagggagaaggcatctttaagtccattcagagacttacagtcaccgaggagatcgccgtgcaaaactggctggctcgggttgggagagaacgcctctctcggatggccattagcggagacgattgcgtggtcaaaccgctggacgatagattcgcgtccgcccttacagctctgaatgacatgggcaaggtgcgcaaagatatccagcagtgggagccttctcgggggtggaacgactggacccaggtccccttttgcagccaccacttccatgaactcgtgatgaaggatggaagaatgctggttgtgccctgtcgcaaccaagacgagctgattggccgggccagaatctcccagggggctggctggtctctcaaagaaacagcctgcctgggaaagagctatgcgcagatgtggacccttatgtactttcaccgccgggatctgagactcgccgctaatgccatctgttccgctgtccctagccattgggtgccgacgtctcgcacaacctggtccattcacgccaagcacgagtggatgaccacagaggacatgctggctgtgtggaaccgggtttggatccaggaaaatccctggatggaggacaaaacccctgtggaaagctgggaggaagtcccctatcttggcaagagagaggatcaatggtgcgggtctctgattggactcacatcccgggccacgtgggcgaaaaacatccagaccgccattaatcaggtgagaagcctgatcggcaacgaggaatacacagactatatgccttccatgaagcgcttccggaaagaggaagaggaagctggggttctgtggtga

SEQ ID NO: 19980 - RNA, 9876 nt, synthetic construct
  misc_feature 1..9876: note = derived and/or modified CDS sequence (opt5) from DENV-2__EU482721__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaaccatggccgctatcctcgcctacaccattggaacaacgcactttcagagagctctgatcttcattcttctgaccgccgtggcgcctagcatgacaatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacggaggctaagcagcctgccacactgagaaaatattgcattgaagctaagctcaccaacaccacaaccgagagccggtgtccgacacaaggagagccctctctgaatgaggaacaggacaaacgctttatctgcaagcattccatggtggatagaggctggggcaacgggtgtggactgttcggcaaagggggaattgtgacgtgcgccatgtttacctgcaaaaagaatatggaaggcaaagtcgttcagcctgagaacctcgaatacacaatcgtgattacaccccacagcggggaggagcatgcggtgggaaatgacacaggcaagcacggcaaagaaatcaagatcacccctcagtcttccattacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcatggatctcgagaaacgccatgtcctgggccggctgattacagtgaaccctatcgttaccgaaaaggacagcccggtgaacattgaggccgaacccccttttggggattcttacatcattatcggcgtcgagcccggacagctcaaactgaattggttcaagaagggctccagcatcgggcaaatgtttgagacaaccatgagaggagctaaacgcatggccattcttggcgacacggcctgggatttcgggtctctgggaggcgtgtttacaagcatcgggaaggctctccaccaggttttcggcgccatttacggagcggctttttccggcgtgtcttggaccatgaaaatcctgattggggtcatcatcacctggattggaatgaacagccggtccacaagcctgtctgtgtcccttgtgctcgttggcatcgtcaccctgtatctgggggtgatggtgcaggccgacacaggatgtgtcgtgagctggaagaataaagaactcaagtgcggctctgggattttcatcacggataacgttcacacctggacagagcagtacaagtttcaacctgaatcccccagcaaactggcctccgctattcagaaggcccatgaggaaggcatctgtggaatcagatctgtgacccgccttgagaatctgatgtggaaacagattacaccggagctcaaccacatcctgagcgaaaatgaggtcaagctgaccattatgacgggcgacatcaaagggattatgcaggctggaaagcggtcccttagacctcaacccaccgaactcaaatattcttggaagacatggggcaaggccaaaatgctgagcaccgagtcccataaccagacattcctgatcgatgggcctgaaaccgcggagtgccccaatacaaaccgcgcctggaatagcctcgaggtggaagactacggatttggcgttttctctaccaacatctggctgaaacttcgggagaaacaggacgtgttttgtgattccaagctgatgagcgctgccattaaagacaatagagctgtccacgccgatatgggctattggatcgaatctgcgctcaacgacacgtggaagatggagaaggcctccttcattgagatcaaaagctgccactggcctaagtctcatacactgtggagcaatggggtgctggaatccgagatgattatccccaaaaacttcgctggaccggttagccagcacaactaccgccctggctatcatacccaaaccgccgggccctggcaccttggaaagctcgaaatggattttgacttctgtgagggcacaaccgtggtcgtgacggaagattgcgggaatcggggaccctctctgagaacaaccacagcttccggcaaactgattaccgagtggtgctgtcggagctgcacactccctccgctgcgctacagaggcgaggacgggtgttggtacggaatggaaatccggccccttaaggagaaggaagagaacctggtgaatagcctcgtcaccgccggccatgggcagatcgataacttttctctgggagttctgggcatggcccttttcctcgaagagatgctgagaacgcgcattgggaccaaacacgctatcctgctcgtggcggtgagctttgtcacactgattaccggaaatatgtccttccgggaccttggcagagtgatggttatggtgggcgccacaatgaccgatgacatcgggatgggagtcacgtatctggctctcctggccgcctttaaggtgcgccctacattcgctgccggcctgcttctgagaaaactcacctctaaggagctgatgatggcgacaattgggatcgctctcctgagccagtccaccatccccgaaaccattcttgagctgacagatgccctcgccctgggaatgatggttctgaaaatcgtgcggaacatggaaaagtaccaacttgctgtcacgattatggccatctcttgcgtgcctaatgcggttattctgcagaacgcttggaaggtgagctgtaccatcctcgccgccgtctccgtgagccccctgctcctgacatcttcccagcagaaagctgactggatccctcttgccctgaccattaagggcctcaatcccacagctatctttctgaccacgctgagccgcacatctaaaaagagatcctggccgcttaacgaggccattatggcggtggggatggtcagcatcctggcctcttccctcctgaaaaatgacattcctatgaccggacccctcgttgctggcggcctgcttaccgtgtgctatgtgctgacagggcggagcgccgatctggaactcgagcgcgctgccgacgtcaagtgggaggatcaagccgaaatctccggaagctctcctattctgagcatcaccatctccgaggacggctctatgagcattaaaaacgaagaggaggaacacacacttacgatcctgattagaaccgggctcctggtgatctccggagttttccccgtgtctattccgatcacagctgcggcctggtacctctgggaggtcaagaagcagcgggctggcgtgctgtgggatgttccttctccccctcccgtggggaaagccgaacttgaggacggagcctatcgcatcaagcagagaggcatttttggctactcccagatcggggctggagtctataaagaaggcaccttccatacaatgtggcacgtgaccagaggggccgtcctgatgcatcgcggaaagagaattgagccctcctgggcggatgtgaaaaaggacctgatcagctacggcgggggatggaagctcgagggcgaatggaaagagggcgaagaggttcaagtgctggctcttgaacctgggaagaatccgcgggccgtccagacgaaacccggactgtttaagaccaacacaggcaccattggggccgtgtccctcgatttcagccctggaacatctggctcccccatcgttgacagaaaagggaaggtggtcggactgtacggcaatggcgtggtgacccgcagcggggcttatgtttctgccatcgcgcagacagagaagtccattgaggataaccctgaaatcgaggacgatattttccggaaaaagagactcacgatcatggacctgcaccccggagctggcaaaaccaagcgctaccttcctgccattgtccgggaagccatcaaaagagggctgcgcacactgattctcgctccgacccgggtggtggccgctgagatggaagaggccctgagaggacttcccatccgctatcagacccctgcgatccgggccgagcatacaggcagagaaattgtcgacctgatgtgtcacgctacgtttaccatgcggctcctgagccccgtgcgcgttcctaactacaatctcatcattatggatgaggcccacttcacagaccccgcttccatcgccgccagagggtatatttctacccgggtggaaatgggcgaggctgcgggaatctttatgacagccaccccgcctggcagccgcgatcccttcccccaatccaacgctcctatcatggacgaggaaagagagattcccgaacggagctggaactctgggcatgagtgggtcacggattttaagggaaagacagtgtggttcgttccttccatcaaagccggcaacgacattgccgcttgcctgagaaagaatgggaaaaaggtgatccagcttagccgcaaaacctttgattctgaatacgtcaagacccgggccaacgactgggatttcgtggttacaaccgacattagcgagatgggagcgaattttagagctgagcgcgtgatcgatccgcggagatgtatgaagcccgtcatcctgacagacggcgaggaacgcgtgattctggccgggcctatgcccgtgacccactcctctgccgctcagcggagaggccgcatcggaagaaaccctaaaaatgaaaacgaccaatatatttacatgggcgagcccctcgaaaatgatgaggactgcgcccattggaaggaggcgaaaatgctgcttgataacatcaatacgccggaagggattatccctagcatgttcgagcccgaacgggagaaggtcgacgccattgatggagaataccgcctgagaggcgaggctcggaaaacatttgttgacctcatgcgcagaggggatctgcctgtgtggctggcctatcgggtggctgccgagggaatcaactacgctgacagacgctggtgtttcgatggcatcaagaataaccagattctcgaagagaacgtcgaagtggagatctggaccaaagagggggaacggaagaaacttaaacccagatggctggacgcccgcatttattccgatcctctggcgctcaaggagttcaaagaatttgccgctggccggaagtctctgacacttaatctgatcaccgagatgggaagactccccacgttcatgacccagaaagcccgggacgctctggataacctggccgttctccacacagccgaagctggcgggcgcgcgtacaatcacgcccttagcgagctgccggagaccctggaaacactcctgcttctgaccctcctggctacagtgaccggaggcatttttctgttcctcatgtccgggaagggaatcggcaagatgacgcttggcatgtgctgcatcattacagccagcatcctgctgtggtatgcccagattcaacctcattggatcgctgcctctattatcctcgagtttttcctgatcgtccttctgattcccgaacccgagaaacagagaacccctcaggacaaccagctcacctacgtggttatcgcgattctgacagtggtcgccgctaccatggccaatgaaatggggtttctggagaagaccaagaaggacctcggacttggctccatcacgacccaagagagcgaatccaacattctggatatcgacctgcggccggcttctgcctggacactctatgcggtggccaccacattcgtcacccccatgctgcgccacagcattgaaaattcctctgtgaacgttagccttacggctatcgccaatcaggctaccgtgctgatggggctcggaaaaggctggcctctgtccaagatggatatcggggtgcccctgctcgccattggatgttacagccaggtcaaccctatcacacttaccgctgccctgctgctcctggttgcgcattacgccattatcggccccggccttcaggctaaggccacaagagaagctcaaaaacgggccgccgcggggattatgaagaatcctaccgtggacggaatcacggtgatcgatctggagccgattccctatgaccctaaatttgaaaagcagctcggccaggtcatgctgctgatcctctgcgtgacacaggttcttatgatgcgcaccacatgggctctgtgtgaggccctgaccctcgctaccgggcccatttctacactgtgggagggaaaccctggcagattctggaatacgaccatcgccgtgtccatggccaacatttttcgggggagctaccttgctggagccggcctcctgttctctatcatgaaaaatacaaccaacacacgcagaggcaccgggaatatcggagaaacgctgggcgagaagtggaagtcccggctgaacgcgctcgggaaaagcgaatttcaaatttataagaaatctggaatccaggaggtcgatagaacacttgccaaggagggcattaaacgcggggaaaccgaccaccatgctgtgagccggggatccgccaagctgagatggttcgtcgagcgcaacatggtgacccccgaaggcaaagttgtggatctgggctgcgggcggggaggctggtcttactattgtgggggactcaagaatgtcagagaggtgaagggcctgacaaaagggggaccgggccacgaggaacctatccccatgagcacctacggctggaaccttgttcgcctgcagtccggggtggacgtcttctttacaccccctgagaagtgcgatacgctcctgtgtgacattggagaaagctcccccaatcctaccatcgaggctggccggacactgagagtgctcaaccttgtggaaaattggctgaacaataacacccaattctgcatcaaagttctgaatccgtatatgccctctgtcattgagaagatggaagccctccagcgcaaatacgggggagcgctggtgcggaaccctcttagcagaaattccacacacgagatgtactgggtgtctaacgccaccggcaatatcgtcagctccgttaacatgatttctcgcatgctgatcaatcggtttacgatgaagcataagaaagctacctatgagcccgatgtggacctcgggagcggaacaagaaacattggcatcgaatccgagattcctaacctggacatcatcggcaagcgcattgagaagatcaagcaggagcacgaaaccagctggcattacgatcaggaccacccctataaaacatgggcctaccacgggtcttatgagaccaagcaaacaggatccgctagctctatggtgaatggcgtcgtgagactgctcaccaagccgtgggatgttgtgcctatggtcacgcagatggccatgacagacaccacccccttcgggcagcagcgggtgtttaaagagaaggttgatacacgcacgcaagaacctaaagagggaaccaagaaacttatgaagattacagctgaatggctgtggaaggagctgggcaaaaagaaaacccccagaatgtgtacacgggaggagttcaccagaaaggtgcggtccaacgccgcgctcggggccatctttacagacgagaataaatggaaaagcgctcgcgaagccgtcgaggatggaagattctgggaactggtggaccgggagcgcaaccttcatctggagggcaaatgcgaaacctgtgtgtacaatatgatgggcaagagagagaagaaactcggggaatttggaaaggctaaaggctctcgggccatttggtatatgtggctgggggcccgcttcctggagtttgaagcgctcggattcctgaacgaggatcactggttttccagaggcaatagcctttccggggtcgagggcgaaggactgcatcggctcggctacatcctgcgcgacgttagcaagaaagaagggggagctatgtacgccgatgacacggccggctgggacaccagaatcacacttgaagatctgaagaacgaggaaatggtgaccaatcacatgaagggggagcataaaaagctcgctgaggccattttcaaactgacatatcagaacaaggtggtccgggtgcagcgccctacccccagaggaacggttatggacatcatttctcggaaagatcagcgcggcagcgggcaagtgggcacatacggactgaataccttcacaaacatggaagctcagctcatcagacagatggagggcgaagggatttttaagtccatccaacggctgaccgtcacggaggagatcgccgtgcagaattggcttgcgagagttggacgcgaacggctgtctagaatggccattagcggcgacgattgcgtggtcaagccgctcgacgatcgcttcgcttccgccctgaccgctcttaacgacatggggaaagtgcggaaggatatccagcagtgggagccttctagaggatggaatgactggacacaagttcccttttgcagccaccacttccatgaactggtgatgaaagatggccgcatgctcgtcgtgccctgtcggaaccaggacgagctgattgggagagcccgcatctcccagggcgcgggatggtctctgaaggaaaccgcctgcctcggcaaaagctatgctcagatgtggacactgatgtactttcaccggagagatcttcgcctggccgctaacgccatttgttccgctgtccctagccattgggtgccgacctctcggacaacctggtccatccacgccaagcacgagtggatgacgacagaggacatgctcgcggtttggaatagagtgtggattcaagaaaacccctggatggaggacaagacccctgtcgaaagctgggaggaagtgccctatctggggaaacgggaggatcagtggtgcggatctcttatcggcctgacctccagagccacatgggctaagaatatccagaccgccattaaccaggtgcgcagcctcatcgggaatgaggaatacacagactatatgccttccatgaaacggttcagaaaggaggaagaggaagccggagttctgtggtga

SEQ ID NO: 19981 - RNA, 9876 nt, synthetic construct
  misc_feature 1..9876: note = derived and/or modified CDS sequence (opt5) from DENV-2__EU482722__SS-prME
  source 1..9876: mol_type = other RNA
acagccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgagatcaaatcttgccactggcctaagagccataccctgtggtccaatggggttcttgaaagcgagatgattatccccaaaaacttcgctggaccggtgtctcagcacaactaccgccctggctatcatacgcagacagccgggccctggcacctcggaaagctggaaatggattttgacttctgtgagggcaccaccgtcgtggtgacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgtcaattctctggttaccgccggccatgggcaaatcgataactttagcctgggagtgcttggcatggccctcttcctggaagagatgctgagaacacgcgtggggaccaaacacgctattctcctggtcgcggtgtcctttgttacgcttatcaccggaaatatgtctttccgggacctgggcagagtgatggtcatggtgggcgccacaatgaccgatgacattgggatgggagttacatatctcgctctgctggccgcctttaaggtgcgccctaccttcgctgccggccttctgctcagaaaactgacgagcaaggagctcatgatggcgacaatcgggattgctctgctttcccagtctaccatccccgaaacaatcctggagctcaccgatgccctggccctgggaatgatggtccttaaaattgtgcggaacatggaaaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaagggcctgaatcccacagctatttttctgaccacactttctcgcacctccaaaaagagaagctggccgctgaacgaggccgttatggcggtggggatggtgtctatcctcgcctccagcctgctcaaaaatgacattcctatgacgggacccctggtcgctggcggccttctgacagtgtgctatgttctgaccgggcggtccgccgatctcgaactggagcgcgtggctgacgtcaagtgggaggatcaggccgaaatcagcggatctagccctattctttccatcaccatttctgaggacggcagcatgtccatcaaaaacgaagaggaggaacacacactgaccatcctcattagaacagggctgctcgtgatctctggagttttccccgtgagcattccgatcacggccgctgcgtggtacctgtgggaggtcaagaagcaacgggccggcgtgctttgggatgtcccttctccccctcccgtggggaaagctgaactggaggacggagcctatcgcattaagcagagaggcatctttggctacagccagatcggggccggagtttataaagaaggcaccttccatacaatgtggcacgtgaccagaggggctgtcctgatgcatcgcggaaagagaattgagcccagctgggccgatgtgaaaaaggacctcatctcctacggcgggggatggaagctggagggcgaatggaaagagggcgaagaggttcaggtgcttgcgctggaacctgggaagaatccgcgggctgtccaaacaaaacccggactctttaagaccaacacgggcaccattggggccgtgagcctggatttctctcctggaacatccggcagccccatcgtggacagaaaagggaaggttgtcggactctacggcaatggcgtggtgacccgctctggggcctatgtctccgctattgcccagacagaaaagagcatcgaggataaccctgaaatcgaggacgatattttccggaaaaagagactgaccatcatggaccttcaccccggagcgggcaaaacaaagcgctacctgcctgctattgtgcgggaagccatcaaaagagggctgcgcacgctcattctggccccgacccgggttgtggctgccgagatggaagaggctcttagaggactgcccatccgctatcagacccctgccattcgggcggagcataccggcagagaaatcgtcgacctcatgtgtcacgccacctttacaatgcggctgctctcccccgtgcgcgttcctaactacaatctgatcattatggatgaggctcacttcacggaccccgcctctatcgctgccagagggtatattagcacccgggtggaaatgggcgaggccgctggaatctttatgacagcgaccccgcctggctcccgcgatcccttcccccagagcaacgcccctattatggacgaggaaagagagatccccgaacggtcttggaactccgggcatgagtgggtcacagattttaagggaaagaccgtgtggttcgttcctagcatcaaagctggcaacgacattgccgcctgccttagaaagaatgggaaaaaggtgatccaactgtctcgcaaaacgtttgatagcgaatacgtcaagacacgggctaacgactgggatttcgtggtgaccaccgacatttccgagatgggagccaattttagagcggagcgcgtcatcgatccgcggagatgtatgaagcccgttattctgacagacggcgaggaacgcgtgatcctcgctgggcctatgcccgtgacccactctagcgccgcccagcggagaggccgcatcggaagaaaccctaaaaatgaaaacgaccagtatatttacatgggcgagcccctggaaaatgatgaggactgcgctcattggaaggaggccaaaatgcttctggataacatcaatacaccggaagggattatcccttccatgttcgagcccgaacgggagaaggtcgacgcgattgatggagaataccgcctcagaggcgaggcccggaaaacctttgtggacctgatgcgcagaggggatctgcctgtttggctcgcttatcgggtggccgctgagggaatcaactacgccgacagacgctggtgtttcgatggcattaagaataaccaaatccttgaagagaacgtcgaagtggagatctggacgaaagagggggaacggaagaagctgaaacccagatggctggacgctcgcatttattctgatcctctcgccctgaaggagttcaaagaatttgcggccggccggaagacacttaccctgaatctcatcacagagatgggaagactgcccaccttcatgacgcagaaagctcgggacgccctggataacctcgctgttcttcacaccgccgaagtgggcgggcgcgcctacaatcacgctctgagcgagctgccggagacactcgaaaccctgcttctgctcacactgctggcgaccgtcacaggaggcatttttctcttccttatgtccgggaagggaatcggcaagatgaccctgggcatgtgctgcattatcacggccagcatcctgctctggtatgctcagattcagcctcattggatcgccgcctctattatcctggagtttttccttattgtgctgctcatccccgaacccgagaaacaaagaacacctcaggacaaccagctgacctacgtcgtgatcgctattctgaccgttgtggccgcgacaatggccaatgaaatggggtttctcgagaagaccaaaaaggaccttggactgggctccatcacaacgcaggagagcgaatccaacattctggatatcgacctccggccggcttctgcctggaccctgtatgctgtggccacaaccttcgtcacacccatgcttcgccacagcattgaaaattcctctgttaacgtgagcctgaccgcgatcgccaatcaagctacggtgctcatggggctgggaagaggctggcctctgtccaaaatggatattggggtccccctccttgccatcggatgttacagccaggtgaaccctatcaccctgacagctgccctgctcctgcttgttgctcattacgccattatcggccccggcctgcaggcgaaggccacccgggaagctcagaagcgcacagccgctgggattatgaaaaatcctaccgtggacggaatcacggtcattgatctcgagccgatcccctatgaccctaagtttgaaaaacaactgggccaggtgatgctgctcgtcctttgcgtgacacaggttctgatgatgagaaccacatgggccctgtgtgaggccctcaccctggcgaccgggcccatctctacactttgggagggaaaccctggccggttctggaatacgaccattgctgtgtccatggccaacatctttcgcgggagctacctggctggagccggcctcctgttctctattatgaagaatacaaccaacacaagacggggcaccgggaatatcggagaaacgctgggcgagaaatggaagtccagactcaacgcccttgggaagtccgaatttcagatttataaaaagtctggaatccaagaggtcgatcgcacactggctaaagagggcatcaagagaggggaaaccgaccaccatgccgtgagcagaggatccgcgaaactgcgctggttcgttgagcggaacatggtgacccccgaaggcaaggtcgtggatctcggctgcgggagaggaggctggtcttactattgtgggggactgaaaaatgtgcgcgaggttaagggccttacaaaagggggaccgggccacgaggagcctattcccatgagcacctacggctggaacctggtccggctccagtccggggtggacgtgttctttacaccccctgagaaatgcgatacgctgctgtgtgacatcggagaaagctcccccaatcctaccattgaggccggcagaacactccgcgtccttaacctggttgaaaattggctgaacaataacacccagttctgcgtgaaggtgctcaatccgtatatgccctctgtcatcgagaaaatggaaacactgcaacggaagtacgggggagctcttgtgagaaaccctctgagccgcaattccacccacgagatgtactgggtttctaacgccacgggcaatattgtgagctccgtcaacatgatctctcggatgctcatcaatagatttaccatgaaacataagaaggctacatatgagcccgatgtggacctggggagcggaacccgcaacattggcatcgaaaacgagattcctaatctggacatcattggcaaaagaatcgaaaagattaaacaggagcacgaaacatcctggcattacgatcaggaccacccctataagacctgggcctaccacgggagctatgagacaaaacagaccggatctgcgtccagcatggttaacggcgtggtcaagctccttacgaagccgtgggatgtgatccctatggtgacacaaatggccatgaccgacaccacacccttcgggcagcagcgggtctttaaagagaaggttgatacgcgcacccaggaacctaaagagggaacaaagaaactgatgagaatcaccgctgaatggctgtggaaggagctcggcaagaaaaagacaccccggatgtgtaccagagaggagttcacacggaaagtgcgctctaatgccgctctgggggccatttttaccgacgagaacaagtggaaatccgctagagaagccgtggaggatagccggttctgggaacttgtcgaccgcgagagaaatctgcatctcgagggaaagtgcgaaacgtgtgtgtacaacatgatgggcaaacgggagaagaagctgggcgaatttgggaaagcgaagggatctcgcgccatctggtatatgtggctgggcgctagattcctcgagtttgaagccctggggttccttaatgaggatcactggttttcccggggaaacagcctgtccggcgttgagggggaaggcctccataaactgggatacattcttcgcgacgtgagcaagaaagagggcggggctatgtacgccgatgacaccgccggatgggacacaagaatcaccctggaagatctcaagaatgaggaaatggtcacaaaccacatgaagggcgagcataaaaagctggcggaggctattttcaaactgacctatcaaaataaggtggttcgggtgcagcgccctacgcccagagggacagtcatggacatcatctctcggaaagatcagcgcggaagcggccaggtggggacctacggcctcaacacattcaccaatatggaagcccaactgattagacagatggagggagaaggcatctttaagtccattcagcggcttacggttaccgaggagatcgccgtgcaaaactggctggctagagtcgggcgcgaacggctctctagaatggccattagcggagacgattgcgtggtcaagccgctggacgatcgcttcgcttccgcccttacagcgctgaatgacatgggcaaagtgcggaaggatatccagcagtgggagccttctagagggtggaacgactggacccaggttcccttttgcagccaccacttccatgaactcgtgatgaaagatggacgcgtcctggtggtgccctgtcggaaccaagacgagctgatcggcagagcccgcatttcccagggggctggctggtctctcaaggaaacagcctgcctgggaaaaagctatgctcagatgtggacccttatgtactttcaccggagagatctgcgcctcgccgcgaatgccatctgttccgctgttcctagccattgggtgccgacatctcggaccacgtggtccattcacgccaagcacgagtggatgacaaccgaggacatgctggctgtctggaacagagtgtggatccaggaaaatccctggatggaggacaagacccctgttgaaagctgggaggaagtgccctatcttggcaaacgggaggatcaatggtgcgggtctctgattggactcacatccagagccacctgggctaagaacatccagacagccattaatcaggtccgcagcctgatcggcaacgaggaatacacggactatatgccttccatgaaacggttcagaaaggaggaagaggaagcgggggtgctgtggtga

SEQ ID NO: 19982 - RNA, 9876 nt, synthetic construct
  misc_feature 1..9876: note = derived and/or modified CDS sequence (opt5) from DENV-2__EU482723__SS-prME
  source 1..9876: mol_type = other RNA
accgccggcgtgatcattatgctgatccccaccgctatggccttccacctcacgacccggaatggggagcctcatatgattgtcggacggcaggaaaagggcaaaagcctgctttttaagacggaggacggggttaatatgtgcaccctgatggcgatcgatctcggagaactgtgtgaggacacaattacctacaaatgcccgcttctgagacaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagcgggcctggaaacacgttcagcgcatcgagacctggattctgagacatcccggcttcacaatcatggccgctattctcgcctacaccatcgggaccacacactttcagcgggctctgattttcatccttctgacggccgtggcgcctagcatgaccatgcgctgcattggaatctccaacagagattttgtcgaaggcgtgtctgggggaagctgggttgacatcgtgctcgagcacggctcctgtgtcacaaccatggccaagaataagcccacactggatttcgaacttattaaaaccgaggctaagcagcctgccacgctgcggaaatattgcatcgaagctaagctcacaaacaccaccacagagagccgctgtccgacccaaggggagccctctctgaatgaggaacaggacaaaagatttatttgcaagcattccatggtggatcggggatggggcaacggctgtgggctgttcggaaagggcgggatcgtgacatgcgccatgtttacgtgcaaaaagaatatggaaggaaaagtcgttctccctgagaacctggaatacaccattgtgatcacaccccacagcggcgaggagcatgcggtggggaatgacaccggaaagcacggcaaagaaatcaagattacacctcagtcttccatcaccgaggccgaacttacgggctatgggaccgtcacaatggagtgtagcccccgcaccggactggatttcaacgaaatggtgctcctgcagatggaggacaaggcttggcttgttcacagacaatggtttctggatctcccgctgccttggctgcccggcgccgacacacaggggtctaattggattcagaaggagaccctcgtgacgttcaagaaccctcatgctaaaaagcaggacgtcgtggttctgggatcccaagaaggcgccatgcacacagcccttaccggggctacagagatccagatgagctccggcaatctgctctttaccggacatctgaaatgccggcttagaatggataagctgcagctcaaaggcatgtcttacagcatgtgtaccgggaagttcaagattgtgaaagaaatcgcggagacacaacacggaacgatcgtcattcgcgtgcagtatgagggcgacgggtccccctgcaagatccccttcgaaattatggatctggagaaacggcatgtcctgggaagactcatcaccgtgaaccctattgttacagaaaaggacagcccggtgaacatcgaggccgaacccccttttggcgattcttacattatcatcggggtcgagcccggccagctgaaacttaattggttcaagaagggatccagcattggccagatgtttgagaccacaatgcgcggggctaaacggatggccatcctgggagacaccgcctgggatttcggctctctcgggggagtgtttacgagcattggcaaggctctgcaccaagttttcggggccatctacggcgcggctttttccggagtgtcttggacaatgaaaattctgatcggcgtcatcattacctggatcgggatgaacagcagatccaccagcctttctgtgtccctcgtgctggttggagtcgtgacactgtatctcggcgtgatggtccaggccgacagcgggtgtgtggtttcttggaagaataaagaactgaagtgcggatccggcattttcatcaccgataacgtgcacacatggacggagcagtacaagtttcagcctgaaagcccctccaaacttgcctctgctattcaaaaggcccatgaggaagggatctgtggcatccgcagcgtcacccggctggagaatctcatgtggaaacagattacaccggagctgaaccacatcctgtccgaaaatgaggtgaaacttaccattatgacaggagacatcaaaggcattatgcaggctgggaagagatctctccgccctcagcccaccgaactgaaatatagctggaagacgtggggaaaggccaaaatgctgtccaccgagagccataaccaaacattcctcatcgatggccctgaaaccgcggagtgccccaatacaaaccgggcctggaactctctggaggttgaagactacgggtttggagtgttctccaccaacatctggcttaagctgagagagaaacaggacgtcttttgtgatagcaagctcatgtctgctgccattaaagacaatcgcgctgtgcacgccgatatgggctattggatcgaatccgcgctgaacgacacatggaagatggagaaggccagcttcattgagatcaaatcttgccactggcctaagagccataccctgtggtccaatggcgttcttgaaagcgagatgattatccccaaaaacttcgctgggccggtgtctcagcacaactaccggcctggatatcatacgcagacagccggcccctggcacctcgggaagctggaaatggattttgacttctgtgagggaaccaccgtcgtggtgacagaagattgcggcaatagagggccctccctgcggaccacgacagctagcggaaaactcattaccgagtggtgctgtcgctcctgcacactgcctccgcttagataccggggcgaggacggctgttggtacgggatggaaatcagacccctgaaggagaaggaagagaacctcgtcaattctctggttaccgccggacatggccaaatcgataactttagcctgggggtgcttggaatggccctcttcctggaagagatgctgcgcacacgggtgggcaccaaacacgctattctcctggtcgcggtgtcctttgttacgcttatcaccgggaatatgtctttcagagacctgggacgcgtgatggtcatggtgggcgccacaatgaccgatgacattggcatgggggttacatatctcgctctgctggccgcctttaaggtgagacctaccttcgctgccggacttctgctccggaaactgacgagcaaggagctcatgatggcgacaatcggcattgctctgctttcccagtctaccatccccgaaacaatcctggagctcaccgatgccctggccctggggatgatggtccttaaaattgtgcgcaacatggaaaagtaccagctggctgttaccatcatggccattagctgcgtgcctaatgcggtcatcctccaaaacgcttggaaggtgtcctgtacaattctggccgccgtgagcgtctctcccctcctgcttacgtccagccagcagaaagctgactggatccctctggccctcaccatcaagggactgaatcccacagctatttttctgaccacactttctagaacctccaaaaagcggagctggccgctgaacgaggccgttatggcggtgggcatggtgtctatcctcgcctccagcctgctcaaaaatgacattcctatgacggggcccctggtcgctggaggccttctgacagtgtgctatgttctgaccggccgctccgccgatctcgaactggagagagctgccgacgtgaagtgggaggatcaggccgaaatcagcgggtctagccctattctttccatcaccatttctgaggacggaagcatgtccatcaaaaacgaagaggaggaacacacactgaccatcctcattcggacaggcctgctcgtcatctctggggtgttccccgttagcattccgatcacggctgcggcctggtacctgtgggaggtgaagaagcaacgcgctggagtcctttgggatgtgccttctccccctcccgtcggcaaagccgaactggaggacggggcctatagaattaagcagcggggaatctttggctacagccagatcggcgctggggtgtataaagaaggaaccttccatacaatgtggcacgttacccgcggcgccgtgctgatgcatagagggaagcggattgagcccagctgggcggatgtcaaaaaggacctcatctcctacggaggcgggtggaagctggagggagaatggaaagagggcgaagaggtgcaggttcttgctctggaacctggcaagaatccgagagccgtgcaaacaaaacccgggctctttaagaccaacacgggaaccattggcgccgtcagcctggatttctctcctgggacatccggaagccccatcgtggaccgcaaaggcaaggtggttgggctctacggaaatggcgtcgtgacccggtctggcgcttatgtgtccgccattgcgcagacagaaaagagcatcgaggataaccctgaaatcgaggacgatattttccgcaaaaagcgcctgaccatcatggaccttcaccccggggctggaaaaacaaagcggtacctgcctgccattgtcagagaagccatcaaacgcggcctgcggacgctcattctggctccgaccagagtggttgccgctgagatggaagaggcccttcgcgggctgcccatccggtatcagacccctgcgattagagccgagcataccggacgggaaatcgtggacctcatgtgtcacgctacctttacaatgcgcctgctctcccccgtcagagtgcctaactacaatctgatcattatggatgaggcccacttcacggaccccgcttctatcgccgcccggggctatattagcacccgcgttgaaatgggggaggctgcgggcatctttatgacagccaccccgcctggatccagagatcccttcccccagagcaacgctcctattatggacgaggaacgggagatccccgaaagatcttggaactccggccatgagtgggtgacagattttaaggggaagaccgtctggttcgtgcctagcatcaaagccggaaacgacattgccgcttgccttcgcaagaatggcaaaaaggttatccaactgtctcggaaaacgtttgatagcgaatacgtgaagacaagagccaacgactgggatttcgtcgtgaccaccgacatttccgagatgggggcgaattttcgcgctgagcgggtgatcgatccgagacgctgtatgaagcccgtcattctgacagacggagaggaacgggttatcctcgccggccctatgcccgtgacccactctagcgccgctcagagacgcgggagaatcggccggaaccctaaaaatgaaaacgaccagtatatttacatgggagagcccctggaaaatgatgaggactgcgcccattggaaggaggcgaaaatgcttctggataacatcaatacaccggaaggcattatcccttccatgttcgagcccgaacgcgagaaggtggacgccattgatggggaatacagactccggggagaggctcgcaaaacctttgtcgacctgatgagacggggcgatctgcctgtgtggctcgcctatagagttgctgccgaggggatcaactacgctgaccgccggtggtgtttcgatggaattaagaataaccaaatccttgaagagaacgtggaagtcgagatctggacgaaagagggcgaaagaaagaagctgaaaccccgctggctggacgcccggatttattctgatcctctcgcgctgaaggagttcaaagaatttgccgctgggagaaagagccttacactgaatctcatcaccgagatgggccggctgcccacattcatgacccagaaagcccgcgacgctctggataacctcgccgtgcttcacacggccgaagttggaggcagagcttacaatcacgcgctgtccgagctgccggagaccctcgaaacactgcttctgctcaccctgctggccacagtgaccgggggaatttttctcttccttatgagcggcaaggggatcggaaagatgacactgggcatgtgctgcattatcaccgcttctatcctgctctggtatgcccagattcagcctcattggatcgccgcttccattatcctggagtttttccttattgtcctgctcatccccgaacccgagaaacaacggacgcctcaggacaaccagctgacatacgtggtcatcgccattctgaccgtggttgcggccaccatggctaatgaaatgggctttctcgagaagaccaaaaaggaccttgggctgggaagcatcaccacacaggagtccgaatctaacattctggatatcgacctccgcccggccagcgcttggacgctgtatgccgtggcgaccacattcgtgacccccatgcttagacactccattgaaaattctagcgtcaacgtttccctgacagccatcgctaatcaagccaccgtgctcatgggcctggggcggggatggcctctgagcaaaatggatattggcgtgcccctccttgctatcgggtgttactctcaggtcaaccctatcacgctgaccgccgctctgctcctgcttgtggcccattacgcgattatcggacccggcctgcaggccaaggctacacgcgaagcccagaagagaaccgctgccggcattatgaaaaatcctacagttgacgggatcaccgtgattgatctcgagccgatcccctatgaccctaagtttgaaaaacaactgggacaggtcatgctgctcgtgctttgcgtcacacaggtgctgatgatgcggacaacctgggccctgtgtgaggcgctcacactggctaccggccccatctccaccctttgggaggggaaccctggacgcttctggaatacaacgattgccgttagcatggctaacatctttagaggctcttacctggccggggccggactcctgttctccattatgaagaataccacaaacacccggagaggcacaggcaatatgggggaaaccctgggagagaaatggaagtcccgcctcaacgctcttggcaagtctgaatttcagatctataaaaagagcgggattcaagaggtggatcggacgctggccaaagagggaatcaagagaggcgaaacagaccaccatgcggtctcccgcgggtctgccaaactgcggtggttcgtggagagaaacatggttacccccgaaggaaaggtggtcgatctcggctgcggccgcgggggatggagctactattgtggcgggctgaaaaatgtgcgggaggtgaagggacttaccaagggcgggccgggacacgaggagcctatccccatgtccacatacggctggaacctggttagactccagagcggcgtcgacgtgttctttacaccccctgagaaatgcgatacactgctgtgtgacattggggaatcctctcccaatcctacgatcgaggctggacgcaccctccgggtgcttaacctggtcgaaaattggctgaacaataacacacagttctgcattaaggttctcaatccgtatatgcccagcgtgatcgagaaaatggaaaccctgcaaagaaagtacggcggggcccttgtgcgcaaccctctgtccagaaattctacacacgagatgtactgggtcagcaacgctaccggaaatattgtgtcctctgttaacatgatcagcagaatgctcatcaatcgctttacgatgaaacataagaaggccacctatgagcccgatgtggacctgggctccgggacaagaaacattggaatcgaaaacgagattcctaatctggacatcattggcaaacggatcgaaaagattaaacaggagcacgaaaccagctggcattacgatcaggaccacccctataagacatgggcgtaccacggctcttatgagaccaaacagacagggtccgccagctctatggtcaacggagtggttaagctccttaccaagccgtgggatgtggtccctatggtgacgcaaatggctatgacagacaccacccccttcggccagcagcgcgtgtttaaagagaaggtcgatacaagaacgcaggaacctaaagaggggaccaagaaactgatgcggatcacagccgaatggctgtggaaggagctcggaaagaaaaagacccccagaatgtgtacacgggaggagttcacccgcaaagttagatccaatgctgccctgggcgctatctttacagacgagaacaagtggaaaagcgcccgggaagcggtggaggattctcgcttctgggaacttgtggacagagagcggaatctgcatctcgaggggaagtgcgaaacctgtgtctacaacatgatgggaaaacgcgagaagaagctgggcgaatttggcaaagccaaggggtccagagctatttggtatatgtggctgggagcccggttcctcgagtttgaagctctgggcttccttaatgaggatcactggtttagccgcgggaactccctgagcggagtggagggcgaagggctccataaactgggctacatccttagagacgtttctaagaaagagggaggcgccatgtacgccgatgacacggcggggtgggacacccggattacactggaagatctcaagaatgaggaaatggtgaccaaccacatgaagggagagcataaaaagctggctgaggccatcttcaaactgacatatcaaaataaggtcgtgcgcgttcagagacctacaccccggggcacggtgatggacattatcagccgcaaagatcagagagggtccggacaggtcggcacatacgggctcaacaccttcacaaatatggaagcccaactgatccggcagatggagggcgaaggaatttttaagtctatccagagacttaccgtgacggaggagattgctgttcaaaactggctggcccgcgtgggccgggaaagactcagccgcatggctatctccggggacgattgcgtcgtgaagccgctggacgatcggttcgcctctgcgcttaccgccctgaatgacatgggaaaagtcagaaaggatattcagcagtgggagcctagccgcggctggaacgactggacacaggtgcccttttgctcccaccacttccatgaactcgttatgaaagatgggcgggtgctggtcgtgccctgtagaaaccaagacgagctgatcggacgcgctcggatctctcagggcgccgggtggagcctcaaggaaaccgcttgcctgggcaaatcctatgcccagatgtggacacttatgtactttcacagacgcgatctgcggctcgcggccaatgctatttgtagcgccgtgccttctcattgggttccgacctccagaacaacctggagcatccacgctaagcacgagtggatgacgacagaggacatgctggccgtgtggaaccgggtctggattcaggaaaatccctggatggaggacaagacccctgtggaatcttgggaggaagttccctatcttggaaaaagagaggatcaatggtgcggctccctgatcgggctcaccagccgcgctacatgggccaagaacattcagaccgcgatcaatcaggtgcggtccctgattggaaacgaggaatacacagactatatgccttctatgaaaagattccgcaaggaggaagaggaagccggcgtcctgtggtga

SEQ ID NO: 19983 - RNA, 9876 nt, synthetic construct
  misc_feature 1..9876: note = derived and/or modified CDS sequence (opt5) from DENV-2__EU482724__SS-prME
  source 1..9876: mol_type = other RNA
accgccggcgtgatcattatgctgatccccacagctatggccttccacctcacgacccggaacggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccagccgcgcctggaactctctggaggttgaagactacggatttggcgtgttctccacaaatatctggcttaagctgcgggagaaacaggacgtcttttgtgatagcaagctcatgtctgctgccattaaagacaacagagctgtgcacgccgatatgggctattggatcgaatccgcgctgaatgacacctggaagatggagaaggccagcttcattgagatcaaatcttgccactggcctaagagccatacgctgtggtccaacggggttcttgaaagcgagatgattatccccaaaaatttcgctggaccggtgtctcagcacaactaccgccctggctatcatacacagaccgccgggccctggcacctcggaaagctggaaatggattttgacttctgtgagggcaccacagtcgtggtgaccgaagattgcgggaaccggggaccctccctgagaacgacaaccgctagcggcaaactcattacagagtggtgctgtcggtcctgcaccctgcctccgcttcgctacagaggcgaggacgggtgttggtacggaatggaaatccggcccctgaaggagaaggaagagaatctcgtcaactctctggttacagccggccatgggcaaatcgataattttagcctgggagtgcttggcatggccctcttcctggaagagatgctgagaacccgcgtggggacgaaacacgctattctcctggtcgcggtgtcctttgttacccttatcacaggaaacatgtctttccgggacctgggcagagtgatggtcatggtgggcgccaccatgacagatgacattgggatgggagttacctatctcgctctgctggccgcctttaaggtgcgccctacgttcgctgccggccttctgctcagaaaactgacaagcaaggagctcatgatggcgaccatcgggattgctctgctttcccagtctacaatccccgaaaccatcctggagctcaccgatgccctggccctgggaatgatggtccttaaaattgtgcggaatatggaaaagtaccagctggctgttacaatcatggccattagctgcgtgcctaacgcggtcatcctccaaaatgcttggaaggtgtcctgtacgattctggccgccgtgagcgtctctcccctcctgcttacctccagccagcagaaagctgactggatccctctggccctcacaatcaagggcctgaaccccaccgctatttttctgacaaccctttctcgcacgtccaaaaagagaagctggccgctgaatgaggccgttatggcggtggggatggtgtctatcctcgcctccagcctgctcaaaaacgacattcctatgacaggacccctggtcgctggcggccttctgaccgtgtgctatgttctgaccgggcggtccgccgatctcgaactggagcgcgctgccgacgtgaagtgggaggatcaggccgaaatcagcggatctagccctattctttccatcacaatttctgaggacggcagcatgtccatcaaaaatgaagaggaggaacacaccctgacaatcctcattagaacggggctgctcgtcatctctggagtgttccccgttagcattccgatcaccgctgcggcctggtacctgtgggaggtgaagaagcaacgggctggcgtcctttgggatgtgccttctccccctcccgtcgggaaagccgaactggaggacggagcctatcgcattaagcagagaggcatctttggctacagccagatcggggctggagtgtataaagaaggcacattccataccatgtggcacgttacaagaggggccgtgctgatgcatcgcggaaagagaattgagcccagctgggcggatgtcaaaaaggacctcatctcctacggcgggggatggaagctggagggcgaatggaaagagggcgaagaggtgcaggttcttgctctggaacctgggaagaacccgcgggccgtgcaaaccaaacccggactctttaagacgaataccggcacaattggggccgtcagcctggatttctctcctggaacctccggcagccccatcgtggacagaaaagggaaggtggttggactctacggcaacggcgtcgtgacacgctctggggcttatgtgtccgccattgcgcagaccgaaaagagcatcgaggataatcctgaaatcgaggacgatattttccggaaaaagagactgacaatcatggaccttcaccccggagctggcaaaacgaagcgctacctgcctgccattgtccgggaagccatcaaaagagggctgcgcaccctcattctggctccgacacgggtggttgccgctgagatggaagaggcccttagaggactgcccatccgctatcagacccctgcgattcgggccgagcataccggcagagaaatcgtggacctcatgtgtcacgctacatttacgatgcggctgctctcccccgtccgcgtgcctaactacaacctgatcattatggatgaggcccacttcaccgaccccgcttctatcgccgccagagggtatattagcacacgggttgaaatgggcgaggctgcgggaatctttatgaccgccacaccgcctggctcccgcgatcccttcccccagagcaatgctcctattatggacgaggaaagagagatccccgaacggtcttggaactccgggcatgagtgggtgaccgattttaagggaaagacggtctggttcgtgcctagcatcaaagccggcaatgacattgccgcttgccttagaaagaacgggaaaaaggttatccaactgtctcgcaaaacatttgatagcgaatacgtgaagacccgggccaatgactgggatttcgtcgtgaccacagacatttccgagatgggagcgaactttagagctgagcgcgtgatcgatccgcggagatgtatgaagcccgtcattctgaccgacggcgaggaacgcgttatcctcgccgggcctatgcccgtgacacactctagcgccgctcagcggagaggccgcatcggaagaaatcctaaaaacgaaaatgaccagtatatttacatgggcgagcccctggaaaacgatgaggactgcgcccattggaaggaggcgaaaatgcttctggataatatcaacaccccggaagggattatcccttccatgttcgagcccgaacgggagaaggtggacgccattgatggagaataccgcctcagaggcgaggctcggaaaacgtttgtcgacctgatgcgcagaggggatctgcctgtgtggctcgcctatcgggttgctgccgagggaatcaattacgctgacagacgctggtgtttcgatggcattaagaacaatcaaatccttgaagagaacgtggaagtcgagatctggacaaaagagggggaacggaagaagctgaaacccagatggctggacgcccgcatttattctgatcctctcgcgctgaaggagttcaaagaatttgccgctggccggaagtcccttaccctgaacctcatcacagagatgggaagactgcccaccttcatgacgcagaaagcccgggacgctctggataatctcgccgtgcttcacaccgccgaagttggcgggcgcgcttacaaccacgcgctgtccgagctgccggagacactcgaaaccctgcttctgctcacactgctggccaccgtgacaggaggcatttttctcttccttatgagcgggaagggaatcggcaagatgaccctgggcatgtgctgcattatcacggcttctatcctgctctggtatgcccagattcagcctcattggatcgccgcttccattatcctggagtttttccttattgtcctgctcatccccgaacccgagaaacaaagaacacctcaggacaatcagctgacctacgtggtcatcgccattctgaccgtggttgcggccacaatggctaacgaaatggggtttctcgagaagaccaaaaaggaccttggactgggcagcatcacaacgcaggagtccgaatctaatattctggatatcgacctccggccggccagcgcttggaccctgtatgccgtggcgacaaccttcgtgacacccatgcttcgccactccattgagaactctagcgtcaatgtttccctgaccgccatcgctaaccaagccacggtgctcatggggctgggaagaggctggcctctgagcaaaatggatattggggtgcccctccttgctatcggatgttactctcaggtcaatcctatcaccctgacagccgctctgctcctgcttgtggcccattacgcgattatcggccccggcctgcaggccaaggctacccgggaagcccagaagcgcacagctgccgggattatgaaaaaccctaccgttgacggaatcacggtgattgatctcgagccgatcccctatgaccctaagtttgaaaaacaactgggccaggtcatgctgctcgtgctttgcgtcacacaggtgctgatgatgagaaccacatgggccctgtgtgaggcgctcaccctggctaccgggcccatctccacactttgggagggaaatcctggccggttctggaacacgaccattgccgttagcatggctaatatctttcgcgggtcttacctggccggagccggcctcctgttctccattatgaagaacacaaccaatacaagacggggcaccgggaacatcggagaaacgctgggcgagaaatggaaaagcagactcaatgctcttgggaagtctgaatttcagatttataaaaagagcggaatccaagaggtggatcgcacactggccaaagagggcatcaagagaggggaaaccgaccaccatgcggtctccagaggatctgccaaactgcgctggttcgtggagcggaacatggttacccccgaaggcaaggtggtcgatctcggctgcgggagaggaggctggagctactattgtgggggactgaaaaacgtgcgcgaggtgaagggccttacaaaagggggaccgggccacgaggagcctattcccatgtccacctacggctggaatctggttcggctccagagcggggtcgacgtgttctttacaccccctgagaaatgcgatacgctgctgtgtgacatcggagaatcctctcccaaccctaccattgaggctggcagaacactccgcgtgcttaatctggtcgaaaactggctgaataacaatacccagttctgcgttaaggtgctcaacccgtatatgcccagcgtgatcgagaaaatggaaacactgcaacggaagtacgggggagcccttgtcagaaatcctctgtcccgcaactctacccacgagatgtactgggtgagcaatgctacgggcaacattgtttcctctgtgaatatgatcagccggatgctcatcaacagatttaccatgaaacataagaaggccacatatgagcccgatgtcgacctggggtccggaacccgcaatattggcatcgaaaacgagattcctaacctggacatcattggcaaaagaatcgaaaagattaaacaggagcacgaaacaagctggcattacgatcaggaccacccctataagacctgggcgtaccacgggtcttatgagacaaaacagaccggatccgccagctctatggtgaatggcgttgtgaagctccttacgaagccgtgggatgtcgtgcctatggtgacacaaatggctatgaccgacaccacacccttcgggcagcagcgggtctttaaagagaaggttgatacgcgcacccaggaacctaaagagggaacaaagaaactgatgagaatcaccgccgaatggctgtggaaggagctcggcaagaaaaagacaccccggatgtgtaccagagaggagttcacacggaaagtgcgctccaacgctgccctgggggctatctttaccgacgagaataagtggaaaagcgccagagaagcggtggaggattctcggttctgggaacttgtcgaccgcgagagaaacctgcatctcgagggaaagtgcgaaacgtgtgtgtacaatatgatgggcaaacgggagaagaagctgggcgaatttgggaaagccaagggatcccgcgctatttggtatatgtggctgggcgccagattcctcgagtttgaagctctggggttccttaacgaggatcactggtttagccggggaaattccctgagcggcgttgagggggaaggcctccataaactgggatacatccttcgcgacgtgtctaagaaagagggcggggccatgtacgccgatgacaccgcgggatgggacacaagaattaccctggaagatctcaagaacgaggaaatggtcacaaatcacatgaagggcgagcataaaaagctggctgaggccatcttcaaactgacctatcaaaacaaggtggttcgggtgcagcgccctacgcccagagggacagtcatggacattatcagccggaaagatcagcgcggatccggccaggtggggacctacggcctcaatacattcaccaacatggaagcccaactgatcagacagatggagggagaaggcatttttaagtctatccagcggcttacggttaccgaggagattgctgtgcaaaattggctggccagagtcgggcgcgaacggctcagcagaatggctatctccggagacgattgcgtggtcaagccgctggacgatcgcttcgcctctgcgcttacagccctgaacgacatgggcaaagtgcggaaggatattcagcagtgggagcctagcagagggtggaatgactggacccaggttcccttttgctcccaccacttccatgaactcgtgatgaaagatggacgcgtcctggtggtgccctgtcggaaccaagacgagctgatcggcagagctcgcatctctcagggggccggctggagcctcaaggaaacagcttgcctgggaaaatcctatgcccagatgtggacccttatgtactttcaccggagagatctgcgcctcgcggccaacgctatttgtagcgccgttccttctcattgggtgccgacatcccggaccacgtggagcatccacgctaagcacgagtggatgacaaccgaggacatgctggccgtctggaatagagtgtggattcaggaaaacccctggatggaggacaagacccctgttgaatcttgggaggaagtgccctatcttggcaaacgggaggatcaatggtgcgggtccctgatcggactcacaagcagagctacctgggccaagaatattcagacagcgatcaaccaggtccgctccctgattggcaatgaggaatacacggactatatgccttctatgaaacggttcagaaaggaggaagaggaagccggggtgctgtggtga

SEQ ID NO: 19984 - RNA, 9876 nt, synthetic construct
  misc_feature 1..9876: note = derived and/or modified CDS sequence (opt5) from DENV-2__EU482725__SS-prME
  source 1..9876: mol_type = other RNA
acagccggcgtgatcattatgctgatccccacagctatggccttccacctcacgacccggaatggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacaccggatgtgtggttagctggaagaataaagaactgaagtgcggctctgggattttcatcacagataacgtgcacacgtggaccgagcagtacaagtttcagcctgaatcccccagcaaacttgcctccgctattcaaaaggcccatgaggaaggcatctgtggaatcagatctgtcacacgcctggagaatctcatgtggaaacagattaccccggagctgaaccacatcctgagcgaaaatgaggtgaaacttacaattatgaccggcgacatcaaagggattatgcaggctggaaagcggtccctcagacctcagcccacggaactgaaatattcttggaagacctggggcaaggccaaaatgctgagcacagagtcccataaccaaaccttcctcatcgatgggcctgaaacagcggagtgccccaataccaaccgcgcctggaatagcctggaggttgaagactacggatttggcgtgttctctacaaacatctggcttaagctgcgggagaaacaggacgtcttttgtgattccaagctcatgagcgctgccattaaagacaatagagctgtgcacgccgatatgggctattggatcgaatctgcgctgaacgacacctggaagatggagaaggcctccttcattgagatcaaaagctgccactggcctaagtctcatacgctgtggagcaatggggttcttgaatccgagatgattatccccaaaaacttcgctggaccggtgagccagcacaactaccgccctggctatcatacacagaccgccgggccctggcacctcggaaagctggaaatggattttgacttctgtgagggcaccacagtcgtggtgaccgaagattgcgggaatcggggaccctctctgagaacgacaaccgcttccggcaaactcattacagagtggtgctgtcggagctgcaccctgcctccgcttcgctacagaggcgaggacgggtgttggtacggaatggaaatccggcccctgaaggagaaggaagagaacctcgtcaattccctggttacagccggccatgggcaaatcgataacttttctctgggagtgcttggcatggccctcttcctggaagagatgctgagaacccgcgtggggacgaaacacgctattctcctggtcgcggtgagctttgttacccttatcacaggaaatatgtccttccgggacctgggcagagtgatggtcatggtgggcgccaccatgacagatgacattgggatgggagttacctatctcgctctgctggccgcctttaaggtgcgccctacgttcgctgccggccttctgctcagaaaactgacatctaaggagctcatgatggcgaccatcgggattgctctgcttagccagtccacaatccccgaaaccatcctggagctcaccgatgccctggccctgggaatgatggtccttaaaattgtgcggaacatggaaaagtaccagctggctgttacaatcatggccatttcttgcgtgcctaatgcggtcatcctccaaaacgcttggaaggtgagctgtacgattctggccgccgtgtccgtcagccccctcctgcttacctcttcccagcagaaagctgactggatccctctggccctcacaatcaagggcctgaatcccaccgctatttttctgacaacccttagccgcacgtctaaaaagagatcctggccgctgaacgaggccgttatggcggtggggatggtgagcatcctcgcctcttccctgctcaaaaatgacattcctatgacaggacccctggtcgctggcggccttctgaccgtgtgctatgttctgaccgggcggagcgccgatctcgaactggagcgcgctgccgacgtgaagtgggaggatcaggccgaaatctccggaagctctcctattcttagcatcacaatttccgaggacggctctatgagcatcaaaaacgaagaggaggaacacaccctgacaatcctcattagaacggggctgctcgtcatctccggagtgttccccgtttctattccgatcaccgctgcggcctggtacctgtgggaggtgcggaagcaacgcgctggcgtcctttgggatgtgccttctccccctcccgtcgggaaggccgaactggaggacggagcctatagaattaaacagcggggcatctttggctactcccagatcggggctggagtgtataaggaaggcacattccataccatgtggcacgttacacgcggggccgtgctgatgcatagaggaaaacggattgagccctcctgggcggatgtcaagaaagacctcatcagctacggcgggggatggaagctggagggcgaatggaaggagggcgaagaggtgcaggttcttgctctggaacctgggaaaaatccgagagccgtgcaaaccaagcccggactctttaaaacgaacaccggcacaattggggccgtctccctggatttcagccctggaacctctggctcccccatcgtggaccgcaaggggaaagtggttggactctacggcaatggcgtcgtgacacggagcggggcttatgtgtctgccattgcgcagaccgagaagtccatcgaggataaccctgaaatcgaggacgatattttcagaaagaaacgcctgacaatcatggaccttcaccccggagctggcaagacgaaacggtacctgcctgccattgtcagagaagccatcaagcgcgggctgcggaccctcattctggctccgacaagagtggttgccgctgagatggaagaggcccttcgcggactgcccatccggtatcagacccctgcgattagagccgagcataccggccgggaaatcgtggacctcatgtgtcacgctacatttacgatgcgcctgctcagccccgtcagagtgcctaactacaatctgatcattatggatgaggcccacttcaccgaccccgcttccatcgccgcccgggggtatatttctacacgcgttgaaatgggcgaggctgcgggaatctttatgaccgccacaccgcctggcagcagagatcccttcccccagtccaacgctcctattatggacgaggaacgggagatccccgaaagaagctggaactctgggcatgagtgggtgaccgattttaaaggaaagacggtctggttcgtgccttccatcaaggccggcaacgacattgccgcttgccttcgcaaaaatgggaagaaagttatccaactgagccggaagacatttgattctgaatacgtgaaaaccagagccaacgactgggatttcgtcgtgaccacagacattagcgagatgggagcgaattttcgcgctgagcgggtgatcgatccgagacgctgtatgaagcccgtcattctgaccgacggcgaagaacgggttatcctcgccgggcctatgcccgtgacacactcctctgccgctcagagacgcggcagaatcggacggaaccctaagaatgaaaacgaccagtatatttacatgggcgagcccctggaaaatgatgaggactgcgcccattggaaagaggcgaagatgcttctggataacatcaataccccggaagggattatccctagcatgttcgagcccgaacgcgagaaagtggacgccattgatggagaatacagactccggggcgaggctcgcaagacgtttgtcgacctgatgagaagaggggatctgcctgtgtggctcgcctatagagttgctgccgagggaatcaactacgctgaccgccggtggtgtttcgatggcattaaaaataaccaaatccttgaagagaacgtggaagtcgagatctggacaaaggagggggaacgcaagaagctgaagccccgctggctggacgcccggatttattccgatcctctcgcgctgaaagagttcaaggaatttgccgctggcagaaaatctcttaccctgaatctcatcacagagatgggacggctgcccaccttcatgacgcagaaggcccgcgacgctctggataacctcgccgtgcttcacaccgccgaagttggcgggagagcttacaatcacgcgctgagcgagctgccggagacactcgaaaccctgcttctgctcacactgctggccaccgtgacaggaggcatttttctcttccttatgtccgggaaaggaatcggcaagatgaccctgggcatgtgctgcattatcacggctagcatcctgctctggtatgcccagattcagcctcattggatcgccgcttctattatcctggagtttttccttattgtcctgctcatccccgaacccgagaagcaacggacacctcaggacaaccagctgacctacgtggtcatcgccattctgaccgtggttgcggccacaatggctaatgaaatggggtttctcgagaaaaccaagaaagaccttggactgggctccatcacaacgcaggagagcgaatccaacattctggatatcgacctccgcccggcctctgcttggaccctgtatgccgtggcgacaaccttcgtgacacccatgcttagacacagcattgaaaatagctctgtcaacgttagcctgaccgccatcgctaatcaagccacggtgctcatggggctgggacggggctggcctctgtccaagatggatattggggtgcccctccttgctatcggatgttacagccaggtcaaccctatcaccctgacagccgctctgctcctgcttgtggcccattacgcgattatcggccccggcctgcaggccaaagctacccgcgaagcccagaagagaacagctgccgggattatgaagaatcctaccgttgacggaatcacggtgattgatctcgagccgatcccctatgaccctaaatttgaaaagcaactgggccaggtcatgctgctcgtgctttgcgtcacacaggtgctgatgatgcggaccacatgggccctgtgtgaggcgctcaccctggctaccgggcccatctctacactttgggagggaaaccctggccgcttctggaatacgaccattgccgtttccatggctaacatctttagagggagctacctggccggagccggcctcctgttctctattatgaaaaatacaaccaacacacggagaggcaccgggaatatcggagaaacgctgggcgagaagtggaaatcccagctcaacgctcttggaaagagcgaatttcaaatttataagaaatctggaatccaggaggtggatcgcacactggccaaggagggcatcaaaagaggggaaaccgaccaccatgcggtcagcagaggatccgccaagctgcgctggttcgtggagcggaacatggttacccccgaaggcaaagtggtcgatctcggctgcgggagaggaggctggtcttactattgtgggggactgaagaatgtgcgcgaggtgaaaggccttacaaaagggggaccgggccacgaggagcctattcccatgagcacctacggctggaacctggttcggctccagtccggggtcgacgtgttctttacaccccctgagaagtgcgatacgctgctgtgtgacatcggagaaagctcccccaatcctaccattgaggctggcagaacactccgcgtgcttaacctggtcgaaaattggctgaacaataacacccaattctgcgttaaagtgctcaatccgtatatgccctctgtgatcgagaagatggaaacactgcagcggaaatacgggggagcccttgtcagaaaccctctgagccgcaattccacccacgagatgtactgggtgtctaacgctacgggcaatattgttagctccgtgaacatgatctctcggatgctcatcaatagatttaccatgaagcataaaaaggccacatatgagcccgatgtcgacctggggagcggaacccgcaacattggcatcgaaaacgagattcctaatctggacatcattggcaagagaatcgagaagattaagcaggagcacgaaacatcctggcattacgatcaggaccacccctataaaacctgggcgtaccacgggagctatgagacaaagcaaaccggatctgcctccagcatggtgaacggcgttgtgaaactccttacgaagccgtgggatgtcgtgcctatggtgacacagatggctatgaccgacaccacacccttcgggcagcagcgggtctttaaggagaaagttgatacgcgcacccaagaacctaaggagggaaccaaaaagctgatgagaatcaccgccgaatggctgtggaaagagctcggcaagaagaaaacaccccggatgtgtaccagagaggagttcacacggaaggtgcgctctaatgctgccctgggggctatctttaccgacgagaacaaatggaagtccgccagagaagcggtggaggatagccggttctgggaacttgtcgaccgcgagagaaatctgcatctcgagggaaaatgcgaaacgtgtgtgtacaacatgatgggcaagcgggagaaaaagctgggcgaatttgggaaggccaaaggatctcgcgctatttggtatatgtggctgggcgccagattcctcgagtttgaagctctggggttccttaatgaggatcactggttttcccggggaaacagcctgtccggcgttgagggggaaggcctccataagctgggatacatccttcgcgacgtgagcaaaaaggagggcggggccatgtacgccgatgacaccgcgggatgggacacaagaattaccctggaagatctcaaaaatgaggaaatggtcacaaaccacatgaagggcgagcataagaaactggctgaggccatcttcaagctgacctatcagaataaagtggttcgggtgcagcgccctacgcccagagggacagtcatggacattatctctcggaaggatcagcgcggaagcggccaagtggggacctacggcctcaacacattcaccaatatggaagcccagctgatcagacagatggagggagaaggcatttttaaatccatccaacggcttacggttaccgaggagattgctgtgcagaactggctggccagagtcgggcgcgaacggctctctagaatggctatcagcggagacgattgcgtggtcaagccgctggacgatcgcttcgcctccgcgcttacagccctgaatgacatgggcaaggtgcggaaagatattcagcagtgggagccttctagagggtggaacgactggacccaagttcccttttgcagccaccacttccatgaactcgtgatgaaggatggacgcgtcctggtggtgccctgtcggaaccaggacgagctgatcggcagagctcgcatctcccagggggccggctggtctctcaaagaaacagcttgcctgggaaagagctatgcccagatgtggacccttatgtactttcaccggagagatctgcgcctcgcggccaatgctatttgttccgccgttcctagccattgggtgccgacatctcggaccacgtggtccatccacgctaaacacgagtggatgacaaccgaggacatgctggccgtctggaacagagtgtggattcaagaaaatccctggatggaggacaagacccctgttgaaagctgggaggaagtgccctatcttggcaagcgggaggatcagtggtgcgggtctctgatcggactcacatccagagctacctgggccaaaaacattcagacagcgatcaatcaggtccgcagcctgattggcaacgaggaatacacggactatatgccttccatgaagcggttcagaaaagaggaagaggaagccggggtgctgtggtga

SEQ ID NO: 19985 - RNA, 9876 nt, synthetic construct
  misc_feature 1..9876: note = derived and/or modified CDS sequence (opt5) from DENV-2__EU482726__SS-prME
  source 1..9876: mol_type = other RNA
accgccggcgtgatcgttatgctgattcccacagttatggctttccacctcacgacccggaacggggagcctcatatgatcgtgggacggcaggaaaagggcaagtccctgctttttaagacagaggacggggtgaatatgtgcaccctgatggccattgatctcggagaactgtgtgaggacacaatcacctacaagtgcccgcttctgcgccaaaacgaacccgaggatattgactgttggtgcaattccacatctacctgggtcacgtatggcacctgtacaaccacaggggagcaccggcgggaaaagcgcagcgtggcgctcgttcctcatgtgggaatgggcctggagaccagaacggaaacatggatgtcctctgagggcgcttggaagcacgtccagcggatcgagacctggatcctgcgccatcccgggttcacaattatggccgccatcctcgcttacaccattggaaccacacactttcagagagccctgatcttcattcttctgacggctgtggcccctagcatgaccatgcggtgcatcggcatttccaaccgcgattttgttgaaggggtgtctggaggcagctgggtcgacatcgtgctcgagcacgggtcctgtgtgacaaccatggcgaagaataagcccacactggatttcgaacttatcaagaccgaggccaagcagcctgctacgctgagaaagtattgcattgaagccaagctcacaaacaccaccacagagagccggtgtccgacccaaggagagccctctctgaatgaagaacaggacaaacgctttatctgcaagcattccatggtcgatagaggctggggcaacgggtgtggactgttcggcaaagggggcattgttacatgcgctatgtttacgtgcaaaaagaatatggaaggcaaaatcgtgcagcctgagaacctcgaatacaccattgtgatcacaccccacagcggggaggagcatgccgtcggaaatgacaccggcaagcacggcaaagaaatcaagattacacctcagtcttccaccacggaggcggaactgaccgggtatggaacagtgaccatggagtgtagcccccggacaggccttgatttcaacgaaatggttctgctccaaatggaggacaaagcctggctggtgcaccgccagtggtttcttgatctgccgctcccttggctgcccggggctgacacccagggatctaattggatccagaaggagacgctggtcacattcaagaaccctcatgccaaaaagcaagacgtggttgtgctcggctcccaggaaggggctatgcacaccgccctgacaggcgccaccgagattcagatgagctccggaaatcttctgtttaccggccatctcaaatgcagactgcggatggataaacttcaactgaaagggatgtcttacagcatgtgtatcggaaagttcaagattgtcaaagaaatcgctgagacacagcacggcacgatcgtgattagagtccagtatgagggggacggatccccctgcaagatccccttcgaaattaccgatctcgagaaacgccatgtgctgggccggctgatcacagttaaccctattgtgaccgaaaaggacgcgccggtcaacatcgaggccgaacccccttttggggatagctacattatcgtgggcgttgagcccggacagctcaaactgaattggttcaagaagggatcttccatcgggcaaatgtttgagacaaccatgagaggagctaaacgcatggccattcttggcgacacggcctgggatttcgggagcctgggaggcgtgtttacatctatcgggaaggctctccaccaggtcttcggcgccatttacggagcggcttttagcggcgtgtcctggaccatgaaaatcctgattggggtgatcatcacctggattggaatgaactctcggagcacatccctgagcgtttctcttgtcctcgtgggcgtggtcaccctgtatctgggggccgtggttcaggccgactccggatgtgtggtcagctggaagaataaagaactcaagtgcggctctgggatcttcattacagataacgtgcacacgtggaccgagcagtacaagtttcaacctgaatcccccagcaaactggcttccgccatccagaaggctcatgaggaaggcatttgtggaatcagatctgttacacgccttgagaatctgatgtggaaacagatcaccccggagctcaaccacattctgagcgaaaatgaggtgaagctgacaatcatgaccggcgacattaaagggatcatgcaggccggaaagcggtcccttagacctcaacccacggaactcaaatattcttggaagacctggggcaaggcgaaaatgctgagcacagagtcccataaccagaccttcctgattgatgggcctgaaacagccgagtgccccaataccaaccgcgcttggaatagcctcgaggtcgaagactacggatttggcgtgttcacaaccaacatctggctgaaacttcgggagaaacaggacgtcttttgtgattctaagctgatgtccgccgctatcaaagacaatagagccgtgcacgcggatatgggctattggattgaaagcgccctcaacgacacgtggaagatggagaaggcttctttcatcgaggtcaaatcctgccactggcctaagagccatacactgtggtctaatggggtgctggaaagcgagatgattatccccaaaaacttcgccggaccggtgtcccagcacaactaccgccctggctatcatacccaaaccgctgggccctggcaccttggaaagctcgaaatggattttgacttctgtgagggcacaaccgtcgttgtgacggaagattgcgggaatcggggacccagcctgagaacaaccacagcctctggcaaactgattaccgagtggtgctgtcggtcctgcacactccctccgctgcgctacagaggcgaggacgggtgttggtacggaatggaaatccggccccttaaggagaaggaagagaacctggtgaatagcctcgtcaccgccggccatgggcagattgataacttttccctgggagtgctgggcatggctcttttcctcgaagagatgctgagaacgcgcgttgggaccaaacacgcgacactgctcgtggccctgtcttttgtcacccttatcacaggaaatatgagcttccgggacctgggcagagtgatggttatggtgggcgctaccatgacggatgacatcgggatgggagtcacatatctcgccctgctggccgcttttaaggtgcgccctaccttcgccgcgggccttctgctcagaaaactgacatccaaggagctcatgatggctaccattgggatcgccctgctttctcagagcaccctgcccgaaacaattctcgagctgacggatgccctggctcttggaatgatggttctgaaaatcgtgcggaacatggaaaagtaccaactcgccgtcaccattatggcgatctcctgcgtgcctaatgctgtgatcctgcagaacgcctggaaggtctcttgtacaattctcgccgctgttagcgtgagccccctgcttctgaccagctctcagcagaaagccgactggatccctctcgctctgacaattaagggcctgaatcccaccgccatctttcttacgacactgtcccgcaccagcaaaaagagatcttggccgctcaacgaggcgattatggccgtggggatggtctccatcctggctagctctctcctgaaaaatgacatccctatgaccggaccccttgtggccggcggcctgctgacagtttgctatgtgctcaccgggcggtccgctgatctggaacttgagcgcgccgccgacgtcaagtgggaggatcaagctgaaattagcggatccagccctatcctgtctattacaatcagcgaggacggctccatgtctattaaaaacgaagaggaggaacagacgctcaccatcctgattagaacagggctcctggtgatcagcggagttttccccgtgtccatcccgattaccgcggccgcttggtacctttgggaggtcaagaagcagcgggccggcgtgctgtgggatgtcccttctccccctcccgtggggaaagccgaactggaggacggagcttatcgcatcaagcagagaggcattctcggctacagccaaatcggggccggagtttataaagaaggcacatttcacaccatgtggcatgtgacgagaggggcggtcctgatgcaccgcggaaagagaattgagccctcctgggctgatgtgaaaaaggaccttatctcttacggcgggggatggaagctggagggcgaatggaaagagggcgaagaggttcaggtgctcgccctggaacctgggaagaatccgcgggccgtccagaccaaacccggaatcttcaagacaaacaccggcacaattggggctgtgagcctcgatttttcccctggaaccagcggctctcccatcgtggacagaaaagggaaggttgtcggactgtacggcaatggcgtggtgacacgctccggggcctatgtcagcgcgattgctcagacggagaagtctatcgaggataaccctgaaattgaggacgatatcttccggaaaaagagacttaccatcatggacctgcatcccggagccggcaaaacaaagcgctacctgcctgccattgtgcgggaagctatcaaaagagggctccgcaccctgattcttgccccgacccgggttgtggctgccgagatggaagaggcgctgagaggactccccatccgctatcaaacccctgccattcgggctgagcacacgggcagagaaatcgtcgacctgatgtgtcatgccaccttcacaatgcggctcctgtcccccgtgcgcgttcctaactacaatcttattatcatggatgaggctcactttaccgaccccgccagcatcgccgctagagggtatatttccacacgggtggaaatgggcgaggcggccggaatcttcatgaccgctacgccgcctggctctcgcgatccctttccccagagcaacgcccctattatggacgaggaaagagagatccccgaacggtcctggaatagcgggcacgagtgggtcacagatttcaagggaaagaccgtgtggtttgttccttctattaaagccggcaacgacatcgctgcctgcctgagaaagaatgggaaaaaggtgatccagctgtcccgcaaaaccttcgatagcgaatacgtcaagacacgggcgaacgactgggattttgtggtgaccacagacatttctgagatgggagctaatttcagagccgagcgcgtcatcgatccgcggagatgtatgaagcccgttattctcaccgacggcgaagaacgcgtgatcctggccgggcctatgcccgtgacgcatagctccgctgcccaacggagaggccgcattggaagaaaccctaaaaatgaaaacgaccagtatatctacatgggcgagccccttgaaaatgatgaggactgcgcgcactggaaggaggccaaaatgctgctcgataacatcaatacaccggaagggattatcccttctatgtttgagcccgaacgggagaaggtcgacgctattgatggagaataccgcctgagaggcgaggcccggaaaaccttcgtggacctgatgcgcagaggggatctccctgtttggcttgcttatcgggtggccgctgagggaatcaactacgccgacagacgctggtgttttgatggcattaagaataaccagatcctggaagagaacgtcgaagtggagatttggacaaaagagggggaacggaagaagctgaaacccagatggctcgacgcgcgcatctatagcgatcctctggcccttaaggagttcaaagagttcgctgccggccggaagtccctgaccctcaatctgatcacggagatgggaagactgcccacctttatgacacagaaagctcgggacgccctcgataaccttgccgttctgcataccgctgaagtgggcgggcgcgcgtacaatcacgccctgtctgagctcccggagacactggaaacccttctgctcctgacactgctcgctaccgtcacgggaggcattttcctttttctgatgagcgggaagggaatcggcaagatgacactgggcatgtgctgcattatcaccgcctccattctcctgtggtatgcccaaatccagcctcactggatcgctgccagcattatccttgagttctttctgattgtgctcctgatccccgaacccgagaaacagagaacccctcaggacaaccaactgacatacgtcgtgattgcgatcctcaccgttgtggccgctacaatggccaatgaaatggggttccttgagaagacgaaaaaggacctgggactgggctctatcaccacacaggagtccgaaagcaacattctcgatatcgacctgcggccggcttccgcctggaccctttatgcggtggccacaacctttgtcacgcccatgctgcgccattctattgagaatagctccgttaacgtgtctctcaccgctatcgccaatcaggctacagtgctgatggggctgggaagaggctggcctctcagcaaaatggatattggggtcccccttctggccatcggatgttactcccaggtgaaccctattaccctgacagctgccctcctgcttctggttgcgcactacgccatcatcggccccggcctccaagctaaggccacccgggaagctcagaagcgcacggccgccgggattatgaaaaatcctacagtggacggaatcaccgtcattgatctggagccgatcccctatgaccctaagttcgaaaaacagctgggccaggtgatgctccttgtcctgtgcgtgacacaagttctgatgatgagaaccacctgggcgctctgtgaggctctgacacttgccacggggcccattagcaccctgtgggagggaaaccctggccggttttggaatacaaccatcgctgtgtctatggccaacatcttccgcgggtcctacctcgccggagctggcctgctgtttagcattatgaagaatacaaccaacacgagacggggcacagggaatatcggagaaaccctcggcgagaaatggaagtctagacttaacgccctggggaagtccgagttccagatttataaaaagagcggaatccaggaggtcgatcgcaccctggcgaaagagggcattaagagaggggaaacagaccatcacgccgtgtctagaggaagcgctaaactccgctggtttgttgagcggaacatggtgacccccgaaggcaaggtcgtggatctgggctgcgggagaggaggctggtcctactattgtgggggacttaaaaatgtgcgcgaggttaagggcctgacaaaaggcgggccggggcatgaagaacctatccccatgtctacgtacggctggaacctcgtccggctgcaaagcggggtggacgtgttcttcacaccccctgagaaatgcgataccctgctctgtgacatcggagaatccagccccaatcctaccattgaggccggcagaacacttcgcgtcctgaacctggttgaaaattggctcaacaataacacccagttttgcatcaaggtgctgaatccgtatatgccctccgtgattgagaaaatggaaacgcttcagcggaagtacgggggagctctggtcagaaaccctctctctcgcaatagcacccacgagatgtactgggtgtccaacgccacaggcaatatcgtttctagcgtgaacatgatttcccggatgctgatcaatagattcaccatgaaacacaagaaggcgacatatgagcccgatgtcgacctggggtctggaacccgcaacatcggcattgaaagcgagatccctaacctcgacattatcggcaaaagaattgaaaagatcaaacaggagcatgaaacatcctggcactacgatcaagaccatccctataagacctgggcctaccacgggagctatgagacgaaacagacaggatctgcttccagcatggtgaatggcgttgtgaaacttctgaccaagccgtgggatgtcgtgcctatggtgacccagatggccatgacagacacgaccccctttgggcagcaacgggtcttcaaagagaaggttgatacacgcacccaggaacctaaagagggaacaaagaaactgatgagaattaccgctgaatggctctggaaggagctgggcaagaaaaagacaccccggatgtgtaccagagaggaatttacgcggaaagtgcgctctaacgccgctcttggggccatcttcaccgacgagaataagtggaaatccgcgagagaagccgtggaggatagccggttttgggaactggtcgaccgcgagagaaacctccacctggagggaaagtgcgaaacatgtgtgtacaatatgatgggcaaacgggagaagaagctgggcgagttcgggaaagctaagggatctcgcgccatctggtatatgtggctcggcgctagatttctggagttcgaagcccttgggtttctgaacgaggatcattggttctcccggggaaatagcctctccggcgttgagggggaaggcctgcaccgccttggatacattctgagagaggtgggcaaaaaggaagggggagccatgtacgcggacgataccgctggctgggacacacggatcaccctcgaggacctgaaaaacgaagagatggtcacgaatcatatgaagggggagcacaagaaactggccgaagccatttttaagctcacatatcagaacaaagtggttcgcgtgcagagacctacaccccggggaacagtcatggatatcattagccgcaaggaccaaagaggctctggacaggtgggcacctacggactgaatacgttcaccaacatggaggctcagcttatccggcaaatggaaggcgaggggatcttcaaaagcattcagcatctgacagccaccgaggaaatcgctgttcagaattggctcgccagagtgggacgcgagcggctgtccagaatggcgatttctggcgatgactgcgtcgtgaagccgatcgatgaccgctttgccagcgctcttacagccctgaacgatatggggaaggtccggaaagacattcagcaatgggaaccttccagaggatggaatgattggacccaggtgcccttctgctctcaccactttcatgagctcgttatgaaggacggccgcgtgctggtcgtgccctgtcggaaccaggatgaactgatcgggagagctcgcatcagccagggcgccggatggtccctcaaagagacagcgtgcctgggcaagtcttatgcccaaatgtggacccttatgtacttccaccggagagacctgcgcctcgctgccaacgctatttgtagcgccgtgccttcccattgggttccgacgagccggacaacctggtctatccacgctaaacacgagtggatgaccacagaagatatgctggccgtgtggaatagagtctggattcaggagaacccctggatggaagacaagacccctgtggagtcctgggaagaggttccctatcttgggaagcgggaggaccagtggtgcggaagcctgatcggcctcacatctagagcgacgtgggccaaaaatattcagaccgctatcaaccaagtgcgctccctgattgggaatgaagagtacacagattatatgcctagcatgaagcggtttagacgcgaagaggaagaggccggagtcctgtggtga

SEQ ID NO: 19986 - RNA, 9876 nt, synthetic construct
  misc_feature 1..9876: note = derived and/or modified CDS sequence (opt5) from DENV-2__EU482727__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacaaacactgaccatcctcatcagaacagggctgctcgtgatttctggagttttccccgtgagcatcccgattacggctgcggcctggtacctgtgggaggtcaagaagcagcgggctggcgtgctttgggatgtcccttctccccctcccgtggggaaagccgaactggaggacggagcctatcgcatcaagcagagaggcatttttggctacagccagatcggggctggagtttataaagaaggcaccttccacacaatgtggcatgtgaccagaggggccgtcctgatgcaccgcggaaagagaatcgagcccagctgggcggatgtgaaaaaggacctcatttcctacggcgggggatggaagctggagggcgaatggaaagagggcgaagaggttcaagtgcttgctctggaacctgggaagaatccgcgggccgtccagacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcatcccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcacaccggcagagaaattgtcgacctcatgtgtcatgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccaaagcaacgctcctatcatggacgaggaaagagagattcccgaacggtcttggaactccgggcacgagtgggtcacagattttaagggaaagaccgtgtggttcgttcctagcatcaaagccggcaacgacatcgccgcttgccttagaaagaatgggaaaaaggtgattcagctgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccattctagcgccgctcagcggagaggccgcatcggaagaaaccctaaaaatgaaaacgaccaatatatctacatgggcgagcccctggaaaatgatgaggactgcgcctactggaaggaggcgaaaatgcttctggataacattaatacaccggaagggatcattccttccatgttcgagcccgaacgggagaaggtcgacgccatcgatggagaatatcgcctcagaggcgaggctcggaaaacctttgtggacctgatgcgcagaggggatctgcctgtttggctcgcctaccgggtggctgccgagggaattaactatgctgacagacgctggtgtttcgatggcatcaagaataaccagattcttgaagagaacgtcgaagtggagatctggacgaaagagggggaacggaagaagctgaaacccagatggctggacgcccgcatctactctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttataatcatgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtacgcccagatccaacctcactggattgccgcttccatcattctggagtttttccttatcgtgctgctcattcccgaacccgagaaacagagaacgcctcaggacaaccagctgacatatgtcgtgatcgccatcctgaccgttgtggcggccaccatggctaatgaaatggggtttctcgagaagaccaagaaggaccttggactgggcagcattaccacacaagagtccgaatctaacatcctggatattgacctccggccggccagcgcttggacgctgtacgccgtggcgaccacattcgtcacccccatgcttcgccactccatcgaaaattctagcgttaacgtgtccctgacagccattgctaatcaggccaccgtgctcatggggctgggaagaggctggcctctgagcaaaatggatatcggggtccccctccttgctattggatgttactctcaggtgaaccctatcacgctgaccgccgctctgctcctgcttgttgcccattatgcgatcattggccccggcctgcaggccaaggctacacgggaagcccaaaagcgcgctgccgccgggatcatgaaaaatcctaccgtggacggaattacagtcatcgatctcgagccgattccctacgaccctaagtttgaaaaacagctgggccaggtgatgctgctcgtcctttgcgtgacccaggttctgatgatgagaacgacatgggcgctgtgtgaggctctcaccctggccacagggcccatctccaccctttgggagggaaaccctggccggttctggaataccacaatcgctgtgagcatggccaacatttttcgcgggtcttatctggccggagctggcctcctgttctccatcatgaagaatacgaccaacacaagacggggcaccgggaatattggagaaacactgggcgagaaatggaaaagcagactcaacgcccttgggaagtctgaatttcaaatctacaaaaagagcggcattcaggaggtcgatcgcaccctggcgaaagagggcatcaagagaggggaaacggaccaccatgccgtgtccagaggatctgctaaactgcgctggttcgttgagcggaacatggtgacacccgaaggcaaggtcgtggatctcggctgcgggagaggaggctggagctattactgtgggggactgaaaaatgtgcgcgaggttaagggccttaccaaagggggaccgggccacgaggagcctatccccatgtccacctatggctggaacctggtccggctccagagcggggtggacgtgttctttacaccccctgagaaatgcgataccctgctgtgtgacattggagaatcctctcccaatcctacaatcgaggccggcagaacgctccgcgtccttaacctggttgaaaattggctgaacaataacacccaattctgcattaaggtgctcaatccgtacatgcccagcgtgatcgagaaaatggaaacactgcagcggaagtacgggggagctcttgtcagaaaccctctgtcccgcaattctacccatgagatgtattgggtgagcaacgccacaggcaatattgtttcctctgtgaacatgatcagccggatgctcatcaatagatttaccatgaaacacaagaaggcgacgtacgagcccgatgtcgacctggggtccggaacccgcaacattggcatcgaaaacgagattcctaatctggacatcattggcaaaagaatcgaaaagattaaacaggagcacgaaacaagctggcattatgatcaggaccacccctacaagacctgggcctatcatgggtcttacgagacaaaacaaaccggatccgctagctctatggtgaacggcgttgtgcggctccttacaaagccgtgggatgtcgtgcctatggtgacccagatggccatgacggacacaacccccttcgggcagcagcgcgtctttaaggagaaagttgataccagaacacaagaacctaaggagggaacgaaaaagctgatgcggatcaccgctgaatggctgtggaaagagctcggcaagaagaaaacacccagaatgtgtacccgggaggagttcacacgcaaggtgagatccaatgccgctctgggggccatctttaccgacgagaacaaatggaaaagcgcgcgggaagccgtggaggattctcgcttctgggaacttgtcgacagagagcggaatctgcacctcgagggaaaatgcgaaacatgtgtgtataacatgatgggcaagcgcgagaaaaagctgggcgaatttgggaaggctaaaggatccagagccatttggtacatgtggctgggcgctcggttcctcgagtttgaagccctggggttccttaatgaggatcactggtttagccgcagaaactccctgagcggagttgagggcgaagggctccataagctgggctacatccttcgggacgtgtctaaaaaggagggaggcgccatgtatgcggatgacaccgctgggtgggacacgcgcattaccctggaagatctcaaaaatgaggaaatggtcacaaaccacatgaagggagagcataagaaactggccgaggccatcttcaagctgacctaccagaataaagtggttagagtgcagcggcctacaccccgcggcaccgtcatggacattatcagcagaaaggatcagcgggggtccggacaagtgggcacgtatgggctcaacacattcaccaatatggaagctcagctgatcagacagatggagggcgaaggaatttttaaatctatccaacgccttacagttaccgaggagattgccgtgcagaactggctggctcgggtcggcagagaacgcctcagccggatggccatctccggggacgattgcgtggtcaagccgctggacgatagattcgcgtctgcccttacggctctgaatgacatgggaaaggtgcgcaaagatattcagcagtgggagcctagccggggctggaacgactggacccaagttcccttttgctcccaccatttccacgaactcgtgatgaaggatgggagagtcctggtggtgccctgtcgcaaccaggacgagctgatcggacgggccagaatctctcagggcgctgggtggagcctcaaagaaacagcctgcctgggcaagtcctacgcgcagatgtggacccttatgtattttcaccgccgggatctgagactcgccgctaatgccatttgtagcgctgttccttctcattgggtgccgacatcccggaccacatggagcatccacgccaaacatgagtggatgaccacggaggacatgctggctgtctggaacagagtgtggattcaagaaaatccctggatggaggacaagacacctgttgaatcttgggaggaagtgccctaccttggaaagcgcgaggatcagtggtgcggctccctgatcgggctcaccagccgggccacctgggcgaaaaacattcagacagccatcaatcaggtcagatccctgattggaaacgaggaatataccgactacatgccttctatgaagcgcttcagaaaagaggaagaggaagctggcgtgctgtggtga

SEQ ID NO: 19987 - RNA, 9876 nt, synthetic construct
  misc_feature 1..9876: note = derived and/or modified CDS sequence (opt5) from DENV-2__EU482728__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccctggtggatagaggctggggcaacgggtgtggactcttcggcaaagggggaatcgtgacatgcgccatgtttacgtgcaaaaagaatatggaaggcaaagtcgttctgcctgagaaccttgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggcctcgatttcaacgaaatggtgctgcttcagatggaggacaaggcttggctggttcaccgccaatggtttctcgatctgccgctgccttggctccccggggccgacacacagggatctaattggattcagaaggagaccctggtgacgttcaagaaccctcatgctaaaaagcaggacgtcgtggttcttggctcccaagaaggggccatgcacacagccctgaccggcgctacagagatccagatgagctccggaaatctcctgtttaccggccatcttaaatgcagactgcggatggataagctccagctgaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctcggccggctgatcaccgtgaaccctattgttacagaaaaggacagcccggtgaacatcgaggccgaacccccttttggggattcttacattatcatcggcgtcgagcccggacagcttaaactgaattggttcaagaagggctccagcattgggcagatgtttgagaccacaatgagaggagctaaacgcatggccatcctcggcgacaccgcctgggatttcgggtctctgggaggcgtgtttacgagcattgggaaggctctgcaccaagttttcggcgccatctacggagcggctttttccggcgtgtcttggacaatgaaaattcttatcggggtcatcattacctggatcggaatgaacagccggtccaccagcctctctgtgtccctggtgctggttggcgtcgtgacactctatctgggggtgatggtccaggccgacagcggatgtgtggtttcttggaagaataaagaacttaagtgcggctccgggattttcatcaccgataacgtgcacacatggacggagcagtacaagtttcagcctgaaagcccctccaaactggcctctgctattcaaaaggcccatgaggaaggcatctgtggaatcagaagcgtcacccgcctcgagaatctgatgtggaaacagattacaccggagctgaaccacatcctttccgaaaatgaggtgaagctcaccattatgacaggcgacatcaaagggattatgcaggctggaaagcggtctctgagacctcagcccaccgaactgaaatatagctggaagacgtggggcaaggccaaaatgctctccaccgagagccataaccaaacattcctgatcgatgggcctgaaaccgcggagtgccccaatacaaaccgcgcctggaactctcttgaggttgaagactacggatttggcgtgttctccaccaacatctggctgaagctccgggagaaacaggacgtcttttgtgatagcaagctgatgtctgctgccattaaagacaatagagctgtgcacgccgatatgggctattggatcgaatccgcgctgaacgacacatggaagatggagaaggccagcttcattgaggttaaatcttgccactggcctaagagccataccctttggtccaatggggtgctcgaaagcgagatgatcattcccaaaaacttcgctggaccggtctctcagcacaactaccgccctggctatcatacgcagacagccgggccctggcacctgggaaagctggaaatggattttgacttctgtgagggcaccaccgtggtggtcacagaagattgcgggaatcggggaccctccctcagaaccacgacagctagcggcaaactgatcaccgagtggtgctgtcggtcctgcacacttcctccgctgcgctacagaggcgaggacgggtgttggtacggaatggaaattcggcccctcaaggagaaggaagagaacctggttaattctctggtgaccgccggccatgggcaaatcgataactttagccttggagtgctcggcatggccctgttcctggaagagatgctcagaacacgcgtcgggaccaaacacgctatcctgcttgtggcggtttcctttgtgacgctgattaccggaaatatgtctttccgggacctcggcagagtcatggtgatggttggcgccacaatgaccgatgacatcgggatgggagtgacatatctggctctgcttgccgcctttaaggtccgccctaccttcgctgccggcctgctcctgagaaaactcacgagcaaggagctgatgatggcgacaattgggatcgcccttctgtcccagtctaccattcccgaaacaatcctcgagctgaccgatgccctggcccttggaatgatggtgctgaaaatcgttcggaacatggaaaagtaccagctcgctgtgaccattatggccatcagctgcgtccctaatgcggtgattctgcaaaacgcttggaaggtgtcctgtacaatcctcgccgccgtcagcgtttctcccctgcttctgacgtccagccagcagaaagctgactggattcctctcgccctgaccatcaagggcctgaatcccacagctatctttcttaccacactgtctcgcacctccaaaaagagaagctggccgctcaacgaggccgtgatggcggtggggatggtctctattctggcctccagcctcctgaaaaatgacatccctatgacgggaccccttgtggctggcggcctgctgacagtttgctatgtgctcaccgggcggtccgccgatctggaacttgagcgcgctgccgacgtcaagtgggaggatcaggccgaaattagcggatctagccctatcctgtccattaccatctctgaggacggcagcatgtccattaaaaacgaagaggaggaacaaacactcaccatcctgatcagaacagggctcctggtgatttctggagttttccccgtgagcatcccgattacggctgcggcctggtacctttgggaggtcaagaagcagcgggctggcgtgctgtgggatgtcccttctccccctcccgtggggaaagccgaactggaggacggagcctatcgcatcaagcagagaggcatttttggctacagccagatcggggctggagtttataaagaaggcaccttccacacaatgtggcatgtgaccagaggggctgtcctcatgcaccgcggaaagagaatcgagcccagctgggcggatgtgaaaaaggacctgatttcctacggcgggggatggaaacttgagggcgaatggaaagagggcgaagaggttcaagtgctggctctcgaacctgggaagaatccgcgggccgtccagacaaaacccggactgtttaagaccaacacgggcaccatcggggccgtgagcctcgatttctctcctggaacatccggcagccccattgtggacagaaaagggaaggttgtcggactgtacggcaatggcgtggtgacccgctctggggcttatgtctccgccatcgcgcagacagaaaagagcattgaggataaccctgaaatcgaggacgatatcttccggaaaaagagacttaccattatggacctgcatcccggagctggcaaaacaaagcgctacctgcctgccatcgtgcgggaagccattaaaagagggctccgcacgctgatccttgctccgacccgggttgtggccgctgagatggaagaggccctgagaggactccccattcgctatcagacccctgcgatccgggccgagcacaccggcagagaaattgtcgacctgatgtgtcatgctacctttacaatgcggctcctgtcccccgtgcgcgttcctaactacaatcttatcatcatggatgaggcccacttcacggaccccgcttctattgccgccagagggtatatcagcacccgggtggaaatgggcgaggctgcgggaatttttatgacagccaccccgcctggctcccgcgatcccttcccccaaagcaacgctcctatcatggacgaggaaagagagattcccgaacggtcttggaactccgggcacgagtgggtcacagattttaagggaaagaccgtgtggttcgttcctagcatcaaagccggcaacgacatcgccgcttgcctgagaaagaatgggaaaaaggtgattcagctgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctcacagacggcgaggaacgcgtgattctggccgggcctatgcccgtgacccattctagcgccgctcagcggagaggccgcatcggaagaaaccctaaaaatgaaaacgaccaatatatctacatgggcgagccccttgaaaatgatgaggactgcgcccactggaaggaggcgaaaatgctgctcgataacattaatacaccggaagggatcattccttccatgttcgagcccgaacgggagaaggtcgacgccatcgatggagaataccgcctgagaggcgaggctcggaaaacctttgtggacctgatgcgcagaggggatctccctgtttggcttgcctatcgggtggctgccgagggaattaactacgctgacagacgctggtgtttcgatggcatcaagaataaccagattctggaagagaacgtcgaagtggagatctggacgaaagagggggaacggaagaagctgaaacccagatggctcgacgcccgcatctattctgatcctctggcgcttaaggagttcaaagaatttgccgctggccggaagtccctgacactcaatctgattaccgagatgggaagactgcccacattcatgacccagaaagcccgggacgctctcgataaccttgccgttctgcatacggccgaagtgggcgggcgcgcttacaatcacgcgctgtccgagctcccggagaccctggaaacacttctgctcctgaccctgctcgccacagtcaccggaggcatctttcttttcctgatgagcgggaagggaattggcaagatgacactgggcatgtgctgcatcattaccgcttctatcctcctgtggtatgcccagatccaacctcactggattgccgcttccatcattcttgagtttttcctgatcgtgctcctgattcccgaacccgagaaacagagaacgcctcaggacaaccagctgacatacgtcgtgatcgccatcctcaccgttgtggcggccaccatggctaatgaaatggggtttcttgagaagaccaagaaggacctgggactgggcagcattaccacacaagagtccgaatctaacatcctcgatattgacctgcggccggccagcgcttggacgctttatgccgtggcgaccacattcgtcacccccatgctgcgccattccatcgaaaattctagcgttaacgtgtccctcacagccattgctaatcaggccaccgtgctgatggggctgggaagaggctggcctctcagcaaaatggatatcggggtcccccttctggctattggatgttactctcaggtgaaccctatcacgctgaccgccgctctcctgcttctggttgcccactacgcgatcattggccccggcctccaggccaaggctacacgggaagcccaaaagcgcgctgccgccgggatcatgaaaaatcctaccgtggacggaattacagtcatcgatctggagccgattccctatgaccctaagtttgaaaaacagctgggccaggtgatgctccttgtcctgtgcgtgacccaggttctgatgatgagaacgacatgggcgctctgtgaggctctgacccttgccacagggcccatctccaccctgtgggagggaaaccctggccggttctggaataccacaatcgctgtgagcatggccaacatttttcgcgggtcttacctcgccggagctggcctgctgttctccatcatgaagaatacgaccaacacaagacggggcaccgggaatattggagaaacactcggcgagaaatggaaaagcagacttaacgccctggggaagtctgaatttcaaatctataaaaagagcggcattcaggaggtcgatcgcaccctggcgaaagagggcatcaagagaggggaaacggaccatcacgccgtgtccagaggatctgctaaactccgctggttcgttgagcggaacatggtgacacccgaaggcaaggtcgtggatctgggctgcgggagaggaggctggagctactattgtgggggacttaaaaatgtgcgcgaggttaagggcctgaccaaagggggaccgggccatgaggagcctatccccatgtccacctacggctggaacctcgtccggctgcagagcggggtggacgtgttctttacaccccctgagaaatgcgataccctgctctgtgacattggagaatcctctcccaatcctacaatcgaggccggcagaacgcttcgcgtcctgaacctggttgaaaattggctcaacaataacacccaattctgcattaaggtgctgaatccgtatatgcccagcgtgatcgagaaaatggaaacacttcagcggaagtacgggggagctctggtcagaaaccctctctcccgcaattctacccacgagatgtactgggtgagcaacgccacaggcaatattgtttcctctgtgaacatgatcagccggatgctgatcaatagatttaccatgaaacacaagaaggcgacgtatgagcccgatgtcgacctggggtccggaacccgcaacattggcatcgaaaacgagattcctaatctcgacatcattggcaaaagaatcgaaaagattaaacaggagcatgaaacaagctggcactacgatcaggaccatccctataagacctgggcctaccacgggtcttatgagacaaaacaaaccggatccgctagctctatggtgaacggcgttgtgcggcttctgacaaagccgtgggatgtcgtgcctatggtgacccagatggccatgacggacacaacccccttcgggcagcagcgcgtctttaaggagaaagttgataccagaacacaagaacctaaggagggaacgaaaaagctgatgcggatcaccgctgaatggctctggaaagagctgggcaagaagaaaacacccagaatgtgtacccgggaggagttcacacgcaaggtgagatccaatgccgctcttggggccatctttaccgacgagaacaaatggaaaagcgcgcgggaagccgtggaggattctcgcttctgggaactggtcgacagagagcggaatctccacctggagggaaaatgcgaaacatgtgtgtacaacatgatgggcaagcgcgagaaaaagctgggcgaatttgggaaggctaaaggatccagagccatttggtatatgtggctcggcgctcggttcctggagtttgaagcccttgggttcctgaatgaggatcattggtttagccgcggaaactccctcagcggcgttgagggggaaggcctgcacaaacttggatacatcctgagagacgtgtctaaaaaggagggcggggccatgtacgcggatgacaccgctggatgggacacgcggattaccctcgaagatctgaaaaatgaggaaatggtcacaaaccatatgaagggcgagcacaagaaactggccgaggccatcttcaagctcacctatcagaataaagtggttcgcgtgcagagacctacaccccgggggaccgtcatggacattatcagccgcaaggatcagagaggatccggccaagtggggacgtacggcctgaacacattcaccaatatggaagctcagcttatccggcagatggagggagaaggcatttttaaatctatccaaagactgacagttaccgaggagattgccgtgcagaactggctcgctcgcgtcgggcgggaaagactgagccgcatggccatctccggagacgattgcgtggtcaagccgcttgacgatcggttcgcgtctgccctgacggctctcaatgacatgggcaaggtgagaaaagatattcagcagtgggagcctagccgcgggtggaacgactggacccaagttcccttttgctcccatcacttccacgaactggtgatgaaggatggacgggtcctggtggtgccctgtagaaaccaggacgagctcatcggccgcgcccggatctctcagggggctggctggagcctgaaagaaacagcctgccttggaaagtcctatgcgcagatgtggaccctgatgtactttcatagacgcgatctccggctggccgctaatgccatttgtagcgctgttccttctcactgggtgccgacatccagaaccacatggagcatccatgccaaacacgagtggatgaccacggaggacatgcttgctgtctggaaccgggtgtggattcaagaaaatccctggatggaggacaagacacctgttgaatcttgggaggaagtgccctatctgggcaagagagaggatcagtggtgcgggtccctcatcggactgaccagccgcgccacctgggcgaaaaacattcagacagccatcaatcaggtccggtccctgattggcaacgaggaatacaccgactatatgccttctatgaagagattccgcaaagaggaagaggaagctggggtgctctggtga

SEQ ID NO: 19988 - RNA, 9876 nt, synthetic construct
  misc_feature 1..9876: note = derived and/or modified CDS sequence (opt5) from DENV-2__EU482729__SS-prME
  source 1..9876: mol_type = other RNA
accgccggcgtgatcattatgctgatccccacagctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgaaatcaaagggattatgcaggctggaaagcggtctctcagacctcagcccaccgagctgaaatatagctggaagacgtggggcaaggccaaaatgctgtccaccgaaagccataaccaaacattcctcatcgacgggcctgagaccgcggagtgccccaatacaaaccgcgcctggaactctctggaagttgaggattacggatttggcgtgttctccaccaacatctggcttaagctgcgggaaaaacaggacgtcttttgtgacagcaagctcatgtctgctgccattaaagataatagagctgtgcacgccgacatgggctattggatcgagtccgcgctgaacgatacatggaagatggagaaggccagcttcattgaagttaaatcttgccactggcctaagagccataccctgtggtccaatggggtgcttgagagcgaaatgatcattcccaaaaacttcgctggaccggtctctcagcacaactaccgccctggctatcatacgcagatcgccgggccctggcacctcggaaagctggagatggactttgatttctgtgaaggcacaaccgtggtggtcaccgaggactgcgggaatcggggaccctccctgagaacaaccacggctagcggcaaactcattacagagtggtgctgtcggtcctgcaccctgcctccgcttcgctacagaggcgaagatgggtgttggtacggaatggagatccggcccctgaaggaaaaggaggaaaacctcgttaattctctggtgacagccggccatgggcaaatcgacaactttagcctgggagtgcttggcatggccctcttcctggaggagatgctgagaacccgcgtcgggacaaaacacgctattctcctgatcgcggtgtcctttgttacccttattacgggaaatatgtctttccgggatctgggcagagtgatggtcatggtgggcgccaccatgacagacgatatcgggatgggagttacctatctcgctctgctggccgcctttaaggtgcgccctacattcgctgccggccttctgctcagaaaactgaccagcaaggaactcatgatggcgacgattgggatcgctctgctttcccagtctacaatccccgagaccattctggaactcacagacgccctggccctgggaatgatggtccttaaaatcgtgcggaacatggagaagtaccagctggctgttaccattatggccatcagctgcgtgcctaatgcggtcattctccaaaacgcttggaaggtgtcctgtaccatcctggccgccgtgagcgtctctcccctcctgcttacatccagccagcagaaagctgattggatccctctggccctcacgattaagggcctgaatcccaccgctatctttctgacaaccctttctcgcacatccaaaaagagaagctggccgctgaacgaagccgttatggcggtggggatggtgtctattctcgcctccagcctgctcaaaaatgacatccctatgaccggacccctggtcgctggcggccttctgacggtgtgctatgttctgacagggcggtccgccgacctcgagctggagcgcgctgccgatgtgaagtgggaagaccaggccgagattagcggatctagccctatcctttccattaccatctctgaagatggcagcatgtccatcaaaaacgaggaggaagaacaaaccctgacaattctcatcagaaccgggctgctcgtcatttctggagtgttccccgttagcatcccgattacagctgcggcctggtacctgtgggaagtgaagaagcagcgggctggcgtcctttgggacgtgccttctccccctcccgtcgggaaagccgagctggaagatggagcctatcgcatcaagcagagaggcatctttggctacagccagattggggctggagtgtataaagagggcacgttccacaccatgtggcatgttacaagaggggccgtgctgatgcaccgcggaaagagaatcgagcccagctgggcggacgtcaaaaaggatctcatttcctacggcgggggatggaagctggaaggcgagtggaaagaaggcgaggaagtgcaagttcttgctctggagcctgggaagaatccgcgggccgtgcagaccaaacccggactctttaagacaaacaccggcacgatcggggccgtcagcctggacttctctcctggaacctccggcagccccattgtggatagaaaagggaaggtggttggactctacggcaatggcgtcgtgacacgctctggggcttatgtgtccgccatcgcgcagaccgaaaagagcatcgaagacaaccctgagattgaagatgacatcttccggaaaaagagactgacaattatggatcttcatcccggagctggcaaaaccaagcgctacctgcctgccatcgtccgggaggccattaaaagagggctgcgcacactcatcctggctccgacgcgggtggttgccgctgaaatggaggaggcccttagaggactgcccattcgctatcagacccctgcgatccgggccgaacacacaggcagagagatcgtggacctcatgtgtcatgctacctttaccatgcggctgctctcccccgtccgcgtgcctaactacaatctgattatcatggacgaagcccacttcacagatcccgcttctattgccgccagagggtatatcagcacgcgggttgagatgggcgaggctgcgggaatttttatgaccgccacaccgcctggctcccgcgaccccttcccccaaagcaacgctcctatcatggatgaagagagagaaatccccgagcggtcttggaactccgggcacgaatgggtgaccgactttaagggaaagacagtctggttcgtgcctagcattaaagccggcaacgatatcgccgcttgccttagaaagaatgggaaaaaggttattcagctgtctcgcaaaacctttgacagcgagtacgtgaagacgcgggccaacgattgggacttcgtcgtgacaaccgatatctccgagatgggagcgaattttagagctgaacgcgtgattgacccgcggagatgtatgaagcccgtcatcctgaccgatggcgaggaacgcgttatcctcgccgggcctatgcccgtgacacattctagcgccgctcagcggagaggccgcattggaagaaaccctaaaaatgagaacgaccaatatatctacatgggcgaacccctggagaatgacgaggattgcgcctactggaaggaagcgaaaatgcttctggacaacattaataccccggaggggatcattccttccatgttcgaacccgagcgggaaaaggtggatgccatcgacggagagtatcgcctcagaggcgaggctcggaaaacatttgtcgatctgatgcgcagaggggacctgcctgtgtggctcgcctaccgggttgctgccgaaggaattaactatgctgatagacgctggtgtttcgacggcatcaagaataaccagatccttgaggaaaacgtggaggtcgagatttggaccaaagaaggggagcggaagaagctgaaacccagatggctggatgcccgcatctactctgaccctctcgcgctgaaggagttcaaagagtttgccgctggccggaagtcccttacgctgaatctcattacagaaatgggaagactgcccaccttcatgacacagaaagcccgggatgctctggacaacctcgccgtgcttcacaccgccgaggttggcgggcgcgcttataatcatgcgctgtccgagctgccggaaacgctcgagaccctgcttctgctcacactgctggccaccgtgacaggaggcatctttctcttccttatgagcgggaagggaattggcaagatgaccctgggcatgtgctgcatcatcacagcttctattctgctctggtacgcccagatccaacctcactggattgccgcttccatcattctggaatttttccttatcgtcctgctcatccccgagcccgaaaaacagagaacccctcaggataaccagctgacgtatgtggtcattgccatcctgacagtggttgcggccaccatggctaatgagatggggtttctcgagaagaccaaaaaggaccttggactgggcagcattacaacccaagaatccgagtctaacatcctggacattgatctccggccggccagcgcttggacactgtacgccgtggcgacgaccttcgtgacacccatgcttcgccactccatcgaaaattctagcgtcaacgtttccctgaccgccattgctaatcaggccacagtgctcatggggctgggaagaggctggcctctgagcaaaatggacatcggggtgcccctccttgctatcggatgttactctcaggtcaaccctattaccctgacggccgctctgctcctgcttgtggcccattatgcgatcattggccccggcctgcaggccaaggctacccgggaggcccaaaagcgcgctgccgccgggatcatgaaaaatcctacagttgatggaattaccgtgatcgacctcgaaccgatcccctacgatcctaagtttgagaaacagctgggccaggtcatgctgctcgtgctttgcgtcacacaggtgctgatgatgagaaccacgtgggcgctgtgtgaggctctcacactggccaccgggcccatttccacactttgggaaggaaaccctggccggttctggaataccaccatcgctgttagcatggccaacatttttcgcgggtcttatctggccggagctggcctcctgttctccatcatgaagaatacaacgaacaccagacggggcacagggaataccggagagacactgggcgaaaaatggaaaagcagactcaacgcccttgggaagtctgagtttcaaatttacaaaaagagcggaatccaggaggtggaccgcaccctggcgaaagaaggcatcaagagaggggagacggatcaccatgccgtctccagaggatctgctaaactgcgctggttcgtggaacggaacatggttacacccgagggcaaggtggtcgacctcggctgcgggagaggaggctggagctattactgtgggggactgaaaaatgtgcgcgaagtgaagggccttaccaaagggggaccgggccacgaggagcctattcccatgtccacctatggctggaacctggttcggctccagagcggggtcgatgtgttctttacaccccctgaaaaatgcgacaccctgctgtgtgatatcggagagtcctctcccaatcctacaattgaagccggcagaacgctccgcgtgcttaacctggtcgagaattggctgaacaataacacccaattctgcatcaaggttctcaatccgtacatgcccagcgtgattgagaagatggagacactgcagcggaagtacgggggagctcttgtgagaaaccctctgtcccgcaattctacccatgagatgtattgggtcagcaacgccacaggcaatatcgtgtcctctgttaacatgatcagccggatgctcattaatagatttaccatgaaacacaagaaggcgacgtacgaacccgacgtggatctggggtccggaacccgcaacatcggcattgagaacgaaatccctaatctggacattatcggcaaaagaattgagaagatcaaacaggaacacgagacaagctggcattatgaccaggatcacccctacaagacctgggcctatcatgggtcttacgagacaaaacaaaccggatccgctagctctatggtcaacggcgtggttcggctccttacaaagccgtgggacgtggtccctatggtgacccagatggccatgacggatacaacccccttcgggcagcagcgcgtgtttaaggaaaaagtcgacaccagaacacaagagcctaaggaaggaacgaaaaagctgatgcggatcaccgctgagtggctgtggaaagagctcggcaagaagaaaacacccagaatgtgtacccgggaagagttcacacgcaaggttagatccaatgccgctctgggggccatttttaccgatgaaaacaaatggaaaagcgcgcgggaggccgtggaagactctcgcttctgggagcttgtggatagagagcggaatctgcacctcgaaggaaaatgcgagacatgtgtctataacatgatgggcaagcgcgagaagaagctgggcgagtttgggaaggctaaaggatccagagccatctggtacatgtggctgggcgctcggttcctcgaatttgaggccctggggttccttaatgaggaccactggtttagccgcagaaactccctgagcggagtggaaggcgaggggctccataagctgggctacattcttcgggatgtttctaaaaaggaaggaggcgccatgtatgcggacgataccgctgggtgggacacgcgcatcaccctggaggacctcaaaaatgaagagatggtgacaaaccacatgaagggagagcataagaaactggccgaagccattttcaagctgacctaccagaataaagtcgtgagagttcagcggcctacaccccgcggcaccgtgatggatatcatcagcagaaaggaccagcgggggtccggacaagtcggcacgtatgggctcaacacattcaccaatatggaggctcagctgattagacagatggaaggcgagggaatctttaaatctattcaacgccttacagtgaccgaggaaatcgccgttcagaactggctggctcgggtgggcagagagcgcctcagccggatggccatttccggggatgactgcgtcgtgaagccgctggatgacagattcgcgtctgcccttacggctctgaatgatatgggaaaggtccgcaaagacatccagcagtgggaacctagccggggctggaacgattggacccaagtgcccttttgctcccaccatttccacgagctcgttatgaaggacgggagagtgctggtcgtgccctgtcgcaaccaggatgaactgatcggacgggccagaatttctcagggcgctgggtggagcctcaaagagacagcctgcctgggcaagtcctacgcgcagatgtggacccttatgtattttcaccgccgggacctgagactcgccgctaatgccatctgtagcgctgtgccttctcattgggttccgacatcccggaccacatggagcattcacgccaaacatgagtggatgaccacggaagatatgctggctgtgtggaacagagtctggatccaagagaatccctggatggaagacaagacacctgtggagtcttgggaagaggttccctaccttggaaagcgcgaggaccagtggtgcggctccctgattgggctcaccagccgggccacctgggcgaaaaacatccagacagccattaatcaggtgagatccctgatcggaaacgaagagtataccgattacatgccttctatgaagcgcttcagaaaagaagaggaagaggctggcgtcctgtggtga

SEQ ID NO: 19989 - RNA, 9876 nt, synthetic construct
  misc_feature 1..9876: note = derived and/or modified CDS sequence (opt5) from DENV-2__EU482731__SS-prME
  source 1..9876: mol_type = other RNA
accgccggcgtgatcgtcatgctgattcccacagttatggctttccacctcacgacccggaacggggagcctcatatgatcgtgggacggcaggaaaagggcaagtccctgctttttaagacagaggacggggtgaatatgtgcaccctgatggccattgatctcggagaactgtgtgaggacacaatcacctacaagtgcccgcttctgcgccaaaacgaacccgaggatattgactgttggtgcaattccacatctacctgggtcacgtatggcacctgtacaaccacaggggagcacagacgggaaaagcgcagcgtggcgctcgttcctcatgtgggaatgggcctggagaccagaacggaaacatggatgtcctctgagggcgcttggaagcacgtccagcggatcgagacctggatcctgcgccatcccgggttcacaattatggccgccatcctcgcttacaccattggaaccacacactttcagagagccctgatcttcattcttctgacggctgtggcccctagcatgaccatgcggtgcatcggcatttccaaccgcgattttgttgaaggggtgtctggaggcagctgggtcgacatcgtgctcgagcacgggtcctgtgtgacaaccatggcgaagaataagcccacactggatttcgaacttatcaagaccgaggccaagcagcctgctacgctgagaaaatattgcattgaagccaagctcacaaacaccaccacagagagccggtgtccgacccaaggagagccctctctgaatgaagaacaggacaaacgctttatctgcaagcattccatggtcgatagaggctggggcaacgggtgtggactgttcggcaaagggggcattgttacatgcgctatgtttacgtgcaaaaagaatatggaaggcaaaatcgtgcagcctgagaacctcgaatacaccattgtgatcacaccccacagcggggaggagcatgccgtcggaaatgacaccggcaagcacggcaaagaaatcaagattacacctcagtcttccaccacggaggcggaactgaccgggtatggaacagtgaccatggagtgtagcccccggacaggccttgatttcaacgaaatggttctgctccaaatggaggacaaagcctggctggtgcaccgccagtggtttcttgatctgccgctcccttggctgcccggggctgacacccagggatctaattggatccagaaggagacgctggtcacattcaagaaccctcatgccaaaaagcaagacgtggttgtgctcggctcccaggaaggggctatgcacaccgccctgacaggcgccaccgagattcagatgagctccggaaatcttctgtttaccggccatctcaaatgcagactgcggatggataaacttcaactgaaagggatgtcttacagcatgtgtacaggaaagttcaagatcgtcaaagaaattgctgagacgcagcacggcaccatcgtgatcagagtccagtatgagggggacggatccccctgcaagattcccttcgaaatcacagatctcgagaaacgccatgtgctgggccggctgattaccgttaaccctatcgtgacagaaaaggacgcgccggtcaacattgaggccgaacccccttttggggatagctacatcattgtgggcgttgagcccggacagctcaaactgaattggttcaagaagggatcttccatcgggcaaatgtttgagaccacgatgagaggagctaaacgcatggccatccttggcgacacagcctgggatttcgggagcctgggaggcgtgtttacctctattgggaaggctctccaccaggtcttcggcgccatctacggagcggcttttagcggcgtgtcctggaccatgaaaattctgatcggggtgattatcacatggatcggaatgaactctcggagcacctccctgagcgtttctcttgtcctcgtgggcgtggtcacactgtatctgggggccatggtgcaggccgactccggatgtgttgtgagctggaagaataaagaactcaagtgcggctctgggattttcatcacggataacgtccacacctggacagagcagtacaagtttcaacctgaatcccccagcaaactggcttccgccattcagaaggctcatgaggaaggcatctgtggaattagatctgtgacccgccttgagaatctgatgtggaaacagatcacaccggagctcaaccacatcctgagcgaaaatgaggttaagctgaccattatgacgggcgacatcaaagggattatgcaggccggaaagcggtcccttagacctcaacccaccgaactcaaatattcttggaagacatggggcaaggcgaaaatgctgagcaccgagtcccataaccagacattcctgatcgatgggcctgaaaccgccgagtgccccaatacaaaccgcgcttggaatagcctcgaggtggaagactacggatttggcgtcttcaccacgaacatttggctgaaacttcgggagaaacaggacgtgttttgtgattctaagctgatgtccgccgctatcaaagacaatagagccgttcacgcggatatgggctattggatcgaaagcgccctcaacgacacatggaagatggagaaggcttctttcattgaggtgaaatcctgccactggcctaagagccataccctgtggtctaatggggtcctggaaagcgagatgatcattcccaaaaacttcgccggaccggtgtcccagcacaactaccgccctggctatcatacccaaacagctgggccctggcaccttggaaagctcgaaatggattttgacttctgtgagggcaccacggtggtcgttacagaagattgcgggaatcggggacccagcctgagaaccacaaccgcctctggcaaactgatcacagagtggtgctgtcggtcctgcaccctccctccgctgcgctacagaggcgaggacgggtgttggtacggaatggaaattcggccccttaaggagaaggaagagaacctggtgaatagcctcgtgacggccggccatgggcagatcgataacttttccctgggagtcctgggcatggctcttttcctcgaagagatgctgagaacccgcgtggggacaaaacacgcgaccctgctcgttgccctgtcttttgtgacacttattaccggaaatatgagcttccgggacctgggcagagtcatggtgatggttggcgctacgatgacagatgacatcgggatgggagtgacctatctcgccctgctggccgcttttaaggtccgccctacattcgccgcgggccttctgctcagaaaactgacctccaaggagctcatgatggctaccatcgggattgccctgctttctcagagcacactgcccgaaacgatcctcgagctgaccgatgccctggctcttggaatgatggtgctgaaaattgttcggaacatggaaaagtaccaactcgccgtgacaatcatggcgatttcctgcgtccctaatgctgtgatcctgcagaacgcctggaaggtgtcttgtaccatcctcgccgctgtcagcgttagccccctgcttctgacaagctctcagcagaaagccgactggattcctctcgctctgaccatcaagggcctgaatcccacggccatttttcttacaaccctgtcccgcaccagcaaaaagagatcttggccgctcaacgaggcgatcatggccgtggggatggtgtccattctggctagctctctcctgaaaaatgacatccctatgacaggaccccttgtcgccggcggcctgctgaccgtgtgctatgttctcacagggcggtccgctgatctggaacttgagcgcgccgccgacgtgaagtgggaggatcaagctgaaatcagcggatccagccctattctgtctatcacgattagcgaggacggctccatgtctatcaaaaacgaagaggaggaacagaccctcacaattctgatcagaaccgggctcctggtcattagcggagtgttccccgtttccatcccgatcacagcggccgcttggtacctttgggaggtgaagaagcagcgggccggcgtcctgtgggatgtgccttctccccctcccgtcgggaaagccgaactggaggacggagcttatcgcattaagcagagaggcatcctcggctacagccaaattggggccggagtgtataaagaaggcacctttcacacgatgtggcatgttaccagaggggcggtgctgatgcaccgcggaaagagaatcgagccctcctgggctgatgtcaaaaaggaccttatttcttacggcgggggatggaagctggagggcgaatggaaagagggcgaagaggtgcaggttctcgccctggaacctgggaagaatccgcgggccgtgcagacaaaacccggaatcttcaagaccaacacaggcaccatcggggctgtcagcctcgatttttcccctggaacaagcggctctcccattgtggacagaaaagggaaggtggttggactgtacggcaatggcgtcgtgacgcgctccggggcctatgtgagcgcgatcgctcagaccgagaagtctattgaggataaccctgaaatcgaggacgatattttccggaaaaagagacttacaatcatggacctgcatcccggagccggcaaaaccaagcgctacctgcctgccatcgtccgggaagctattaaaagagggctccgcaccctgatccttgccccgacacgggtggttgctgccgagatggaagaggcgctgagaggactccccattcgctatcaaacgcctgccatccgggctgagcacaccggcagagaaattgtggacctgatgtgtcatgccacattcaccatgcggctcctgtcccccgtccgcgtgcctaactacaatcttatcattatggatgaggctcactttacagaccccgccagcatcgccgctagagggtatatctccacccgggttgaaatgggcgaggcggccggaattttcatgacggctacaccgcctggctctcgcgatccctttccccagagcaacgcccctatcattgacgaggaaagagagatccccgaacggtcctggaatagcgggcacgagtgggtgaccgatttcaagggaaagaccgtctggtttgtgccttctattaaagccggcaacgacatcgctgcctgcctgagaaagaatgggaaaaaggttatccagctgtcccgcaaaacattcgatagcgaatacgtgaagacccgggcgaacgactgggattttgtcgtgacaaccgacatttctgagatgggagctaatttcaaggccgagagagtgatcgatccgcgccggtgtatgaaacccgtcattctcacggacggcgaagagagagttatcctggccgggcctatgcccgtgacacatagctccgctgcccaacgccggggcagaattggacgcaaccctaagaatgaaaacgaccagtatatctacatgggcgagccccttgaaaatgatgaggactgcgcgcactggaaagaggccaagatgctgctcgataacatcaataccccggaagggattatcccttctatgtttgagcccgaaagagagaaagtggacgctattgatggagaataccggctgcgcggcgaggccagaaagacattcgtcgacctgatgcggcgcggggatctccctgtgtggcttgcttataaagttgccgctgagggaatcaactacgccgacagaaagtggtgttttgatggcattaagaataaccagatcctggaagagaacgtggaagtcgagatttggaccaaagagggggaacggaagaaactgaagcccagatggctcgacgcgcgcatctatagcgatcctctggcccttaaagagttcaaggagttcgctgccggccggaagtccctgacgctcaatctgatcaccgagatgggaagactgcccacatttatgacccagaaagctcgcaacgccctcgacaatcttgccgtgctgcatacagctgaagttggcgggcgggcgcacaaccacgccctgtctgagctcccggagaccctggaaacacttctgctcctgaccctgctcgctacggtgacaggaggcattttcctttttctgatgagcgggaagggaatcggcaaaatgaccctgggcatgtgctgcattatcaccgcctccattctcctgtggtacgcccaaatccagcctcattggatcgctgccagcattatccttgagttctttctgattgtcctcctgatccccgaacccgagaagcagagaacacctcaggataatcaactgacctatgtggtcattgcgatcctcacagtggttgccgctacgatggccaacgaaatggggttccttgagaaaaccaagaaggacctgggatttggctctatcacaacccaggagtccgaaagcaatattctggacatcgatctccggccggcttccgcctggacactgtacgcggtggccaccacgttcgtgacccccatgcttcgccactctattgagaacagctccgtcaatgtttctctgacagctatcgccaaccaggctaccgtgctcatggggctgggaaaaggctggcctctgagcaagatggacattggggtgcccctccttgccatcggatgttattcccaggtcaatcctattacactgaccgctgccctgctcctgcttgtggcgcattacgccatcatcggccccggcctgcaagctaaagccacgagagaagctcagaagcgggccgccgcggggattatgaaaaaccctacagttgatggaatcaccgtgattgacctcgagccgatcccctacgatcctaagtttgaaaagcagctgggccaggtcatgctgctcattctttgcgtgacacaagtcctgatgatgcgcaccacctgggctctgtgtgaggccctcacactggctacggggcccatcagcaccctttgggagggaaatcctggcagattctggaacacaaccatcgccgtgtctatggccaatatttttcgggggtcctatctggctggagccggcctcctgttcagcatcatgaaaaacacaaccaatacgcgcagaggcacagggaacgttggagaaaccctgggcgagaagtggaaatctcggctcaacgcgcttgggaagtccgaatttcagatttacaaaaagagcggaatccaggaggtggaccgcaccctggccaaagagggcattaagagaggggaaacagatcaccatgctgtctctcggggaagcgccaagctgagatggttcgtggagcgcaatatggttacccccgaaggcaaagtggtcgacctcggctgcgggcggggaggctggtcctattactgtgggggactgaagaacgtgagagaggtgaaaggccttacaaaagggggaccgggccacgaagaacctatccccatgtctacgtatggctggaatctggttcgcctccaaagcggggtcgatgtgttctttacaccccctgagaaatgcgacaccctgctgtgtgatatcggagaatccagccccaaccctaccattgaggctggccggacactcagagtgcttaatctggtcgaaaactggctgaataacaatacccagttctgcatcaaggttctcaacccgtacatgccctccgtgattgagaagatggaaacgctgcagcgcaaatatgggggagcccttgtgcggaatcctctgtctagaaacagcacccacgagatgtactgggtctccaatgcgacaggcaacatcgtgtctagcgttaatatgatttcccgcatgctcatcaaccggtttaccatgaagcataaaaaggccacatacgagcccgacgtggatctggggtctggaaccagaaacatcggcattgaaagcgagatccctaatctggacattatcggcaaacgcattgaaaagatcaagcaggagcacgaaacatcctggcattatgaccaagatcacccctacaaaacctgggcttatcacgggagctacgagacgaagcagacaggatctgcctccagcatggtcaacggcgtggttcggctccttaccaaaccgtgggacgtggtccctatggtgacccagatggctatgacagatacgacccccttcgggcagcaaagagtgtttaaggagaaagtcgacacacgcacccaggaacctaaggagggaacaaagaaactgatgaagattaccgccgaatggctgtggaaagagctcggcaagaaaaagacacccagaatgtgtacccgggaggagttcacgcgcaaagttagatctaatgctgccctgggggcgatctttaccgatgagaacaagtggaagtccgcccgggaagctgtggaggacggaagattctgggaacttgtggatcgggagcgcaatctgcatctcgagggcaaatgcgaaacatgtgtctataacatgatgggcaagagagagaaaaagctgggggaatttggaaaagccaagggcagccgggctatctggtacatgtggctgggggcccgcttcctcgagtttgaagccctgggattccttaatgaggaccactggttttctagaggcaactccctgagcggggtggagggcgaaggactccatcggctgggctatattcttcgcgaggttgggaagaaagaaggaggcgcgatgtacgctgatgacaccgccgggtgggatacaagaatcaccctggaggacctcaagaatgaagagatggtgacgaaccacatgaaaggagagcataagaaactggccgaagctattttcaagctgacataccagaataaggtcgtgcgggttcagcgccctacccccagaggcacagtgatggacatcatttcccggaaagatcaacgcgggagcggccaggtcggaacctatggcctcaacacgttcaccaatatggaggcccagctgatcagacaaatggaaggggagggaatctttaagtctattcagcaccttacagctaccgaggaaatcgccgtgcagaactggctggcgcgggttggccgcgagagactcagccggatggccatttccggggacgattgcgtggtcaaaccgatcgacgatagattcgcttctgccctgacagctcttaatgacatgggaaaggtgcgcaaagatattcagcaatgggaacctagccggggctggaacgactggacccaggtccccttttgctcccaccatttccacgagctggtgatgaaggatgggagagttctcgtggtcccctgtcgcaaccaggacgaactgatcggccgggccagaatctctcagggagcgggctggagcctgaaggagacagcctgcctcgggaaatcctacgctcaaatgtggaccctgatgtattttcatcgccgggatcttagactggccgctaatgccatttgttctgctgtgcctagccactgggtgccgacgtcccgcacaacctggagcatccacgccaagcatgagtggatgaccacagaagacatgctcgcggtttggaaccgggtgtggattcaggagaatccctggatggaagataaaacccctgtcgagtcttgggaagaggtgccctacctgggaaagagagaggaccagtggtgcggctcccttatcgggctgacaagccgcgccacgtgggctaaaaacattcagaccgccatcaatcaagttcggtctctcattggaaacgaagagtatacagactacatgccttccatgaagagattccggagagaagaggaagaggccggcgtgctgtggtga

SEQ ID NO: 19990 - RNA, 9876 nt, synthetic construct
  misc_feature 1..9876: note = derived and/or modified CDS sequence (opt5) from DENV-2__EU482732__SS-prME
  source 1..9876: mol_type = other RNA
acagtgggagtcatcattatgctgatccccacagccatggctttccacctcacgacacggaatggggagcctcatatgattgttggacggcaggaaaagggcaagagcctgctttttaagacagaggacggggtgaatatgtgcaccctgatggccatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtcgcgctcgtgcctcatgttggaatgggcctggagaccagaacggaaacatggatgtcctctgagggcgcttggaagcacgtgcagcggatcgagacctggattctgcgccatcccgggttcacaatcatggccgccattctcgcttacaccatcggaaccacacactttcagagagccctgattttcatccttctgacggctgtcgcccctagcatgaccatgcggtgcattggcatctccaaccgcgattttgtggaaggggtttctggaggcagctgggtggacatcgtcctcgagcacgggtcctgtgtgacaaccatggcgaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtcacatgcgctatgtttacgtgcaaaaagaatatggaaggcaaagttgtgctccctgagaacctggaatacaccattgtgatcacaccccacagcggggaggagcatgccgtcggaaatgacaccggcaagcacggcaaagaaatcaagattacacctcagtcttccatcaccgaggcggaacttacggggtatggaaccgtgacaatggagtgtagcccccggaccggcctggatttcaacgaaatggttctcctgcagatggaggacaaagcctggcttgtgcaccgccaatggtttctggatctcccgctgccttggctgcccggggctgacacacagggatctaattggattcagaaggagaccctcgtcacgttcaagaaccctcatgccaaaaagcaggacgtggttgtgctgggctcccaagaaggggctatgcacacagcccttaccggcgccacagagatccagatgagctccggaaatctgctctttaccggccatctgaaatgcagacttcggatggataagctgcagctcaaagggatgtcttacagcatgtgtaccggaaagttcaagattgtcaaagaaatcgctgagacacaacacggcacgatcgtgattagagtccagtatgagggggacggatccccctgcaagatccccttcgaaattatggatctggagaaacgccatgtgctgggccggctcatcaccgttaaccctattgtgacagaaaaggacagcccggtcaacatcgaggcggaacccccttttggggattcttacattatcatcggcgtggagcccggacagctgaaacttaattggttcaagaagggctccagcattgggcagatgtttgagaccacaatgagaggagccaaacgcatggctatcctgggcgacaccgcctgggatttcgggtctctcggaggcgcctttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacacacactgaccatcctcatcagaacagggctgctcgtgatttctggagttttccccgtgagcatcccgattacggctgcggcctggtacctgtgggaggtcaagaagcaacgggctggcgtgctttgggatgtcccttctccccctcccgtggggaaagccgaactggaggacggagcctatcgcatcaagcagagaggcatttttggctacagccagatcggggctggagtttataaagaaggcaccttccatacaatgtggcacgtgaccagaggggccgtcctgatgcatcgcggaaagagaatcgagcccagctgggcggatgtgaaaaaggacctcatttcctacggcgggggatggaagctggagggcgaatggaaagagggcgaagaggttcaggtgcttgctctggaacctgggaagaatccgcgggccgtccaaacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcaccccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcataccggcagagaaattgtcgacctcatgtgtcacgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccagagcaacgctcctatcatggacgaggaaagagagattcccgaacggtcttggaactccgggcatgagtgggtcacagattttaagggaaagaccgtgtggttcgttcctagcatcaaagccggcaacgacatcgccgcttgccttagaaagaatgggaaaaaggtgattcaactgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccactctagcgccgctcagcggagaggccgcatcggaagaaaccctaaaaatgaaaacgaccagtatatctacatgggcgagcccctggaaaatgatgaggactgcgcccattggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccaaattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcacacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccagcctcattggattgccgcttccatcattctggagtttttccttatcgtgctgctcattcccgaacccgagaaacaaagaacgcctcaggacaaccagctgacatacgtcgtgatcgccatcctgaccgttgtggcggccaccatggctaatgaaatggggtttctcgagaagaccaagaaggaccttggactgggcagcattaccacacaggagtccgaatctaacatcctggatattgacctccggccggccagcgcttggacgctgtatgccgtggcgaccacattcgtcacccccatgcttcgccactccatcgaaaattctagcgttaacgtgtccctgacagccattgctaatcaagccaccgtgctcatggggctgggaagaggctggcctctgagcaaaatggatatcggggtccccctccttgctattggatgttactctcaggtgaaccctatcacgctgaccgccgctctgctcctgcttgttgcccattacgcgatcattggccccggcctgcaggccaaggctacacgggaagcccagaagcgcgctgccgccgggatcatgaaaaatcctaccgtggacggaattacagtcatcgatctcgagccgattccctatgaccctaagtttgaaaaacaactgggccaggtgatgctgctcgtcctttgcgtgacccaggttctgatgatgagaacgacatgggcgctgtgtgaggctctcaccctggccacagggcccatctccaccctttgggagggaaaccctggccggttctggaataccacaatcgctgtgagcatggccaacatttttcgcgggtcttacctggccggagctggcctcctgttctccatcatgaagaatacgaccaacacaagacggggcaccgggaatattggagaaacactgggcgagaaatggaaaagcagactcaacgcccttgggaagtctgaatttcagatctataaaaagagcggcattcaagaggtcgatcgcaccctggcgaaagagggcatcaagagaggggaaacggaccaccatgccgtgtccagaggatctgctaaactgcgctggttcgttgagcggaacatggtgacacccgaaggcaaggtcgtggatctcggctgcgggagaggaggctggagctactattgtgggggactgaaaaatgtgcgcgaggttaagggccttaccaaagggggaccgggccacgaggagcctatccccatgtccacctacggctggaacctggtccggctccagagcggggtggacgtgttctttacaccccctgagaaatgcgataccctgctgtgtgacattggagaatcctctcccaatcctacaatcgaggccggcagaacgctccgcgtccttaacctggttgaaaattggctgaacaataacacccagttctgcattaaggtgctcaatccgtatatgcccagcgtgatcgagaaaatggaaacactgcaacggaagtacgggggagctcttgtcagaaaccctctgtcccgcaattctacccacgagatgtactgggtgagcaacgccacaggcaatattgtttcctctgtgaacatgatcagccggatgctcatcaatagatttaccatgaaacataagaaggcgacgtatgagcccgatgtcgacctggggtccggaacccgcaacattggcatcgaaaacgagattcctaatctggacatcattggcaaaagaatcgaaaagattaaacaggagcacgaaacaagctggcattacgatcaggaccacccctataagacctgggcctaccacgggtcttatgagacaaaacagaccggatccgctagctctatggtgaacggcgttgtgaagctccttacaaagccgtgggatgtcgtgcctatggtgacccaaatggccatgacggacacaacccccttcgggcagcagcgggtctttaaagagaaggttgatacccgcacacaggaacctaaagagggaacgaagaaactgatgagaatcaccgctgaatggctgtggaaggagctcggcaagaaaaagacaccccggatgtgtaccagagaggagttcacacggaaagtgcgctccaatgccgctctgggggccatctttaccgacgagaacaagtggaaaagcgcgagagaagccgtggaggattctcggttctgggaacttgtcgaccgcgagagaaatctgcatctcgagggaaagtgcgaaacatgtgtgtacaacatgatgggcaaacgggagaagaagctgggcgaatttgggaaagctaagggatcccgcgccatttggtatatgtggctgggcgctagattcctcgagtttgaagccctggggttccttaatgaggatcactggtttagccggggaaactccctgagcggcgttgagggggaaggcctccataaactgggatacatccttcgcgacgtgtctaagaaagagggcggggccatgtacgcggatgacaccgctggatgggacacgagaattaccctggaagatctcaagaatgaggaaatggtcacaaaccacatgaagggcgagcataaaaagctggccgaggccatcttcaaactgacctatcaaaataaggtggttcgggtgcagcgccctacacccagagggaccgtcatggacattatcagccggaaagatcagcgcggatccggccaggtggggacgtacggcctcaacacattcaccaatatggaagctcaactgatcagacagatggagggagaaggcatttttaagtctatccagcggcttacagttaccgaggagattgccgtgcaaaactggctggctagagtcgggcgcgaacggctcagcagaatggccatctccggagacgattgcgtggtcaagccgctggacgatcgcttcgcgtctgcccttacggctctgaatgacatgggcaaagtgcggaaggatattcagcagtgggagcctagcagagggtggaacgactggacccaggttcccttttgctcccaccacttccatgaactcgtgatgaaagatggacgcgtcctggtggtgccctgtcggaaccaagacgagctgatcggcagagcccgcatctctcagggggctggctggagcctcaaggaaacagcctgcctgggaaaatcctatgcgcagatgtggacccttatgtactttcaccggagagatctgcgcctcgccgctaatgccatttgtagcgctgttccttctcattgggtgccgacatcccggaccacatggagcatccacgccaagcacgagtggatgaccacggaggacatgctggctgtctggaacagagtgtggattcaggaaaatccctggatggaggacaagacacctgttgaatcttgggaggaagtgccctatcttggcaaacgggaggatcaatggtgcgggtccctgatcggactcaccagcagagccacctgggcgaagaacattcagacagccatcaatcaggtccgctccctgattggcaacgaggaatacaccgactatatgccttctatgaaacggttcagaaaggaggaagaggaagctggggtgctgtggtga

SEQ ID NO: 19991 - RNA, 9876 nt, synthetic construct
  misc_feature 1..9876: note = derived and/or modified CDS sequence (opt5) from DENV-2__EU482733__SS-prME
  source 1..9876: mol_type = other RNA
acagccggagtgatcattatgctgatccccacagctatggccttccacctcacgacacggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacatggaaaagtaccagctggctgtgaccattatggccatcagctgcgtccctaatgcggtgattctccaaaacgcttggaaggtgtcctgtacaatcctggccgccgtcagcgtttctcccctcctgcttacgtccagccagcagaaagctgactggattcctctggccctcaccatcaagggcctgaatcccacagctatctttctgaccacactttctcgcacctccaaaaagagaagctggccgctgaacgaggccgtgatggcggtggggatggtctctattctcgcctccagcctgctcaaaaatgacatccctatgacgggacccctggtggctggcggccttctgacagtttgctatgtgctgaccgggcggtccgccgatctcgaactggagcgcgctgccgacgtcaagtgggaggatcaggccgaaattagcggatctagccctatcctttccattaccatctctgaggacggcagcatgtccattaaaaacgaagaggaggaacaaacactgaccatcctcatcagaacagggctgctcgtgatttctggagttttccccgtgagcatcccgattacggctgcggcctggtacctgtgggaggtcaagaagcagcgggctggcgtgctttgggatgtcccttctccccctcccgtggggaaagccgaactggaggacggagcctatcgcatcaagcagagaggcatttttggctacagccagatcggggctggagtttataaagaaggcaccttccacacaatgtggcatgtgaccagaggggccgtcctgatgcaccgcggaaagagaatcgagcccagctgggcggatgtgaaaaaggacctcatttcctacggcgggggatggaagctggagggcgaatggaaagagggcgaagaggttcaagtgcttgctctggaacctgggaagaatccgcgggccgtccagacaaaacccggactctttaagaccaacacgggcaccatcggggccgtgagcctggatttctctcctggaacatccggcagccccattgtggacagaaaagggaaggttgtcggactctacggcaatggcgtggtgacccgctctggggcttatgtctccgccatcgcgcagacagaaaagagcattgaggataaccctgaaatcgaggacgatatcttccggaaaaagagactgaccattatggaccttcatcccggagctggcaaaacaaagcgctacctgcctgccatcgtgcgggaagccattaaaagagggctgcgcacgctcatcctggctccgacccgggttgtggccgctgagatggaagaggcccttagaggactgcccattcgctatcagacccctgcgatccgggccgagcacaccggcagagaaattgtcgacctcatgtgtcatgctacctttacaatgcggctgctctcccccgtgcgcgttcctaactacaatctgatcatcatggatgaggcccacttcacggaccccgcttctattgccgccagagggtatatcagcacccgggtggaaatgggcgaggctgcgggaatttttatgacagccaccccgcctggctcccgcgatcccttcccccaaagcaacgctcctatcatggacgaggaaagagagattcccgaacggtcttggaactccgggcacgagtgggtcacagattttaagggaaagaccgtgtggttcgttcctagcatcaaagccggcaacgacatcgccgcttgccttagaaagaatgggaaaaaggtgattcagctgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctgacagacggcgaggaacgcgtgattctcgccgggcctatgcccgtgacccattctagcgccgctcagcggagaggccgcatcggaagaaaccctaaaaatgaaaacgaccaatatatctacatgggcgagcccctggaaaatgatgaggactgcgcccactggaaggaggcgaaaatgcttctggataacattaatacaccggaagggatcattccttccatgttcgagcccgaacgggagaaggtcgacgccatcgatggagaataccgcctcagaggcgaggctcggaaaacctttgtggacctgatgcgcagaggggatctgcctgtttggctcgcctatcgggtggctgccgagggaattaactacgctgacagacgctggtgtttcgatggcatcaagaataaccagattcttgaagagaacgtcgaagtggagatctggacgaaagagggggaacggaagaagctgaaacccagatggctggacgcccgcatctattctgatcctctcgcgctgaaggagttcaaagaatttgccgctggccggaagtcccttacactgaatctcattaccgagatgggaagactgcccacattcatgacccagaaagcccgggacgctctggataacctcgccgttcttcatacggccgaagtgggcgggcgcgcttacaatcacgcgctgtccgagctgccggagaccctcgaaacactgcttctgctcaccctgctggccacagtcaccggaggcatctttctcttccttatgagcgggaagggaattggcaagatgacactgggcatgtgctgcatcattaccgcttctatcctgctctggtatgcccagatccaacctcactggattgccgcttccatcattctggagtttttccttatcgtgctgctcattcccgaacccgagaaacagagaacgcctcaggacaaccagctgacatacgtcgtgatcgccatcctgaccgttgtggcggccaccatggctaatgaaatggggtttctcgagaagaccaagaaggaccttggactgggcagcattaccacacaagagtccgaatctaacatcctggatattgacctccggccggccagcgcttggacgctgtatgccgtggcgaccacattcgtcacccccatgcttcgccattccatcgaaaattctagcgttaacgtgtccctgacagccattgctaatcaggccaccgtgctcatggggctgggaagaggctggcctctgagcaaaatggatatcggggtccccctccttgctattggatgttactctcaggtgaaccctatcacgctgaccgccgctctgctcctgcttgttgcccactacgcgatcattggccccggcctgcaggccaaggctacacgggaagcccaaaagcgcgctgccgccgggatcatgaaaaatcctaccgtggacggaattacagtcatcgatctcgagccgattccctatgaccctaagtttgaaaaacagctgggccaggtgatgctgctcgtcctttgcgtgacccaggttctgatgatgagaacgacatgggcgctgtgtgaggctctcaccctggccacagggcccatctccaccctttgggagggaaaccctggccggttctggaataccacaatcgctgtgagcatggccaacatttttcgcgggtcttacctggccggagctggcctcctgttctccatcatgaagaatacgaccaacacaagacggggcaccgggaatattggagaaacactgggcgagaaatggaaaagcagactcaacgcccttgggaagtctgaatttcaaatctataaaaagagcggcattcaggaggtcgatcgcaccctggcgaaagagggcatcaagagaggggaaacggaccatcacgccgtgtccagaggatctgctaaactgcgctggttcgttgagcggaacatggtgacacccgaaggcaaggtcgtggatctcggctgcgggagaggaggctggagctactattgtgggggactgaaaaatgtgcgcgaggttaagggccttaccaaagggggaccgggccatgaggagcctatccccatgtccacctacggctggaacctggtccggctccagagcggggtggacgtgttctttacaccccctgagaaatgcgataccctgctgtgtgacattggagaatcctctcccaatcctacaatcgaggccggcagaacgctccgcgtccttaacctggttgaaaattggctgaacaataacacccaattctgcattaaggtgctcaatccgtatatgcccagcgtgatcgagaaaatggaaacactgcagcggaagtacgggggagctcttgtcagaaaccctctgtcccgcaattctacccacgagatgtactgggtgagcaacgccacaggcaatattgtttcctctgtgaacatgatcagccggatgctcatcaatagatttaccatgaaacacaagaaggcgacgtatgagcccgatgtcgacctggggtccggaacccgcaacattggcatcgaaaacgagattcctaatctggacatcattggcaaaagaatcgaaaagattaaacaggagcatgaaacaagctggcactacgatcaggaccatccctataagacctgggcctaccacgggtcttatgagacaaaacaaaccggatccgctagctctatggtgaacggcgttgtgcggctccttacaaagccgtgggatgtcgtgcctatggtgacccagatggccatgacggacacaacccccttcgggcagcagcgcgtctttaaggagaaagttgataccagaacacaagaacctaaggagggaacgaaaaagctgatgcggatcaccgctgaatggctgtggaaagagctcggcaagaagaaaacacccagaatgtgtacccgggaggagttcacacgcaaggtgagatccaatgccgctctgggggccatctttaccgacgagaacaaatggaaaagcgcgcgggaagccgtggaggattctcgcttctgggaacttgtcgacagagagcggaatctgcacctcgagggaaaatgcgaaacatgtgtgtacaacatgatgggcaagcgcgagaaaaagctgggcgaatttgggaaggctaaaggatccagagccatttggtatatgtggctgggcgctcggttcctcgagtttgaagccctggggttccttaatgaggatcattggtttagccgcggaaactccctgagcggcgttgagggggaaggcctccacaagctgggatacatccttagagacgtgtctaaaaaggagggcggggccatgtacgcggatgacaccgctggatgggacacgcggattaccctggaagatctcaaaaatgaggaaatggtcacaaaccatatgaagggcgagcacaagaaactggccgaggccatcttcaagctgacctatcagaataaagtggttcgcgtgcagagacctacaccccgggggaccgtcatggacattatcagccgcaaggatcagagaggatccggccaagtggggacgtacggcctcaacacattcaccaatatggaagctcagctgatccggcagatggagggagaaggcatttttaaatctatccaaagacttacagttaccgaggagattgccgtgcagaactggctggctcgcgtcgggcgggaaagactcagccgcatggccatctccggagacgattgcgtggtcaagccgctggacgatcggttcgcgtctgcccttacggctctgaatgacatgggcaaggtgagaaaagatattcagcagtgggagcctagccgcgggtggaacgactggacccaagttcccttttgctcccatcacttccacgaactcgtgatgaaggatggacgggtcctggtggtgccctgtagaaaccaggacgagctgatcggccgcgcccggatctctcagggggctggctggagcctcaaagaaacagcctgcctgggaaagtcctatgcgcagatgtggacccttatgtactttcatagacgcgatctgcggctcgccgctaatgccatttgtagcgctgttccttctcactgggtgccgacatccagaaccacatggagcatccatgccaaacacgagtggatgaccacggaggacatgctggctgtctggaaccgggtgtggattcaagaaaatccctggatggaggacaagacacctgttgaatcttgggaggaagtgccctatcttggcaagagagaggatcagtggtgcgggtccctgatcggactcaccagccgcgccacctgggcgaaaaacattcagacagccatcaatcaggtccggtccctgattggcaacgaggaatacaccgactatatgccttctatgaagagattccgcaaagaggaagaggaagctggggtgctgtggtga

SEQ ID NO: 19992 - RNA, 9876 nt, synthetic construct
  misc_feature 1..9876: note = derived and/or modified CDS sequence (opt5) from DENV-2__EU482734__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattatgatcacaccccacagcggggaggagcatgcggtgggaaatgacaccggcaagcacggcaaagaaatcaagattacacctcagtcttccatcaccgaggccgaactgacggggtatggaaccgtgacaatggagtgtagcccccggaccggccttgatttcaacgaaatggtcctgctccaaatggaggacaaggcttggctggtgcaccgccagtggtttcttgatctgccgctcccttggctgcccggggccgacacacagggatctaattggattcagaaggagaccctggttacgttcaagaaccctcatgctaaaaagcaagacgtggtcgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgttaaagaaatcgcggagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcgtggggaaggctctccaccaggttttcggcgccatttacggagcggctttttccggcgtgtcttggacaatgaaaatcctgattggggtcatcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacaggcgacattaaagggatcatgcaggccggaaagcggtctcttagacctcaacccaccgaactcaaatatagctggaagacgtggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacaaacatctggctgaaacttcgggagaaacaggacgtgttttgtgattccaagctgatgagcgccgctatcaaagacaatagagccgtccacgcggatatgggctattggattgaatctgccctcaacgacacctggaagatggagaaggcttccttcatcgaggtgaaaagctgccactggcctaagtctcatacgctgtggagcaatggggttctggaatccgagatgattatccccaaaaacttcgccggaccggtgagccagcacaactaccgccctggctatcatacacaaaccgctgggccctggcaccttggaaagctcgaaatggattttgacttctgtgagggcaccacagtcgtggtgaccgaagattgcgggaatcggggaccctctctgagaacgacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacagccggccatgggcagattgataacttttctctgggagtgctgggcatggctcttttcctcgaagagatgctgagaacccgcgtggggacgaaacacgcgatcctgctcgtcgccgtgagctttgttaccctgatcacaggaaatatgtccttccgggaccttggcagagtgatggtcatggtgggcgctaccatgacagatgacattgggatgggagttacctatctggccctcctggccgcttttaaggtgcgccctacgttcgccgcgggcctgcttctgagaaaactcacatctaaggagctgatgatggctaccatcgggattgccctcctgagccagtccacaatccccgaaaccattcttgagctgaccgatgccctcgctctgggaatgatggccctgaaaatcgtcaagaacatggaaaagtaccaacttgcggtgacaatcatggctatttcttgcgttcctaatgccgtgatcctgcagaacgcctggaaagtcagctgtacgattctcgctgccgtgtccgtgagccccctgctcctgacctcttcccagcagaaggctgactggatccctcttgccctgacaattaaaggcctcaatcccaccgcgatctttctgacaaccctgagccggacgtctaagaaacgctcctggccgcttaacgaggccatcatggctgtcgggatggttagcattctggcctcttccctcctgaagaatgacatccctatgacaggacccctcgtggctggcggcctgcttaccgtgtgctatgtcctgaccgggagaagcgccgatctggaactcgagcgggccgctgacgtgaaatgggaggatcaagcggaaatttccggaagctctcctatcctgagcattacaatctccgaggacggctctatgagcattcgcaacgaagaggaggaacagacccttacaatcctgatcagaacggggctcctggttatttccggagtgttccccgtctctatcccggtgaccgccgctgcctggtacctctgggaggttaagaagcagcgggccggcgtgctgtgggatgtcccttctccccctcccgtggggaaagctgaacttgaggacggagcctatcgcattaagcagagaggcatcctgggctactcccaaattggggcgggagtctataaagaaggcacatttcacaccatgtggcatgtgacaagaggggctgttctgatgcaccgcggaaagagaatcgagccctcctgggccgatgtgaaaaaggacctcgtcagctacggcgggggatggaagctggagggcgaatggaaagagggcgaagaggtgcaggttcttgccctggaacctgggaagaatccgcgggctgtgcagaccaaacccggaatcttcaagacgaacaccggcacaattggggccgtctccctcgattttagccctggaacctctggctcccccatcgtggacagaaaagggaaggtggttggactgtacggcaatggcgtcgtgacacgcagcggggcgtatgtgtctgctattgcccagaccgagaagtccatcgaggataaccctgaaattgaggacgatatcttccggaaaaagagactcacaatcatggacctgcatcccggagccggcaaaacgaagcgctaccttcctgctattgtccgggaagccatcaaaagagggctgcgcaccctgattctcgctccgacacgggtggttgccgcggagatggaagaggccctgagaggacttcccatccgctatcaaacccctgctattcgggccgagcacaccggcagagaaatcgtggacctgatgtgtcatgctacattcacgatgcggctcctgagccccgtccgcgtgcctaactacaatctcattatcatggatgaggcccactttaccgaccccgcctccatcgctgcgagagggtatatttctacacgggttgaaatgggcgaggccgctggaatcttcatgaccgccacaccgcctggcagccgcgatccctttccccagtccaacgcccctattatggacgaggaaagagagatccccgaacggagctggaactctgggcacgagtgggtgaccgatttcaagggaaagacggtctggtttgtgccttccattaaagctggcaacgacatcgccgcgtgcctgagaaagaatgggaaaaaggttatccagcttagccgcaaaacattcgattctgaatacgtgaagacccgggctaacgactgggattttgtcgtgaccacagacattagcgagatgggagccaatttcaaggccgagagagtgatcgatccgcgccggtgtatgaaacccgtcattctgaccgacggcgaagagagagttatcctggctgggcctatgcccgtgacacattcctctgccgcgcaacgccggggcagaattggacgcaaccctaagaatgaaaacgaccagtatatctacatgggcgagcccctcgaaaatgatgaggactgcgcccactggaaagaggctaagatgctgcttgataacatcaataccccggaagggattatccctagcatgtttgagcccgaaagagagaaagtggacgccattgatggagaataccggctgcgcggcgaggctagaaagacgttcgtcgacctcatgcggcgcggggatctgcctgtgtggctggcctataaagttgctgccgagggaatcaactacgcggacagacggtggtgttttgatggcattaagaataaccagatcctcgaagagaacgtggaagtcgagatttggacaaaggagggggaacgcaagaaacttaaaccccgctggctggacgcccggatctattccgatcctctggctctcaaggagttcaaagagttcgccgctggcagaaagtctctgacccttaatctgatcacagagatgggacgcctccccacctttatgacgcagaaggcccggaacgccctggacaatctggctgtgctccataccgcggaagccggcgggaaggcttacaaccacgcccttagcgagctgccggagacactggaaaccctcctgcttctgacactcctggccaccgttacaggaggcattttcctgtttctcatgtccgggaagggaatcggcaaaatgacccttggcatgtgctgcattatcacggctagcattctgctgtggtatgcccaaatccagcctcactggatcgcggcctctattatcctcgagttctttctgattgtgcttctgatccccgaacccgagaagcagagaacacctcaggataatcaactcacctacgtcgtgattgctatcctgaccgtcgtggccgctacaatggccaacgaaatggggttcctggagaaaaccaagaaggacctcggacttggctccatcacaacgcaggagagcgaatccaatattctggacatcgatctgcggccggcgtctgcctggaccctctatgctgttgccacaacctttgtgacacccatgctgcgccatagcattgagaactcctctgtgaatgtcagccttaccgctatcgccaaccaggctacggttctgatggggctcggaaaaggctggcctctgtccaagatggacattggggtgcccctgctcgccatcggatgttacagccaggtgaatcctattacccttacagcggccctgctgctcctggtcgctcactacgccatcatcggccccggccttcaagctaaagccaccagagaagcccagaagcgggcggctgccgggattatgaaaaaccctacagtggatggaatcaccgttattgacctggagccgatcccctatgatcctaagttcgaaaagcagctcggccaggtgatgctgctgattctctgcgtcacgcaagtgcttatgatgcgcacaacctgggctctgtgtgaggccctgacactcgccaccgggcccatctctaccctgtgggagggaaatcctggcagattttggaacacaacgatcgctgtctccatggccaatattttccgggggagctaccttgcgggagccggcctgctcttttctatcatgaaaaacaccacaaatacccgcagaggcacagggaacattggagaaaccctgggcgagaagtggaaatcccggctgaacgctctcggaaagagcgagttccagatctataaaaagtctggcattcaggaggtggaccgcacgcttgccaaagagggcatcaagagaggggaaacagatcatcacgctgttagccggggatccgccaagctgagatggtttgtggagcgcaatatggtcacccccgaaggcaaagtggttgacctgggctgcgggcggggaggctggtcttactattgtgggggactcaagaacgtgagagaggtcaaaggcctgaccaaagggggaccgggccatgaagaacctatcacaatgagcacctacggctggaatcttgtgcgcctgcaatccggggtggatgttttcttcacacctcccgagaaatgcgacacgctcctgtgtgatattggagaaagctcccccaaccccaccatcgaggcgggccggacactgagagtcctcaatcttgtggaaaactggctgaataacaatacccagttttgcattaaggtgctgaacccttatatgccgtctgtcatcgagaagatggaaacactccagcgcaaatacgggggagccctggttcggaatccccttagcagaaactccacccacgagatgtactgggtgtctaatgctacgggcaacattgtgagctccgtcaatatgatctctcgcatgctgatcaaccggttcaccatgaagcacaaaaaggccacatatgagcctgacgtggatctcgggagcggaaccagaaacattggcatcgaatccgagattcccaatctggacatcattggcaaacgcatcgaaaagattaagcaggagcatgaaacaagctggcactacgaccaagatcatccttataaaacctgggcttaccacgggtcttatgagacaaagcagaccggatccgccagctctatggttaacggcgtggtccggctgctcacgaaaccctgggacgtggttccgatggtgacacagatggctatgaccgataccacaccttttgggcagcaaagagtcttcaaggagaaagtggacacgcgcacccaggaacccaaggagggaacaaagaaacttatgaagatcaccgccgaatggctgtggaaagagctgggcaagaaaaagacacctagaatgtgtacccgggaggaatttacacgcaaagtgagatccaatgcggccctcggggctatcttcaccgatgagaacaagtggaaaagcgcccgggaagctgtcgaggacggaagattttgggaactggttgatcgggagcgcaatcttcacctggagggcaaatgcgaaacgtgtgtgtacaacatgatgggcaagagagagaaaaagctcggggagttcggaaaagccaagggctctcgggccatttggtatatgtggctgggggcgcgctttctggagttcgaagctctcggatttctgaatgaggaccattggttctccagaggcaacagcctttccggggtggagggcgaaggactgcaccggctcggctacatcctgcgcgatgtcagcaagaaagaagggggagccatgtacgccgacgataccgctggctgggacacaagaattacccttgaagacctgaagaatgaggaaatggtgacaaaccatatgaaaggggagcacaagaaactcgccgaggctatctttaagctgacctatcagaataaggttgtgcgggtccagcgccccacgcctagaggaacagtgatggatattatctctcggcgcgaccaaagaggcagcgggcaggttggcacctacggactgaacacattcaccaatatggaagcccagctcatccggcaaatggagggcgaagggattttcaaatccatccagcatctgacggtgaccgaggagattgcggtccagaactggcttgcccgcgtgggaagagaacggctgtctagaatggctatcagcggcgatgactgcgttgtgaagcccattgatgaccgctttgcctccgctctcacagccctgaatgatatggggaaagtccggaaggacatccagcaatgggagccgtctagaggatggaacgattggacccaggtgcctttctgcagccaccactttcatgaacttgtcatgaaagacggccgcgtgctggttgtgccctgtcggaaccaggatgagctcatcgggagagcgcgcatttcccagggcgccggatggtctctgaaggaaacagcttgcctgggcaagagctatgcccaaatgtggaccctcatgtacttccaccggagagacctgcgccttgctgccaatgctatctgttccgccgtccccagccattgggtgcctacatctcggaccacgtggtccattcacgcgaaacacgagtggatgacaaccgaggatatgctggccgtgtggaacagagtttggatccaggaaaatccgtggatggaggacaagacccccgtggaaagctgggaggaagtcccttatctcgggaaacgcgaggaccagtggtgcggatctctgattggccttacatcccgggctacctgggccaagaacatccagacagccattaatcaagtgagaagcctgatcgggaacgaggaatacacggattatatgccctccatgaaacggtttagacgcgaggaagaggaagctggagttctctggtga

SEQ ID NO: 19993 - RNA, 9876 nt, synthetic construct
  misc_feature 1..9876: note = derived and/or modified CDS sequence (opt5) from DENV-2__EU482735__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattatgatcacaccccacagcggggaggagcatgcggtgggaaatgacaccggcaagcacggcaaagaaatcaagattacacctcagtcttccatcaccgaggccgaactgacggggtatggaaccgtgacaatggagtgtagcccccggaccggccttgatttcaacgaaatggtcctgctccaaatggaggacaaggcttggctggtgcaccgccagtggtttcttgatctgccgctcccttggctgcccggggccgacacacagggatctaattggattcagaaggagaccctggttacgttcaagaaccctcatgctaaaaagcaagacgtggtcgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgttaaagaaatcgcggagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcgtggggaaggctctccaccaggttttcggcgccatttacggagcggctttttccggcgtgtcttggacaatgaaaatcctgattggggtcatcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacaggcgacattaaagggatcatgcaggccggaaagcggtctcttagacctcaacccaccgaactcaaatatagctggaagacgtggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacaaacatctggctgaaacttcgggagaaacaggacgtgttttgtgattccaagctgatgagcgccgctatcaaagacaatagagccgtccacgcggatatgggctattggattgaatctgccctcaacgacacctggaagatggagaaggcttccttcatcgaggtgaaaagctgccactggcctaagtctcatacgctgtggagcaatggggttctggaatccgagatgattatccccaaaaacttcgccggaccggtgagccagcacaactaccgccctggctatcatacacaaaccgctgggccctggcaccttggaaagctcgaaatggattttgacttctgtgagggcaccacagtcgtggtgaccgaagattgcgggaatcggggaccctctctgagaacgacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacagccggccatgggcagattgataacttttctctgggagtgctgggcatggctcttttcctcgaagagatgctgagaacccgcgtggggacgaaacacgcgatcctgctcgtcgccgtgagctttgttaccctgatcacaggaaatatgtccttccgggaccttggcagagtgatggtcatggtgggcgctaccatgacagatgacattgggatgggagttacctatctggccctcctggccgcttttaaggtgcgccctacgttcgccgcgggcctgcttctgagaaaactcacatctaaggagctgatgatggctaccatcgggattgccctcctgagccagtccacaatccccgaaaccattcttgagctgaccgatgccctcgctctgggaatgatggccctgaaaatcgtcaagaacatggaaaagtaccaacttgcggtgacaatcatggctatttcttgcgttcctaatgccgtgatcctgcagaacgcctggaaagtcagctgtacgattctcgctgccgtgtccgtgagccccctgctcctgacctcttcccagcagaaggctgactggatccctcttgccctgacaattaaaggcctcaatcccaccgcgatctttctgacaaccctgagccggacgtctaagaaacgctcctggccgcttaacgaggccatcatggctgtcgggatggttagcattctggcctcttccctcctgaagaatgacatccctatgacaggacccctcgtggctggcggcctgcttaccgtgtgctatgtcctgaccgggagaagcgccgatctggaactcgagcgggccgctgacgtgaaatgggaggatcaagcggaaatttccggaagctctcctatcctgagcattacaatctccgaggacggctctatgagcattcgcaacgaagaggaggaacagacccttacaatcctgatcagaacggggctcctggttatttccggagtgttccccgtctctatcccggtgaccgccgctgcctggtacctctgggaggttaagaagcagcgggccggcgtgctgtgggatgtcccttctccccctcccgtggggaaagctgaacttgaggacggagcctatcgcattaagcagagaggcatcctgggctactcccaaattggggcgggagtctataaagaaggcacatttcacaccatgtggcatgtgacaagaggggctgttctgatgcaccgcggaaagagaatcgagccctcctgggccgatgtgaaaaaggacctcgtcagctacggcgggggatggaagctggagggcgaatggaaagagggcgaagaggtgcaggttcttgccctggaacctgggaagaatccgcgggctgtgcagaccaaacccggaatcttcaagacgaacaccggcacaattggggccgtctccctcgattttagccctggaacctctggctcccccatcgtggacagaaaagggaaggtggttggactgtacggcaatggcgtcgtgacacgcagcggggcgtatgtgtctgctattgcccagaccgagaagtccatcgaggataaccctgaaattgaggacgatatcttccggaaaaagagactcacaatcatggacctgcatcccggagccggcaaaacgaagcgctaccttcctgctattgtccgggaagccatcaaaagagggctgcgcaccctgattctcgctccgacacgggtggttgccgcggagatggaagaggccctgagaggacttcccatccgctatcaaacccctgctattcgggccgagcacaccggcagagaaatcgtggacctgatgtgtcatgctacattcacgatgcggctcctgagccccgtccgcgtgcctaactacaatctcattatcatggatgaggcccactttaccgaccccgcctccatcgctgcgagagggtatatttctacacgggttgaaatgggcgaggccgctggaatcttcatgaccgccacaccgcctggcagccgcgatccctttccccagtccaacgcccctattatggacgaggaaagagagatccccgaacggagctggaactctgggcacgagtgggtgaccgatttcaagggaaagacggtctggtttgtgccttccattaaagctggcaacgacatcgccgcgtgcctgagaaagaatgggaaaaaggttatccagcttagccgcaaaacattcgattctgaatacgtgaagacccgggctaacgactgggattttgtcgtgaccacagacattagcgagatgggagccaatttcaaggccgagagagtgatcgatccgcgccggtgtatgaaacccgtcattctgaccgacggcgaagagagagttatcctggctgggcctatgcccgtgacacattcctctgccgcgcaacgccggggcagaattggacgcaaccctaagaatgaaaacgaccagtatatctacatgggcgagcccctcgaaaatgatgaggactgcgcccactggaaagaggctaagatgctgcttgataacatcaataccccggaagggattatccctagcatgtttgagcccgaaagagagaaagtggacgccattgatggagaataccggctgcgcggcgaggctagaaagacgttcgtcgacctcatgcggcgcggggatctgcctgtgtggctggcctataaagttgctgccgagggaatcaactacgcggacagacggtggtgttttgatggcattaagaataaccagatcctcgaagagaacgtggaagtcgagatttggacaaaggagggggaacgcaagaaacttaaaccccgctggctggacgcccggatctattccgatcctctggctctcaaggagttcaaagagttcgccgctggcagaaagtctctgacccttaatctgatcacagagatgggacgcctccccacctttatgacgcagaaggcccggaacgccctggacaatctggctgtgctccataccgcggaagccggcgggaaggcttacaaccacgcccttagcgagctgccggagacactggaaaccctcctgcttctgacactcctggccaccgttacaggaggcattttcctgtttctcatgtccgggaagggaatcggcaaaatgacccttggcatgtgctgcattatcacggctagcattctgctgtggtatgcccaaatccagcctcactggatcgcggcctctattatcctcgagttctttctgattgtgcttctgatccccgaacccgagaagcagagaacacctcaggataatcaactcacctacgtcgtgattgctatcctgaccgtcgtggccgctacaatggccaacgaaatggggttcctggagaaaaccaagaaggacctcggacttggctccatcacaacgcaggagagcgaatccaatattctggacatcgatctgcggccggcgtctgcctggaccctctatgctgttgccacaacctttgtgacacccatgctgcgccatagcattgagaactcctctgtgaatgtcagccttaccgctatcgccaaccaggctacggttctgatggggctcggaaaaggctggcctctgtccaagatggacattggggtgcccctgctcgccatcggatgttacagccaggtgaatcctattacccttacagcggccctgctgctcctggtcgctcactacgccatcatcggccccggccttcaagctaaagccaccagagaagcccagaagcgggcggctgccgggattatgaaaaaccctacagtggatggaatcaccgttattgacctggagccgatcccctatgatcctaagttcgaaaagcagctcggccaggtgatgctgctgattctctgcgtcacgcaagtgcttacaatgcgcaccacatgggctctgtgtgaggccctgaccctcgccaccgggcccatctctacactgtgggagggaaatcctggcagattttggaacacgaccatcgctgtctccatggccaatattttccgggggagctaccttgcgggagccggcctgctcttttctatcatgaaaaacacaaccaatacacgcagaggcaccgggaacattggagaaacgctgggcgagaagtggaaatcccggctgaacgctctcggaaagagcgagttccagatctataaaaagtctggcattcaggaggtggaccgcacacttgccaaagagggcatcaagagaggggaaaccgatcatcacgctgttagccggggatccgccaagctgagatggtttgtggagcgcaatatggtcacccccgaaggcaaagtggttgacctgggctgcgggcggggaggctggtcttactattgtgggggactcaagaacgtgagagaggtcaaaggcctgacaaaagggggaccgggccatgaagaacctatccccatgagcacctacggctggaatcttgtgcgcctgcaatccggggtggatgttttcttcacaccccctgagaaatgcgacacgctcctgtgtgatattggagaaagctcccccaaccctaccatcgaggcgggccggacactgagagtcctcaatcttgtggaaaactggctgaataacaatacccagttttgcattaaggtgctgaacccgtatatgccctctgtcatcgagaagatggaaacactccagcgcaaatacgggggagccctggttcggaatcctcttagcagaaactccacccacgagatgtactgggtgtctaatgctacgggcaacattgtgagctccgtcaatatgatctctcgcatgctgatcaaccggttcaccatgaagcacaaaaaggccacatatgagcccgacgtggatctcgggagcggaaccagaaacattggcatcgaatccgagattcctaatctggacatcattggcaaacgcatcgaaaagattaagcaggagcatgaaacaagctggcactacgaccaagatcatccctataaaacctgggcttaccacgggtcttatgagacaaagcagaccggatccgccagctctatggttaacggcgtggtccggctgctcacgaaaccgtgggacgtggttcctatggtgacacagatggctatgaccgataccacaccctttgggcagcaaagagtcttcaaggagaaagtggacacgcgcacccaggaacctaaggagggaacaaagaaacttatgaagatcaccgccgaatggctgtggaaagagctgggcaagaaaaagacacccagaatgtgtacccgggaggaatttacacgcaaagtgagatccaatgcggccctcggggctatcttcaccgatgagaacaagtggaaaagcgcccgggaagctgtcgaggacggaagattttgggaactggttgatcgggagcgcaatcttcacctggagggcaaatgcgaaacgtgtgtgtacaacatgatgggcaagagagagaaaaagctcggggagttcggaaaagccaagggctctcgggccatttggtatatgtggctgggggcgcgctttctggagttcgaagctctcggatttctgaatgaggaccattggttctccagaggcaacagcctttccggggtggagggcgaaggactgcaccggctcggctacatcctgcgcgatgtcagcaagaaagaagggggagccatgtacgccgacgataccgctggctgggacacaagaattacccttgaagacctgaagaatgaggaaatggtgacaaaccatatgaaaggggagcacaagaaactcgccgaggctatctttaagctgacctatcagaataaggttgtgcgggtccagcgccctacgcccagaggaacagtgatggatattatctctcggcgcgaccaaagaggcagcgggcaggttggcacctacggactgaacacattcaccaatatggaagcccagctcatccggcaaatggagggcgaagggattttcaaatccatccagcatctgacggtgaccgaggagattgcggtccagaactggcttgcccgcgtgggaagagaacggctgtctagaatggctatcagcggcgatgactgcgttgtgaagccgattgatgaccgctttgcctccgctctcacagccctgaatgatatggggaaagtccggaaggacatccagcaatgggagccttctagaggatggaacgattggacccaggtgcccttctgcagccaccactttcatgaacttgtcatgaaagacggccgcgtgctggttgtgccctgtcggaaccaggatgagctcatcgggagagcgcgcatttcccagggcgccggatggtctctgaaggaaacagcttgcctgggcaagagctatgcccaaatgtggaccctcatgtacttccaccggagagacctgcgccttgctgccaatgctatctgttccgccgtccctagccattgggtgccgacatctcggaccacgtggtccattcacgcgaaacacgagtggatgacaaccgaggatatgctggccgtgtggaacagagtttggatccaggaaaatccctggatggaggacaagacccctgtggaaagctgggaggaagtcccctatctcgggaaacgcgaggaccagtggtgcggatctctgattggccttacatcccgggctacctgggccaagaacatccagacagccattaatcaagtgagaagcctgatcgggaacgaggaatacacggattatatgccttccatgaaacggtttagacgcgaggaagaggaagctggagttctctggtga

SEQ ID NO: 19994 - RNA, 9876 nt, synthetic construct
  misc_feature 1..9876: note = derived and/or modified CDS sequence (opt5) from DENV-2__EU482736__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagagcaggacaaacgctttgtgtgcaagcattccatggtggatagaggctggggcaacgggtgtggactgttcggcaaggggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaagcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaagcttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggcgctcttcctggaagagatgctgagaacacgcgtcgggaccaaacacgccatgctcctggtggttgtgtcctttgtcacgcttatcaccggaaacatgtctttccgggacctgggcagagtgatggttatggtgggcgctacaatgaccgatgacatcgggatgggaattacatatctcgccctgctggccgcttttaaggtccgccctaccttcgccgcgggccttctgctcagaaaactgacgagcaaggagctcatgatggctacaatcgggattgccctgctttcccagtctaccatccccgaaacaattctggagctcaccgatgccctggctctgagcatgatggtgcttaaaatcgttcggaatatggaaaagtaccagctggccgtgaccatcatggcgatttcctgcgtccctaacgctgtgatcctccaaaatgcctggaaggtgagctgtacaattctggccgctgtctctgtttcccccctcctgcttacgagctctcagcagaaagccgactggatccctctggctctcaccattaagggactgaaccccacagccatctttctgaccacactttcccgcaccagcaaaaagagatcttggccgctgaatgaggcgatcatggccgtgggcatggtgtccattctcgctagctccctgctcaaaaacgacatccctatgacggggcccctggtcgccggaggccttctgacagtgtgctatgttctgaccggccggagcgctgatctcgaactggagcgcgccgccgacgtgaagtgggaggatcaggctgaaatttctgggagctcccctatcctttctattaccatcagcgaggacggatccatgtctattaaaaatgaagaggaggaacaaacactgaccatcctcatcagaacaggcctgctcgtcattagcggggtgttccccgtttccatcccgattacggcggccgcttggtacctgtgggaggtgaagaagcagcgggccggagtcctttgggatgtgccttctccccctcccgtcggcaaagccgaactggaggacggggcttatcgcatcaagcagagaggaattctgggctacagccagatcggcgccggggtgtataaagaaggaacctttcacacaatgtggcatgttacccggggcgcggtgctcatgcaccgcgggaagagaatcgagccctcctgggctgatgtcaaaaaggacctgattagctacggaggcgggtggaagcttgagggagaatggaaagagggcgaagaggtgcaagttctggccctcgaacctggcaagaacccgcgggccgtgcagacaaaacccgggctgttcaagaccaatacgggaaccatcggcgctgtctctctcgatttttcccctgggacaagcggatctcccattgtggacagaaaaggcaaggtggttgggctgtacggaaacggcgtcgtgacccgctccggcgcctatgtgagcgcgatcgctcagacagagaagtccattgaggataatcctgaaatcgaggacgatatcttccggaaaaagagacttaccattatggacctgcatcccggggccggaaaaacaaagcgctacctgcctgccatcgtccgggaagctattaaaagaggcctccgcacgctgatccttgccccgacccgggtggttgctgccgagatggaagaggcgctgagagggctccccattcgctatcagacacctgccatccgggctgagcacaccggaagagaaattgtggacctgatgtgtcatgccaccttcacaatgcggctcctgtctcccgtccgcgtgcctaactacaaccttatcatcatggatgaggctcactttacggaccccgccagcattgccgctagaggctatatctccacccgggttgaaatgggggaggcggccggcattttcatgacagctaccccgcctggaagccgcgatccctttccccaatctaatgcccctatcatggacgaggaaagagagattcccgaacggtcctggaacagcggccacgagtgggtgacagatttcaaggggaagaccgtctggtttgtgccttctatcaaagccggaaatgacatcgctgcctgcctgagaaagaacggcaaaaaggttattcagctgagccgcaaaacgttcgattccgaatacgtgaagacacgggcgaatgactgggattttgtcgtgaccaccgacatctctgagatgggggctaacttcaaggccgagagagtgattgatccgcgccggtgtatgaaacccgtcatcctcacagacggagaagagagagttattctggccggccctatgcccgtgacccatagctccgctgcccagcgccgggggagaatcggccgcaatcctaagaacgaaaatgaccaatatatctacatgggagagccccttgaaaacgatgaggactgcgcgcactggaaagaggccaagatgctgctcgataatattaacacaccggaaggcatcattccttctatgtttgagcccgaaagagagaaagtggacgctatcgatggggaataccggctgcgcggagaggccagaaagaccttcgtcgacctgatgcggcgcggcgatctccctgtgtggcttgcttatagagttgccgctgaggggattaattacgccgaccggagatggtgttttgatggaatcaaaaacaatcagattctggaagagaacgtggaagtcgagatctggacgaaggagggcgaacgcaagaaactgaagccccggtggctcgacgcgagaatctatagcgatcctctggcccttaaagagttcaaggaattcgctgccgggcgcaaatccctgacactcaacctgattaccgagatgggccggctgcccacatttatgacccagaaggctagagacgccctcgataatcttgccgtgctgcatacggctgaagcgggaggccgggcctacaaccacgctctgagcgagctcccggagaccctggaaacacttctgctcctgaccctgctcgccacagttaccgggggaatcttcctttttctgatgtctggcaaggggattggaaaaatgacactgggcatgtgctgcatcattaccgcctccatcctcctgtggtatgctcagatccaacctcactggattgccgcgagcatcattcttgagttctttctgatcgtgctcctgattcccgaacccgagaagcagcgcacgcctcaggacaatcagctgacatacgtcgtgatcgccatcctcaccgtcgtggctgccaccatggctaacgaaatgggcttccttgagaaaacaaagaaagacctggggctgggatccattgccacccaagagtctgaaagcaatatcctcgatattgacctgagaccggcgtccgcctggacactttatgctgttgccacgacctttgtgacacccatgctgcggcattctatcgagaacagctccgtgaatgtcagcctcaccgctattgccaaccaggctacagttctgatgggcctggggaagggatggcctctctctaagatggatatcggcgtgccccttctggccattgggtgttactcccaggtgaatcctatcaccctgacggcggccctcctgcttctggtcgctcactacgccatcattggacccggcctccaggctaaagccacccgcgaagcccaaaagagagcggctgccggcatcatgaaaaaccctacagtggacgggattaccgttatcgatctggagccgattccctatgaccctaagttcgaaaaacagctgggacaggtgatgctccttatcctgtgcgtcacacaggtgctgatgatgcggaccacgtgggctctctgtgaggccctgacacttgccaccggccccatcagcacactgtgggaggggaatcctggacgcttttggaacaccaccattgctgtctctatggccaatatcttcagaggctcctacctcgcgggggccggactgctgtttagcattatgaagaacacaacgaatacccggcgcggcacaggcaacatcggggaaaccctcggagagaagtggaaatctagacttaatgctctgggcaagagcgaattccaaatttataaaaagtccgggatccaggaggtggatcggacactggccaaagagggaatcaagagaggcgaaaccgaccatcacgctgtttctcgcgggagcgccaaactccggtggtttgtggagagaaacatggtcacgcccgaaggaaaggtggttgatctgggctgcggccgcgggggatggtcctactattgtggcgggcttaagaacgtgcgggaggtcaaaggactgacaaagggcgggccgggacatgaagagcctattcccatgagcacctacggctggaatctcgtgagactgcagtccggcgtggacgttttcttcaccccccctgagaaatgcgatacactgctctgtgacatcggggaatctagccccaaccctaccattgaggcgggacgcacacttcgggtcctgaatctggtggaaaactggctcaataacaatacgcaattttgcatcaaggtgctgaacccgtatatgccctccgtcattgagaaaatggaaacccttcagagaaagtacggcggggccctggttcgcaatcctctctctcggaacagcacacacgagatgtactgggtgtccaatgctaccggaaacatcgtgtctagcgtcaatatgatctccagaatgctgattaaccgcttcacaatgaagcacaaaaaggccacctatgagcccgatgtggacctgggcagcgggacgcggaatatcggaattgaatctgagatccctaacctcgacattatcggcaaaagaattgaaaagatcaaacaggagcatgaaacctcctggcactacgatcaggaccatccctataagacatgggcttaccacggcagctatgagaccaagcaaacagggtctgcctccagcatggttaacggagtggtccgccttctgaccaaaccgtgggatgtggttcctatggtgacacagatggctatgaccgacacgacaccctttggccagcagagagtcttcaaggagaaagtggatacccggacccaagaacctaaggaggggacaaaaaagctgatgaagatcacggccgaatggctctggaaagagctgggaaagaaaaagaccccccgcatgtgtacaagagaggaatttacccggaaagtgagatctaatgcggcccttggcgctattttcacagacgagaacaagtggaaatccgcccgggaagctgtcgaggatagccgcttttgggaactgatcgacagagagcggaatctccacctggaggggaagtgcgaaacctgtgtttacaacatgatgggaaagcgcgagaaaaagctgggcgaattcggcaaagccaaggggtccagagccatttggtatatgtggctcggagcgcggtttctggagttcgaagctcttggctttctgaatgaggatcattggttcagccgcgggaactctctcagcggagtggagggcgaagggctgcacagacttggctacatcctgcgggacgtgtccaaaaaggagggaggcgccatgtacgccgatgacacagctgggtgggacacccgcattacgctcgaagatctgaagaatgaggaaatggtcaccaaccatatgaaaggagagcacaagaaactggccgaggctatctttaagctcacatatcagaataaagtggttagagtgcagcggcctaccccccgcggcacagtcatggacatcatttctagacgggatcagcgcgggagcggacaagtgggcacctacgggctgaacacgttcacaaatatggaagcccagcttatcagacagatggagggcgaaggaattttcaagtccatccaacatctgaccgttacagaggagattgcggtgcagaactggctcgcccgggtcggcagagaacgcctgtctcggatggctatcagcggggacgattgcgtggttaagccgcttgacgatagatttgcctccgctctgaccgccctcaatgacatgggaaaagtgcgcaaggatatccagcagtgggagccttctcggggctggaacgactggacgcaagtccccttctgcagccaccactttcatgaactggtgatgaaagatgggagagtcctggtggttccctgtcgcaatcaggacgagctcattggacgggcgagaatctcccagggcgccgggtggagcctgaaggaaaccgcttgccttggcaaatcttatgcccagatgtggacactgatgtacttccaccgccgggatctcagactggctgccaacgctatttgttccgccgtgcctagccattgggtcccgacctctcgcacaacctggtccatccacgcgaagcacgagtggatgacaaccgaggacatgcttgccgtgtggaaccgggtgtggattcaagaaaatccctggatggaggacaagacgcctgttgaaagctgggaggaagtgccctatctgggaaaaagagaggatcagtggtgcggctccctcatcgggctgacatctcgggctacctgggccaagaacattcagaccgccatcaatcaggtcagaagcctgatcggaaacgaggaatacacagactatatgccttccatgaaacgctttcggagagaggaagaggaagctggcgtgctctggtga

SEQ ID NO: 19995 - RNA, 9876 nt, synthetic construct
  misc_feature 1..9876: note = derived and/or modified CDS sequence (opt5) from DENV-2__EU482737__SS-prME
  source 1..9876: mol_type = other RNA
accgccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagagcaggacaaacgctttgtgtgcaagcattccatggtcgatagaggctggggcaacgggtgtggactgttcggcaaggggggaatcgttacatgcgccatgtttacgtgcaaaaagaatatggaaggcaaagtggtgctccctgagaacctggaatacaccattgtcatcacaccccacagcggggaggagcatgcggtgggaaatgacaccggcaagcacggcaaagaaattaagatcacacctcagtcttccatcaccgaggccgaacttacggggtatggaaccgttacaatggagtgtagcccccggaccggcctggatttcaacgaaatggtgctcctgcagatggaggacaaagcttggcttgtccaccgccaatggtttctggatctcccgctgccttggctgcccggggccgacacacagggatctaattggattcagaaggagaccctcgtgacgttcaagaaccctcatgctaaaaagcaggacgttgtggtcctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgattgtcatcagagtgcagtatgagggggacggatccccctgcaagatccccttcgaaattatggatctggagaaacgccatgttctgggccggctcatcaccgtgaaccctattgtcgccgaaaaggacagcccggtgaacatcgaggctgaacccccttttggggattcttacattatcattggcgttgagcccggacagctgaaacttaattggttcaagaagggctccagcatcgggcagatgtttgagacaaccatgagaggagccaaacgcatggccatcctgggcgacacagcttgggatttcgggtctctcggaggcgtgtttaccagcattgggaaggccctgcaccaagtcttcggcgcgatctacggagctgccttttccggcgtgtcttggacgatgaaaattctgatcggggtgattatcacatggatcggaatgaacagccggtccaccagcctttctgtttccctcgtcctggtgggcgtggtcaccctgtatctcggggccatggtgcaggctgacagcggatgtgttgtgtcttggaagtccaaagaactgaagtgcggcagcgggattttcatcacagataatgtccacacctggacagagcagtacaagtttcagcctgaatccccctctaaacttgccagcgctattcaaaaggcccatgaggaaggcatctgtggaattagatccgtgacgcgcctggagaacctcatgtggaaacagatcaccccggagctgaatcacatcctgtctgaaaacgaggttaagcttacaattatgaccggcgacatcaaagggattatgcaggcgggaaagcggagcctcagacctcagcccacagaactgaaatattcctggaagacctggggcaaggccaaaatgctgagcacggagtctcataatcaaaccttcctcatcgatgggcctgaaacagctgagtgccccaacaccaatcgcgcctggaactccctggaggtggaagactacggatttggcgtcttcacaaccaatatttggcttaagctgcgggagaaacaggacgtgttttgtgatagcaagctcatgtctgctgccatcaaagacaacagagcggttcacgccgatatgggctattggatcgaatccgctctgaatgacacatggaagatggagaaggccagcttcattgaggtgaaatcttgccactggcctaagagccataccctgtggtccaacggggtccttgaaagcgagatgatcattcccaaaaatttcgctggaccggtgtctcagcacaactaccgccctggctatcatacgcagacagccgggccctggcacctcggaaagctggaaatggattttgacttctgtgagggcaccaccgtggtcgttacagaagattgcgggaaccggggaccctccctgagaaccacgacagccagcggcaaactcatcaccgagtggtgctgtcggtcctgcacactgcctccgcttcgctacagaggcgaggacgggtgttggtacggaatggaaattcggcccctgaaggagaaggaagagaatctcgtgaactctctggtgaccgctggccatgggcaaatcgataattttagcctgggagtccttggcatggcgctcttcctggaagagatgctgagaacacgcgtggggaccaaacacgccatgctcctggttgtggtctcctttgtgacgcttattaccggaaacatgtctttccgggacctgggcagagttatggtgatggtcggcgctacaatgaccgatgacatcgggatgggaatcacatatctcgccctgctggccgcttttaaggtgcgccctaccttcgccgcgggccttctgctcagaaaactgacgagcaaggagctcatgatggctacaattgggatcgccctgctttcccagtctaccattcccgaaacaatcctggagctcaccgatgccctggctctgagcatgatggttcttaaaattgtgcggaatatggaaaagtaccagctggccgtcaccatcatggcgatctcctgcgtgcctaacgctgtgattctccaaaatgcctggaaggtcagctgtacaatcctggccgctgtttctgtgtcccccctcctgcttacgagctctcagcagaaagccgactggattcctctggctctcaccatcaagggactgaaccccacagccatttttctgaccacactttcccgcaccagcaaaaagagatcttggccgctgaatgaggcgatcatggccgtgggcatggtctccatcctcgctagctccctgctcaaaaacgacattcctatgacggggcccctggtggccggaggccttctgacagtttgctatgtgctgaccggccggagcgctgatctcgaactggagcgcgccgccgacgtcaagtgggaggatcaggctgaaatctctgggagctcccctattctttctatcaccattagcgaggacggatccatgtctatcaaaaatgaagaggaggaacaaacactgaccattctcatcagaacaggcctgctcgtgatcagcggggttttccccgtgtccattccgatcacggcggccgcttggtacctgtgggaggtcaagaagcagcgggccggagtgctttgggatgtcccttctccccctcccgtgggcaaagccgaactggaggacggggcttatcgcattaagcagagaggaatcctgggctacagccagattggcgccggggtttataaagaaggaacctttcacacaatgtggcatgtgacccggggcgcggtcctcatgcaccgcgggaagagaatcgagccctcctgggctgatgtgaaaaaggacctgatcagctacggaggcgggtggaagcttgagggagaatggaaagagggcgaagaggttcaagtgctggccctcgaacctggcaagaacccgcgggccgtccagacaaaacccgggctgttcaagaccaatacgggaaccattggcgctgtgtctctcgatttttcccctgggacaagcggatctcccatcgtggacagaaaaggcaaggttgtcgggctgtacggaaacggcgtggtgacccgctccggcgcctatgtcagcgcgattgctcagacagagaagtccatcgaggataatcctgaaattgaggacgatatcttccggaaaaagagacttaccatcatggacctgcatcccggggccggaaaaacaaagcgctacctgcctgccattgtgcgggaagctatcaaaagaggcctccgcacgctgattcttgccccgacccgggttgtggctgccgagatggaagaggcgctgagagggctccccatccgctatcagacacctgccattcgggctgagcacaccggaagagaaatcgtcgacctgatgtgtcatgccaccttcacaatgcggctcctgtctcccgtgcgcgttcctaactacaaccttattatcatggatgaggctcactttacggaccccgccagcatcgccgctagaggctatatttccacccgggtggaaatgggggaggcggccggcatcttcatgacagctaccccgcctggaagccgcgatccctttccccaatctaatgcccctattatggacgaggaaagagagatccccgaacggtcctggaacagcggccacgagtgggtcacagatttcaaggggaagaccgtgtggtttgttccttctattaaagccggaaatgacatcgctgcctgcctgagaaagaacggcaaaaaggtgatccagctgagccgcaaaacgttcgattccgaatacgtcaagacacgggcgaatgactgggattttgtggtgaccaccgacatttctgagatgggggctaacttcaaggccgagagagtcatcgatccgcgccggtgtatgaaacccgttattctcacagacggagaagagagagtgatcctggccggccctatgcccgtgacccatagctccgctgcccagcgccgggggagaattggccgcaatcctaagaacgaaaatgaccaatatatctacatgggagagccccttgaaaacgatgaggactgcgcgcactggaaagaggccaagatgctgctcgataatatcaacacaccggaaggcattatcccttctatgtttgagcccgaaagagagaaagtcgacgctattgatggggaataccggctgcgcggagaggccagaaagaccttcgtggacctgatgcggcgcggcgatctccctgtttggcttgcttatagagtggccgctgaggggatcaattacgccgaccggagatggtgttttgatggaattaaaaacaatcagatcctggaagagaacgtcgaagtggagatttggacgaaggagggcgaacgcaagaaactgaagccccggtggctcgacgcgagaatctatagcgatcctctggcccttaaagagttcaaggaattcgctgccgggcgcaaatccctgacactcaacctgatcaccgagatgggccggctgcccacatttatgacccagaaggctagagacgccctcgataatcttgccgttctgcatacggctgaagcgggaggccgggcctacaaccacgctctgagcgagctcccggagaccctggaaacacttctgctcctgaccctgctcgccacagtgaccgggggaattttcctttttctgatgtctggcaaggggatcggaaaaatgacactgggcatgtgctgcattatcaccgcctccattctcctgtggtatgctcagatccaacctcactggatcgccgcgagcattatccttgagttctttctgattgtcctcctgatccccgaacccgagaagcagcgcacgcctcaggacaatcagctgacatacgtggtcattgccatcctcaccgtggttgctgccaccatggctaacgaaatgggcttccttgagaaaacaaagaaagacctggggctgggatccatcgccacccaagagtctgaaagcaatattctcgatatcgacctgagaccggcgtccgcctggacactttatgctgtggccacgacctttgtgacacccatgctgcggcattctattgagaacagctccgtcaatgttagcctcaccgctatcgccaaccaggctacagtgctgatgggcctggggaagggatggcctctctctaagatggatattggcgtgccccttctggccatcgggtgttactcccaggtcaatcctattaccctgacggcggccctcctgcttctggtggctcactacgccatcatcggacccggcctccaggctaaagccacccgcgaagcccaaaagagagcggctgccggcattatgaaaaaccctacagttgacgggatcaccgtgattgatctggagccgatcccctatgaccctaagttcgaaaaacagctgggacaggtcatgctccttattctgtgcgtgacacaggtcctgatgatgcggaccacgtgggctctctgtgaggccctgacacttgccaccggccccatcagcacactgtgggaggggaatcctggacgcttttggaacaccaccatcgctgtgtctatggccaatattttcagaggctcctacctcgcgggggccggactgctgtttagcatcatgaagaacacaacgaatacccggcgcggcacaggcaacattggggaaaccctcggagagaagtggaaatctagacttaatgctctgggcaagagcgaattccaaatctataaaaagtccgggattcaggaggttgatcggacactggccaaagagggaatcaagagaggcgaaaccgaccatcacgctgtgtctcgcgggagcgccaaactccggtggtttgtcgagagaaacatggtgacgcccgaaggaaaggttgtggatctgggctgcggccgcgggggatggtcctactattgtggcgggcttaagaacgtccgggaggtgaaaggactgacaaagggcgggccgggacatgaagagcctatccccatgagcacctacggctggaatctcgtgagactgcagtccggcgttgacgtcttcttcaccccccctgagaaatgcgatacactgctctgtgacattggggaatctagccccaaccctaccatcgaggcgggacgcacacttcgggtgctgaatctggtggaaaactggctcaataacaatacgcaattttgcattaaggtcctgaacccgtatatgccctccgttatcgagaaaatggaaacccttcagagaaagtacggcggggccctggtgcgcaatcctctctctcggaacagcacacacgagatgtactgggtgtccaatgctaccggaaacattgtctctagcgtgaatatgatctccagaatgctgatcaaccgcttcacaatgaagcacaaaaaggccacctatgagcccgatgttgacctgggcagcgggacgcggaatattggaatcgaatctgagattcctaacctcgacatcattggcaaaagaatcgaaaagattaaacaggagcatgaaacctcctggcactacgatcaggaccatccctataagacatgggcttaccacggcagctatgagaccaagcaaacagggtctgcctccagcatggtgaacggagtcgtgcgccttctgaccaaaccgtgggatgttgtgcctatggtcacacagatggctatgaccgacacgacaccctttggccagcagagagtgttcaaggagaaagtggatacccggacccaagaacctaaggaggggacaaaaaagctgatgaagatcacggccgaatggctctggaaagagctgggaaagaaaaagaccccccgcatgtgtacaagagaggaatttacccggaaagtcagatctaatgcggcccttggcgctatcttcacagacgagaacaagtggaaatccgcccgggaagctgttgaggatagccgcttttgggaactgattgacagagagcggaatctccacctggaggggaagtgcgaaacctgtgtgtacaacatgatgggaaagcgcgagaaaaagctgggcgaattcggcaaagccaaggggtccagagccatctggtatatgtggctcggagcgcggtttctggagttcgaagctcttggctttctgaatgaggatcattggttcagccgcgggaactctctcagcggagtggagggcgaagggctgcacagacttggctacattctgcgggacgtctccaaaaaggagggaggcgccatgtacgccgatgacacagctgggtgggacacccgcatcacgctcgaagatctgaagaatgaggaaatggtgaccaaccatatgaaaggagagcacaagaaactggccgaggctatttttaagctcacatatcagaataaagttgtgagagtccagcggcctaccccccgcggcacagtgatggacatcatctctagacgggatcagcgcgggagcggacaagttggcacctacgggctgaacacgttcacaaatatggaagcccagcttattagacagatggagggcgaaggaatcttcaagtccattcaacatctgaccgtgacagaggagatcgcggtccagaactggctcgcccgggtgggcagagaacgcctgtctcggatggctattagcggggacgattgcgttgtgaagccgcttgacgatagatttgcctccgctctgaccgccctcaatgacatgggaaaagtccgcaaggatatccagcagtgggagccttctcggggctggaacgactggacgcaagtgcccttctgcagccaccactttcatgaactggtcatgaaagatgggagagtgctggttgtgccctgtcgcaatcaggacgagctcatcggacgggcgagaatttcccagggcgccgggtggagcctgaaggaaaccgcttgccttggcaaatcttatgcccagatgtggacactgatgtacttccaccgccgggatctcagactggctgccaacgctatctgttccgccgtccctagccattgggtgccgacctctcgcacaacctggtccattcacgcgaagcacgagtggatgacaaccgaggacatgcttgccgtgtggaaccgggtttggatccaagaaaatccctggatggaggacaagacgcctgtggaaagctgggaggaagtcccctatctgggaaaaagagaggatcagtggtgcggctccctcattgggctgacatctcgggctacctgggccaagaacatccagaccgccattaatcaggtgagaagcctgatcggaaacgaggaatacacagactatatgccttccatgaaacgctttcggagagaggaagaggaagctggcgttctctggtga

SEQ ID NO: 19996 - RNA, 9876 nt, synthetic construct
  misc_feature 1..9876: note = derived and/or modified CDS sequence (opt5) from DENV-2__EU482739__SS-prME
  source 1..9876: mol_type = other RNA
accgccggcgtgatcattatgctgatccccaccgctatggccttccacctcacgacccggaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaagaccgaggctaagcagcctgccacgctgagaaagtattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggtgatggtccaggccgacagcggatgtgtggtttcttggaagaataaagaactgaagtgcggctccgggattttcatcaccgataacgtgcacacatggacggagcagtacaagtttcagcctgaaagcccctccaaacttgcctctgctattcaaaaggcccatgaggaaggcatctgtggaatcagaagcgtcacccgcctggagaatctcatgtggaaacagattacaccggagctgaaccacatcctgtccgaaaatgaggtgaaacttaccattatgacaggcgacatcaaagggattatgcaggctggaaagcggtctctcagacctcagcccaccgaactgaaatatagctggaagacgtggggcaaggccaaaatgctgtccaccgagagccataaccaaacattcctcatcgatgggcctgaaaccgcggagtgccccaatacaaaccgcgcctggaactctctggaggttgaagactacggatttggcgtgttctccaccaacatctggcttaagctgcgggagaaacaggacgtcttttgtgatagcaagctcatgtctgctgccattaaagacaatagagctgtgcacgccgatatgggctattggatcgaatccgcgctgaacgacacatggaagatggagaaggccagcttcattgaggttaaatcttgccactggcctaagagccataccctgtggtccaatggggtgcttgaaagcgagatgatcattcccaaaaacttcgctggaccggtctctcagcacaactaccgccctggctatcatacgcagacagccgggccctggcacctcggaaagctggaaatggattttgacttctgtgagggcaccaccgtggtggtcacagaagattgcgggaatcggggaccctccctgagaaccacgacagctagcggcaaactcatcaccgagtggtgctgtcggtcctgcacactgcctccgcttcgctacagaggcgaggacgggtgttggtacggaatggaaattcggcccctgaaggagaaggaagagaacctcgttaattctctggtgaccgccggccatgggcaaatcgataactttagcctgggagtgcttggcatggccctcttcctggaagagatgctgagaacacgcgtcgggaccaaacacgctatcctcctggtggcggtttcctttgtgacgcttattaccggaaatatgtctttccgggacctgggcagagtcatggtgatggttggcgccacaatgaccgatgacatcgggatgggagtgacatatctcgctctgctggccgcctttaaggtccgccctaccttcgctgccggccttctgctcagaaaactgacgagcaaggagctcatgatggcgacaattgggatcgctctgctttcccagtctaccattcccgaaacaatcctggagctcaccgatgccctggccctgggaatgatggtgcttaaaatcgttcggaacctggaaaagtaccagctcgctgtgaccattatggccatcagctgcgtccctaatgcggtgattctgcaaaacgcttggaaggtgtcctgtacaatcctcgccgccgtcagcgtttctcccctgcttctgacgtccagccagcagaaagctgactggattcctctcgccctgaccatcaagggcctgaatcccacagctatctttcttaccacactgtctcgcacctccaaaaagagaagctggccgctcaacgaggccgtgatggcggtggggatggtctctattctggcctccagcctcctgaaaaatgacatccctatgacgggaccccttgtggctggcggcctgctgacagtttgctatgtgctcaccgggcggtccgccgatctggaacttgagcgcgctgccgacgtcaagtgggaggatcaggccgaaattagcggatctagccctatcctgtccattaccatctctgaggacggcagcatgtccattaaaaacgaagaggaggaacaaacactcaccatcctgatcagaacagggctcctggtgatttctggagttttccccgtgagcatcccgattacggctgcggcctggtacctttgggaggtcaagaagcagcgggctggcgtgctgtgggatgtcccttctccccctcccgtggggaaagccgaactggaggacggagcctatcgcatcaagcagagaggcatttttggctacagccagatcggggctggagtttataaagaaggcaccttccacacaatgtggcatgtgaccagaggggccgtcctcatgcaccgcggaaagagaatcgagcccagctgggcggatgtgaaaaaggacctgatttcctacggcgggggatggaaacttgagggcgaatggaaagagggcgaagaggttcaagtgctggctctcgaacctgggaagaatccgcgggccgtccagacaaaacccggactgtttaagaccaacacgggcaccatcggggccgtgagcctcgatttctctcctggaacatccggcagccccattgtggacagaaaagggaaggttgtcggactgtacggcaatggcgtggtgacccgctctggggcttatgtctccgccatcgcgcagacagaaaagagcattgaggataaccctgaaatcgaggacgatatcttccggaaaaagagacttaccattatggacctgcatcccggagctggcaaaacaaagcgctacctgcctgccatcgtgcgggaagccattaaaagagggctccgcacgctgatccttgctccgacccgggttgtggccgctgagatggaagaggccctgagaggactccccattcgctatcagacccctgcgatccgggccgagcacaccggcagagaaattgtcgacctgatgtgtcatgctacctttacaatgcggctcctgtcccccgtgcgcgttcctaactacaatcttatcatcatggatgaggcccacttcacggaccccgcttctattgccgccagagggtatatcagcacccgggtggaaatgggcgaggctgcgggaatttttatgacagccaccccgcctggctcccgcgatcccttcccccaaagcaacgctcctatcatggacgaggaaagagagattcccgaacggtcttggaactccgggcacgagtgggtcacagattttaagggaaagaccgtgtggttcgttcctagcatcaaagccggcaacgacatcgccgcttgcctgagaaagaatgggaaaaaggtgattcagctgtctcgcaaaacgtttgatagcgaatacgtcaagacacgggccaacgactgggatttcgtggtgaccaccgacatctccgagatgggagcgaattttagagctgagcgcgtcattgatccgcggagatgtatgaagcccgttatcctcacagacggcgaggaacgcgtgattctggccgggcctatgcccgtgacccattctagcgccgctcagcggagaggccgcatcggaagaaaccctaaaaatgaaaacgaccaatatatctacatgggcgagccccttgaaaatgatgaggactgcgcccactggaaggaggcgaaaatgctgctcgataacattaatacaccggaagggatcattccttccatgttcgagcccgaacgggagaaggtcgacgccatcgatggagaataccgcctgagaggcgaggctcggaaaacctttgtggacctgatgcgcagaggggatctccctgtttggcttgcctatcgggtggctgccgagggaattaactacgctgacagacgctggtgtttcgatggcatcaagaataaccagattctggaagagaacgtcgaagtggagatctggacgaaagagggggaacggaagaagctgaaacccagatggctcgacgcccgcatctattctgatcctctggcgcttaaggagttcaaagaatttgccgctggccggaagtccctgacactcaatctgattaccgagatgggaagactgcccacattcatgacccagaaagcccgggacgctctcgataaccttgccgttctgcatacggccgaagtgggcgggcgcgcttacaatcacgcgctgtccgagctcccggagaccctggaaacacttctgctcctgaccctgctcgccacagtcaccggaggcatctttcttttcctgatgagcgggaagggaattggcaagatgacactgggcatgtgctgcatcattaccgcttctatcctcctgtggtatgcccagatccaacctcactggattgccgcttccatcattcttgagtttttcctgatcgtgctcctgattcccgaacccgagaaacagagaacgcctcaggacaaccagctgacatacgtcgtgatcgccatcctcaccgttgtggcggccaccatggctaatgaaatggggtttcttgagaagaccaagaaggacctgggactgggcagcattaccacacaagagtccgaatctaacatcctcgatattgacctgcggccggccagcgcttggacgctttatgccgtggcgaccacattcgtcacccccatgctgcgccattccatcgaaaattctagcgttaacgtgtccctcacagccattgctaatcaggccaccgtgctgatggggctgggaagaggctggcctctcagcaaaatggatatcggggtcccccttctggctattggatgttactctcaggtgaaccctatcacgctgaccgccgctctcctgcttctggttgcccactacgcgatcattggccccggcctccaggccaaggctacacgggaagcccaaaagcgcgctgccgccgggatcatgaaaaatcctaccgtggacggaattacagtcatcgatctggagccgattccctatgaccctaagtttgaaaaacagctgggccaggtgatgctccttgtcctgtgcgtgacccaggttctgatgatgagaacgacatgggcgctctgtgaggctctgacccttgccacagggcccatctccaccctgtgggagggaaaccctggccggttctggaataccacaatcgctgtgagcatggccaacatttttcgcgggtcttacctcgccggagctggcctgctgttctccatcatgaagaatacgaccaacacaagacggggcaccgggaatattggagaaacactcggcgagaaatggaaaagcagacttaacgccctggggaagtctgaatttcaaacctataaaaagagcggaatccaggaggtcgatcgcacgctggcgaaagagggcattaagagaggggaaacagaccatcacgccgtgtccagaggatctgctaaactccgctggttcgttgagcggaacatggtgacccccgaaggcaaggtcgtggatctgggctgcgggagaggaggctggagctactattgtgggggacttaaaaatgtgcgcgaggttaagggcctgaccaaagggggaccgggccatgaggagcctatccccatgtccacatacggctggaacctcgtccggctgcagagcggggtggacgtgttctttacaccccctgagaaatgcgatacactgctctgtgacatcggagaatcctctcccaatcctacgattgaggccggcagaacccttcgcgtcctgaacctggttgaaaattggctcaacaataacacacaattctgcatcaaggtgctgaatccgtatatgcccagcgtgattgagaaaatggaaacccttcagcggaagtacgggggagctctggtcagaaaccctctctcccgcaattctacacacgagatgtactgggtgagcaacgccaccggcaatatcgtttcctctgtgaacatgattagccggatgctgatcaatagatttacgatgaaacacaagaaggcgacctatgagcccgatgtcgacctggggtccggaacacgcaacatcggcattgaaaacgagatccctaatctcgacattatcggcaaaagaattgaaaagatcaaacaggagcatgaaaccagctggcactacgatcaggaccatccctataagacatgggcctaccacgggtcttatgagaccaaacaaacaggatccgctagctctatggtgaacggcgttgtgcggcttctgaccaagccgtgggatgtcgtgcctatggtgacgcagatggccatgacagacaccacccccttcgggcagcagcgcgtctttaaggagaaagttgatacaagaacgcaagaacctaaggagggaaccaaaaagctgatgcggattacagctgaatggctctggaaagagctgggcaagaagaaaacccccagaatgtgtacacgggaggagttcacccgcaaggtgagatccaatgccgctcttggggccatctttacagacgagaacaaatggaaaagcgcgcgggaagccgtggaggattctcgcttctgggaactggtcgacagagagcggaatctccacctggagggaaaatgcgaaacctgtgtgtacaacatgatgggcaagcgcgagaaaaagctgggcgaatttgggaaggctaaaggatccagagccatctggtatatgtggctcggcgctcggttcctggagtttgaagcccttgggttcctgaatgaggatcattggtttagccgcggaaactccctcagcggcgttgagggggaaggcctgcacaaacttggatacattctgagagacgtgtctaaaaaggagggcggggccatgtacgcggatgacacggctggatgggacacccggatcacactcgaagatctgaaaaatgaggaaatggtcaccaaccatatgaagggcgagcacaagaaactggccgaggccattttcaagctcacatatcagaataaagtggttcgcgtgcagagacctacaccccgggggacggtcatggacatcattagccgcaaggatcagagaggatccggccaagtggggacatacggcctgaacaccttcacaaatatggaagctcagcttatccggcagatggagggagaaggcatctttaaatctattcaacatctgaccgttacggaggagatcgccgtgcagaactggctcgctagagtcgggcgcgaacggctgagcagaatggccatttccggagacgattgcgtggtcaagccgcttgacgatcgcttcgcgtctgccctgaccgctctcaatgacatgggcaaggtgcggaaagatatccagcagtgggagcctagcagagggtggaacgactggacacaagttcccttttgctcccaccacttccatgaactggtgatgaaggatggacgcgtcctggtggtgccctgtcggaaccaggacgagctcattggcagagcccgcatctctcagggggctggctggagcctgaaagaaaccgcctgccttggaaagtcctatgcgcagatgtggacactgatgtactttcaccggagagatctccgcctggccgctaatgccatctgtagcgctgttccttctcattgggtgccgacctcccggacaacctggagcattcacgccaaacacgagtggatgacgacagaggacatgcttgctgtctggaacagagtgtggatccaagaaaatccctggatggaggacaagacccctgttgaatcttgggaggaagtgccctatctgggcaagcgggaggatcagtggtgcgggtccctcattggactgaccagcagagccacatgggcgaaaaacatccagaccgccattaatcaggtccgctccctgatcggcaacgaggaatacacagactatatgccttctatgaagcggttcagaaaagaggaagaggaagctggggtgctctggtga

SEQ ID NO: 19997 - RNA, 9876 nt, synthetic construct
  misc_feature 1..9876: note = derived and/or modified CDS sequence (opt5) from DENV-2__EU482740__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagagcaggacaaacgctttgtgtgcaagcattccatggtggatagaggctggggcaacgggtgtggactgttcggcaaggggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaagcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagtccaaagaactgaagtgcggcagcgggatcttcattaccgataatgtgcacacatggacggagcagtacaagtttcagcctgaatccccctctaaacttgctagcgccatccaaaaggctcatgaggaaggcatttgtggaatcagatccgtcacccgcctggagaacctcatgtggaaacagatcacaccggagctgaatcacattctgtctgaaaacgaggtgaagcttaccatcatgacaggcgacattaaagggatcatgcagcctggaaagcggagcctcagaccccagcctaccgaactgaaatattcctggaagacgtggggcaaggccaaaatgctgagcaccgagtctcataatcaaacattcctcattgatgggcccgaaaccgcggagtgccctaacacaaatcgcgcctggaactccctggaggttgaagactacggatttggcgtgttcaccacaaatatctggcttaagctgcgggagaaacaggacgtcttttgtgatagcaagctcatgtctgctgccatcaaagacaacagagctgtgcacgccgatatgggctattggattgaatccgcgctgaatgacacctggaagatggagaaggccagcttcatcgaggttaaatcttgccactggcccaagagccatacgctgtggtccaacggggtgcttgaaagcgagatgattatcccgaaaaatttcgctggacctgtctctcagcacaactaccgccccggctatcatacacagaccgccgggccctggcacctcggaaagctggaaatggattttgacttctgtgagggcaccacagtggtggtcaccgaagattgcgggaaccggggaccttccctgagaacgacaaccgctagcggcaaactcattacagagtggtgctgtcggtcctgcaccctgccgccccttcgctacagaggcgaggacgggtgttggtacggaatggaaatccggcctctgaaggagaaggaagagaatctcgttaactctctggtgacagccggccatgggcaaattgataattttagcctgggagtgcttggcatggccctcttcctggaagagatgctgagaacccgcgtcgggacgaaacacgctatcctcctggtggcggtttcctttgtgacccttatcacaggaaacatgtctttccgggacctgggcagagtcatggtgatggttggcgccaccatgacagatgacattgggatgggagtgacctatctcgctctgctggccgcctttaaggtccgccccacgttcgctgccggccttctgctcagaaaactgacaagcaaggagctcatgatggcgaccatcgggattgctctgctttcccagtctacaatccctgaaaccattctggagctcaccgatgccctggccctgggaatgatggtgcttaaaatcgttcggaatatggaaaagtaccagctggctgtgacaatcatggccattagctgcgtccccaacgcggtgatcctccaaaatgcttggaaggtgtcctgtacgattctggccgtcgttagcgtgtctcctctcctgcttacctccagccagcagaaagccgactggatccccctggctctcacaattaagggcctgaacccgaccgccatctttctgacaaccctttctcgcacgtccaaaaagagaagctggcctctgaatgaggctatcatggccgtggggatggtctctattctcgcgtccagcctgctcaaaaacgacatccccatgacaggacctctggtggccggcggccttctgaccgtttgctatgtgctgaccgggcggtccgctgatctcgaactggagcgcgccgctgacgtcaagtgggaggatcaggccgaaattagcggatctagccccatcctttccattacaatctctgaggacggcagcatgtccattaaaaatgaagaggaggaacaaaccctgacaatcctcatcagaacggggctgctcgtgatttctggagttttcccggtgagcatccctattaccgccgctgcgtggtacctgtgggaggtcaagaagcagcgggccggcgtgctttgggatgtcccctcccctccccccgtggggaaagctgaactggaggacggagcctatcgcatcaagcagagaggcattctgggctactctcagatcggggccggagtttataaagaaggcacatttcacaccatgtggcatgtgacacggggggctgtcctcatgcaccgcggaaagagaatcgagcctagctgggccgatgtgaaaaaggacctgatttcctacggcgggggatggaagcttgagggcgaatggaaagagggcgaagaggttcaagtgctggcgctcgaaccggggaagaacccccgggctgtccagaccaaacctggactgttcaagacgaataccggcacaatcggggccgtgagcctcgatttttctcccggaacctccggcagccctattgtggacagaaaagggaaggttgtcggactgtacggcaacggcgtggtgacacgctctggggcctatgtctccgctatcgcccagaccgagaagagcattgaggataatcccgaaatcgaggacgatatcttccggaaaaagagacttacaattatggacctgcatcctggagcgggcaaaacgaagcgctacctgccggctatcgtgcgggaagccattaaaagagggctccgcaccctgatccttgcccccacacgggttgtggctgccgagatggaagaggctctgagaggactccctattcgctatcagacccccgccatccgggcggagcacaccggcagagaaattgtcgacctgatgtgtcatgccacattcacgatgcggctcctgtcccctgtgcgcgttcccaactacaaccttatcatcatggatgaggctcactttaccgacccggcctctattgctgccagagggtatatcagcacacgggtggaaatgggcgaggccgctggaattttcatgaccgcgacacctcccggctcccgcgatccctttcctcaaagcaatgcccccatcatggacgaggaaagagagattcctgaacggtcttggaactccgggcacgagtgggtcaccgatttcaagggaaagacggtgtggtttgttccgagcatcaaagctggcaatgacatcgccgcctgcctgagaaagaacgggaaacgcgtgattcagctgtctcggaagacattcgatagcgaatacgtcaaaaccagagctaatgactgggattttgtggtgaccacagacatctccgagatgggagccaacttcaaggcggagcgcgtcattgatccccggagatgtatgaagcctgttatcctcaccgacggcgaagagcgcgtgattctggctgggcccatgcctgtgacacattctagcgccgcccagcggagaggccgcatcggaagaaatcccaaaaacgaaaatgaccaatatatctacatgggcgagccgcttgaaaacgatgaggactgcgctcactggaaggaggccaaaatgctgctcgataatattaacacccctgaagggatcattccctccatgtttgagcctgaacgggagaaggtcgacgcgatcgatggagaataccgcctgagaggcgaggcccggaaaacgttcgtggacctgatgcgcagaggggatctccccgtttggcttgcttatcgggtggccgctgagggaattaattacgccgacagacgctggtgttttgatggcatcaagaacaatcagattctggaagagaacgtcgaagtggagatctggacaaaagagggggaacggaagaagctgaaacctagatggctcgacgctcgcatctattctgatcccctggcccttaaggagttcaaagaattcgcggccggccggaagagcctgaccctcaacctgattacagagatgggaagactgccgacctttatgacgcagaaagctcgggacgccctcgataatcttgctgttctgcataccgccgaagccggcgggcgcgcttacaaccacgcgctgtccgagctccctgagacactggaaacccttctgctcctgacactgctcgccaccgtgacaggaggcatcttcctttttctgatgagcgggaagggaattggcaagatgaccctgggcatgtgctgcatcattacggcttctatcctcctgtggtatgcccagatccaaccccactggattgccgcttccatcattcttgagttctttctgatcgtcctcctgattcccgaacctgagaaacagagaacaccgcaggacaatcagctgacctacgtggtcatcgccatcctcaccgtggttgcggccacaatggctaacgaaatggggttccttgagaagaccaaaaaggacctgggactgggcagcattacaacgcaagagtccgaatctaatatcctcgatattgacctgcggcccgccagcgcttggaccctttatgccgtggcgacaacctttgtgacacctatgctgcgccattccatcgagaactctagcgtcaatgtttccctcaccgccattgctaaccaggccacggtgctgatggggctgggaaaaggctggcccctcagcaagatggatatcggggtgcctcttctggctattggatgttactctcaggtcaatcccatcaccctgacagccgctctcctgcttctggtggcccactacgcgatcattggccctggcctccaggccaaggctaccagagaagcccaaaaacgggctgccgccgggatcatgaagaacccgacagttgacggaattaccgtgatcgatctggagcccattccttatgaccccaaattcgaaaagcagctgggccaggtcatgctccttatcctgtgcgtgacgcaggtcctgatgatgcgcacaacctgggcgctctgtgaggctctgacacttgccaccgggcctatctccaccctgtgggagggaaatcccggcagattttggaacacaacgattgctgtgagcatggccaatatcttccgggggtcttacctcgccggagctggcctgctgttttccattatgaaaaacaccacaaatacccgcagaggcacagggaacatcggagaaaccctcggcgagaagtggaagagccggcttaatgccctggggaaatctgaattccaaatttataagaaaagcggaatccaggaggttgatagaacgctggcgaaggagggcatcaaacgcggggaaacagaccatcacgccgtgtcccggggatctgctaagctcagatggtttgtcgagcgcaacatggtgaccccggaaggcaaagttgtggatctgggctgcgggcggggaggctggagctactattgtgggggacttaagaacgtcagagaggtgaagggcctgaccaaagggggacctggccatgaagagcccattcccatgtccacatacggctggaatctcgtgcgcctgcagagcggggttgacgtcttcttcacccctcccgagaagtgcgatacactgctctgtgacatcggagaatcctctcctaacccgacgattgaggccggccggacccttagagtgctgaatctggtggaaaactggctcaataacaatacacaattttgcgtcaaagttctgaacccctatatgcctagcgtgatcgagaagatggaaacccttcagcgcaaatacgggggagctctggtgcggaatcccctctccagaaactctacacacgagatgtactgggtcagcaatgccaccggcaacattgtgtcctctgttaatatgatcagccgcatgctgatcaaccggttcacgatgaagcacaagaaagcgacctatgagcctgatgtggacctggggtccggaacaagaaatattggcatcgaaagcgagattcccaacctcgacatcattggcaagcgcatcgaaaaaattaagcaggagcatgaaacctcttggcactacgatcaggaccatccgtataaaacatgggcctaccacgggtcctatgagaccaagcaaacaggaagcgcttcttccatggtcaacggcgtggttagacttctgaccaagccttgggatgtggtccccatggtgacgcagatggccatgacagacaccaccccttttgggcagcagcgggtgttcaaagagaaggtcgatacacgcacgcaagaacccaaagagggaaccaagaaactgatgaagatcacagctgaatggctctggaaggagctgggcaaaaagaaaacccctagaatgtgtacacgggaggaatttaccagaaaggttcggagcaatgccgctcttggggccatcttcacagacgagaacaaatggaagtctgcgcgcgaagccgtggaggattccagattttgggaactgattgaccgggagcgcaatctccacctggagggaaaatgcgaaacctgtgtgtacaacatgatgggcaagagagagaagaaactgggcgaattcgggaaggctaaaggaagccgggccatctggtatatgtggctcggcgctcgctttctggagttcgaagcccttgggtttctgaatgaggatcattggttctccagaggaaacagcctctctggcgtcgagggggaaggcctgcaccggcttggatacattctgcgcgacgtgagcaagaaagagggcggggccatgtacgcggatgacacggctggatgggacaccagaatcacactcgaagatctgaagaatgaggaaatggttaccaaccatatgaagggcgagcacaaaaagctggccgaggccatttttaaactcacatatcagaataaggtggtccgggtgcagcgccccaccccgagagggacggttatggacatcatctcccggcgcgatcagagaggatctggccaagtggggacatacggcctgaacaccttcacaaatatggaagctcagcttattcggcagatggagggagaaggcatcttcaaaagcattcaacatctgaccgtcacggaggagatcgccgtgcagaactggctcgctagagttgggcgcgaacggctgtccagaatggccatttctggagacgattgcgtggtcaagcctcttgacgatcgctttgcgagcgccctgaccgctctcaatgacatgggcaaggtgcggaaagatatccagcagtgggagccctccagagggtggaacgactggacacaagtccccttctgctctcaccactttcatgaactggtgatgaaggatggacgcgttctggtggtcccttgtcggaatcaggacgagctcatcggcagagcccgcattagccagggggctggctggtccctgaaagaaaccgcctgccttggaaagagctatgcgcagatgtggacactgatgtacttccaccggagagatctccgcctggccgctaacgccatctgttctgctgtgccgtcccattgggtgcccaccagccggacaacctggtctattcacgccaaacacgagtggatgacgacagaggacatgcttgctgtttggaacagagtgtggatccaagaaaatccttggatggaggacaagacccccgtcgaatcctgggaggaagtgccttatctgggcaagcgggaggatcagtggtgcgggagcctcattggactgacctccagagccacatgggcgaaaaacatccagaccgccattaatcaggttcgctctctgatcggcaacgaggaatacacagactatatgcccagcatgaagcggtttagacgcgaggaagaggaagctggggtgctctggtga

SEQ ID NO: 19998 - RNA, 9876 nt, synthetic construct
  misc_feature 1..9876: note = derived and/or modified CDS sequence (opt5) from DENV-2__EU482741__SS-prME
  source 1..9876: mol_type = other RNA
accgccggagtgatcattatgctgatccccaccgctatggccttccacctcacgaccagaaacggggaacctcatatgattgtcggacggcaggaaaagggcaaatccctgctttttaagaccgaagacggggttaatatgtgcaccctgatggcgatcgatctcggagaactgtgtgaagacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggccctcttcctggaagagatgctgagaacacgcgtcgggaccaaacacgccatgctcctggtggttgtgtcctttgtcacgcttatcaccggaaacatgtctttccgggacctgggcagagtgatggttatggtgggcgctacaatgaccgatgacatcgggatgggaattacatatctcgccctgctggccgcttttaaggtccgccctaccttcgccgcgggccttctgctcagaaaactgacgagcaaggagctcatgatggctacaatcgggattgccctgctttcccagtctaccatccccgaaacaattctggagctcaccgatgccctggctctgggaatgatggtgcttaaaatcgttcggaatatggaaaagtaccagctggccgtgaccatcatggcgattagctgcgtccctaacgctgtgatcctccaaaatgcctggaaggtgtcctgtacaattctggccgctgtcagcgtttctcccctcctgcttacgtccagccagcagaaagccgactggatccctctggctctcaccattaagggcctgaaccccacagccatctttctgaccacactttctcgcacctccaaaaagagaagctggccgctgaatgaggcgatcatggccgtggggatggtgtctattctcgcttccagcctgctcaaaaacgacatccctatgacgggacccctggtcgccggcggccttctgacagtgtgctatgttctgaccgggcggtccgctgatctcgaactggagcgcgccgccgacgtgaagtgggaggatcaggctgaaattagcggatctagccctatcctttccattaccatctctgaggacggcagcatgtccattaaaaatgaagaggaggaacaaacactgaccatcctcatcagaacagggctgctcgtcatttctggagtgttccccgttagcatcccgattacggcggccgcttggtacctgtgggaggtgaagaagcagcgggccggcgtcctttgggatgtgccttctccccctcccgtcgaaaaagccgagctggaagacggggcttatcgcatcaagcagagaggcattctgggctacagccagatcggcgccggggtgtataaagagggaacctttcacacaatgtggcatgttacccggggcgcggtgctcatgcaccgcgggaagagaatcgagcccagctgggctgatgtcaaaaaggacctgatttcctacggaggcgggtggaaacttgaaggagagtggaaagaaggcgaggaagtgcaagttctggccctcgagcctggcaagaacccgcgggccgtgcagacaaaacccgggctgttcaagaccaatacgggaaccatcggcgctgtcagcctcgatttttctcctgggacatccggaagccccattgtggacagaaaaggcaaggtggttgggctgtacggaaacggcgtcgtgacccgctctggcgcctatgtgtccgcgatcgctcagacagaaaagagcattgaagataatcctgagatcgaagacgatatcttccggaaaaagagacttaccattatggacctgcatcccggggccggaaaaacaaagcgctacctgcctgccatcgtccgggaggctattaaaagaggcctccgcacgctgatccttgccccgacccgggtggttgctgccgaaatggaggaggcgctgagagggctccccattcgctatcagacccctgcgatccgggctgaacacaccggaagagagattgtggacctgatgtgtcatgccaccttcacaatgcggctcctgtcccccgtccgcgtgcctaactacaaccttatcatcatggatgaagctcactttacggaccccgcctctattgccgctagaggctatatcagcacccgggttgagatgggggaggcggccggcattttcatgacagctaccccgcctggatcccgcgatccctttccccaaagcaatgcccctatcatggacgaagagagagaaattcccgagcggtcttggaactccggccacgaatgggtgacagatttcaaggggaagaccgtctggtttgtgcctagcatcaaagccggaaatgacatcgctgcctgcctgagaaagaacggcaaaaaggttattcagctgtctcgcaaaacgttcgatagcgagtacgtgaagacacgggcgaatgactgggattttgtcgtgaccaccgacatctccgagatgggggctaacttcaaggccgaaagagtgattgatccgcgccggtgtatgaaacccgtcatcctcacagacggagaggaaagagttattctggccggccctatgcccgtgacccattctagcgctgcccagcgccgggggagaatcggccgcaatcctaagaacgagaatgaccaatatatctacatgggagaaccccttgagaacgatgaggactgcgcgcactggaaagaagccaagatgctgctcgataatattaacacaccggagggcatcattccttccatgtttgaacccgagagagaaaaagtggacgctatcgatggggagtaccggctgcgcggagaggccagaaagaccttcgtcgacctgatgcggcgcggcgatctccctgtgtggcttgcttatagagttgccgctgaagggattaattacgccgaccggagatggtgttttgatggaatcaaaaacaatcagattctggaggaaaacgtggaggtcgagatctggacgaaggaaggcgagcgcaagaaactgaagccccggtggctcgacgcgagaatctattctgatcctctggcccttaaagagttcaaggagttcgctgccgggcgcaaaagcctgacactcaacctgattaccgaaatgggccggctgcccacatttatgacccagaaggctagagacgccctcgataatcttgccgtgctgcatacggctgaggcgggaggccgggcctacaaccacgctctgtccgagctcccggaaaccctggagacacttctgctcctgaccctgctcgccacagttaccgggggaatcttcctttttctgatgagcggcaaggggattggaaaaatgacactgggcatgtgctgcatcattaccgcctctatcctcctgtggtatgctcagatccaacctcactggattgccgcgtccatcattcttgagttctttctgatcgtgctcctgattcccgagcccgaaaagcagcgcacgcctcaggacaatcagctgacatacgtcgtgatcgccatcctcaccgtcgtggctgccaccatggctaacgagatgggcttccttgagaaaacaaagaaagacctggggctgggaagcattgccacccaagaatccgagtctaatatcctcgatattgacctgagaccggcgagcgcctggacactttatgctgttgccacgacctttgtgacacccatgctgcggcattccatcgaaaactctagcgtgaatgtctccctcaccgctattgccaaccaggctacagttctgatgggcctggggaagggatggcctctcagcaagatggatatcggcgtgccccttctggccattgggtgttactctcaggtgaatcctatcaccctgacggcggccctcctgcttctggtcgctcactacgccatcattggacccggcctccaggctaaagccacccgcgaggcccaaaagagagcggctgccggcatcatgaaaaaccctacagtggacgggattaccgttatcgatctggaaccgattccctatgaccctaagttcgagaaacagctgggacaggtgatgctccttatcctgtgcgtcacacaggtgctgatgatgcggaccacgtgggctctctgtgaggccctgacacttgccaccggccccatctccacactgtgggaagggaatcctggacgcttttggaacaccaccattgctgtcagcatggccaatatcttcagaggctcttacctcgcgggggccggactgctgttttccattatgaagaacacaacgaatacccggcgcggcacaggcaacatcggggagaccctcggagaaaagtggaaaagcagacttaatgctctgggcaagtctgagttccaaatttataaaaagagcgggatccaggaggtggatcggacactggccaaagaaggaatcaagagaggcgagaccgaccatcacgctgtttcccgcgggtctgccaaactccggtggtttgtggaaagaaacatggtcacgcccgagggaaaggtggttgatctgggctgcggccgcgggggatggagctactattgtggcgggcttaagaacgtgcgggaagtcaaaggactgacaaagggcgggccgggacatgaggagcctattcccatgtccacctacggctggaatctcgtgagactgcagagcggcgtggacgttttcttcacaccccctgaaaaatgcgatacactgctctgtgacatcggggagtcctctcccaaccctaccattgaagcgggacgcacacttcgggtcctgaatctggtggagaactggctcaataacaatacgcaattttgcatcaaggtgctgaacccgtatatgcccagcgtcattgagaagatggagacccttcagagaaagtacggcggggccctggttcgcaatcctctctcccggaactctacacacgagatgtactgggtgagcaatgctaccggaaacatcgtgtcctctgtcaatatgatcagcagaatgctgattaaccgcttcacaatgaagcacaaaaaggccacctatgaacccgatgtggacctgggctccgggacgcggaatatcggaattgagagcgaaatccctaacctcgacattatcggcaaaagaattgagaagatcaaacaggaacatgagacctcttggcactacgatcaggaccatccctataagacatgggcttaccacggctcctatgagaccaagcaaacagggagcgcctcttccatggttaacggagtggtccgccttctgaccaaaccgtgggatgtggttcctatggtgacacagatggctatgaccgacacgacaccctttggccagcagagagtcttcaaggaaaaagtggatacccggacccaagagcctaaggaagggaccaagaagctgatgaagatcacggccgagtggctctggaaagagctgggaaagaaaaagacaccccgcatgtgtacaagagaagagtttacccggaaagtgagaagcaatgcggcccttggcgctattttcacagacgaaaacaagtggaaatctgcccgggaggctgtcgaagattcccgcttttgggagctgatcgacagagagcggaatctccacctggaagggaagtgcgagacctgtgtttacaacatgatgggaaagcgcgagaaaaagctgggcgagttcggcaaagccaaggggagcagagccatttggtatatgtggctcggagcgcggtttctggagttcgaggctcttggctttctgaatgaggatcattggttctcccgcgggaacagcctctctggagtggaaggcgaggggctgcacagacttggctacatcctgcgggacgtgagcaaaaaggaaggaggcgccatgtacgccgatgacacagctgggtgggacacccgcattacgctcgaggatctgaagaatgaagagatggtcaccaaccatatgaaaggagagcacaagaaactggccgaagctatctttaagctcacatatcagaataaagtggttagagtgcagcggcctacaccccgcggcacagtcatggacatcatttccagacgggatcagcgcgggtctggacaagtgggcacctacgggctgaacacgttcacaaatatggaggcccagcttatcagacagatggaaggcgagggaattttcaagagcatccaacatctgaccgttacagaggaaattgcggtgcagaactggctcgcccgggtcggcagagagcgcctgtcccggatggctatctctggggacgattgcgtggttaagccgcttgacgatagatttgccagcgctctgaccgccctcaatgacatgggaaaagtgcgcaaggatatccagcagtgggaaccttcccggggctggaacgactggacgcaagtccccttctgctctcaccactttcatgagctggtgatgaaagatgggagagtcctggtggttccctgtcgcaatcaggacgaactcattggacgggcgagaatcagccagggcgccgggtggtccctgaaggagaccgcttgccttggcaaaagctatgcccagatgtggacactgatgtacttccaccgccgggatctcagactggctgccaacgctatttgttctgccgtgccttcccattgggtcccgaccagccgcacaacctggtctatccacgcgaagcacgagtggatgacaaccgaagacatgcttgccgtgtggaaccgggtgtggattcaagagaatccctggatggaagacaagacgcctgttgagtcctgggaagaggtgccctatctgggaaaaagagaggatcagtggtgcggcagcctcatcgggctgacatcccgggctacctgggccaagaacattcagaccgccatcaatcaggtcagatctctgatcggaaacgaagagtacacagactatatgcctagcatgaaacgctttcggagagaagaggaagaggctggcgtgctctggtga

SEQ ID NO: 19999 - RNA, 9876 nt, synthetic construct
  misc_feature 1..9876: note = derived and/or modified CDS sequence (opt5) from DENV-2__EU482742__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagagcaggacaaacgctttgtgtgcaagcattccatggtggatagaggctggggcaacgggtgtggactgttcggcaaggggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaagcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctcccgagattcagatgagctccggaaatctgctctttacaggccatctgaaatgcagacttcggatggataagctgcagctcaaagggatgtcttacagcatgtgtaccggaaagttcaagatcgtcaaagaaattgcggagacccaacacggcacaatcgtgatcagagtccagtatgagggggacggatccccctgcaagattcctttcgaaatcatggatctggagaaacgccatgtgctgggccggctcattacggttaacccgatcgtgaccgaaaaggacagccccgtcaacattgaggccgaacctccctttggggattcttacatcattatcggcgtggagcctggacagctgaaacttaattggttcaagaagggctccagcatcgggcagatgtttgagacaaccatgagaggagctaaacgcatggccattctgggcgacacagcctgggatttcgggtctctcggaggcgtttttaccagcatcgggaaggctctgcaccaagtgttcggcgccatttacggagcggctttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggccgacagcggatgtgtggtttcttggaagtccaaagaactgaagtgcggcagcgggatcttcattacagataatgtgcacacctggacagagcagtacaagtttcagcccgaatccccgtctaaacttgctagcgccatccaaaaggctcatgaggaaggcatttgtggaatcagatccgtcacgcgcctggagaacctcatgtggaaacagatcacccctgagctgaatcacattctgtctgaaaacgaggtgaagcttacaatcatgaccggcgacattaaagggatcatgcaggccggaaagcggagcctcagaccccagcctacagaactgaaatattcctggaagacctggggcaaggcgaaaatgctgagcacggagtctcataatcaaaccttcctcattgatgggcccgaaacagccgagtgccctaacaccaatcgcgcttggaactccctggaggttgaagactacggatttggcgtgttcacaaccaatatctggcttaagctgcgggagaaacaggacgtcttttgtgatagcaagctcatgtctgccgctatcaaagacaacagagccgtgcacgcggatatgggctattggattgaatccgccctgaatgacacatggaagatggagaaggctagcttcatcgaggttaaatcttgccactggcccaagagccataccctgtggtccaacggggtgcttgaaagcgagatgattatcccgaaaaatttcgccggacctgtctctcagcacaactaccgccccggctatcatacgcagacagctgggccctggcacctcggaaagctggaaatggattttgacttctgtgagggcaccaccgtggtggtcacagaagattgcgggaaccggggaccttccctgagaaccacgacagccagcggcaaactcattaccgagtggtgctgtcggtcctgcacactgccgccccttcgctacagaggcgaggacgggtgttggtacggaatggaaatccggcctctgaaggagaaggaagagaatctcgttaactctctggtgaccgccggccatgggcaaattgataattttagcctgggagtgcttggcatggctctcttcctggaagagatgctgagaacacgcgtcgggaccaaacacgcgatcctcctggtggccgtttcctttgtgacgcttatcaccggaaacatgtctttccgggacctgggcagagtcatggtgatggttggcgctacaatgaccgatgacattgggatgggagtgacatatctcgccctgctggccgcttttaaggtccgccccaccttcgccgcgggccttctgctcagaaaactgacgagcaaggagctcatgatggctacaatcgggattgccctgctttcccagtctaccatccctgaaacaattctggagctcaccgatgccctggctctgggaatgatggtgcttaaaatcgttcggaatatggaaaagtaccagctggccgtgaccatcatggcgattagctgcgtccccaacgctgtgatcctccaaaatgcctggaaggtgtcctgtacaattctggccgctgtcagcgtttctcctctcctgcttacgtccagccagcagaaagccgactggatccccctggctctcaccattaagggcctgaacccgacagccatctttctgaccacactttctcgcacctccaaaaagagaagctggcctctgaatgaggcgatcatggccgtggggatggtgtctattctcgcttccagcctgctcaaaaacgacatccccatgacgggacctctggtcgccggcggccttctgacagtgtgctatgttctgaccgggcggtccgctgatctcgaactggagcgcgccgccgacgtgaagtgggaggatcaggctgaaattagcggatctagccccatcctttccattaccatctctgaggacggcagcatgtccattaaaaatgaagaggaggaacaaacactgaccatcctcatcagaacagggctgctcgtcatttctggagtgttcccggttagcatccctattacggcggccgcttggtacctgtgggaggtgaagaagcagcgggccggcgtcctttgggatgtgccctcccctccccccgtcgggaaagccgaactggaggacggagcttatcgcatcaagcagagaggcattctgggctactctcagatcggggccggagtgtataaagaaggcacctttcacacaatgtggcatgttacccggggggcggtgctcatgcaccgcggaaagagaatcgagcctagctgggctgatgtcaaaaaggacctgatttcctacggcgggggatggaagcttgagggcgaatggaaagagggcgaagaggtgcaagttctggccctcgaaccggggaagaacccccgggccgtgcagacaaaacctggactgttcaagaccaatacgggcaccatcggggctgtcagcctcgatttttctcccggaacatccggcagccctattgtggacagaaaagggaaggtggttggactgtacggcaacggcgtcgtgacccgctctggggcctatgtgtccgcgatcgctcagacagagaagagcattgaggataatcccgaaatcgaggacgatatcttccggaaaaagagacttaccattatggacctgcatcctggagccggcaaaacaaagcgctacctgccggccatcgtccgggaagctattaaaagagggctccgcacgctgatccttgcccccacccgggtggttgctgccgagatggaagaggcgctgagaggactccctattcgctatcagacacccgccatccgggctgagcacaccggcagagaaattgtggacctgatgtgtcatgccaccttcacaatgcggctcctgtcccctgtccgcgtgcccaactacaaccttatcatcatggatgaggctcactttacggacccggcctctattgccgctagagggtatatcagcacccgggttgaaatgggcgaggcggccggaattttcatgacagctacccctcccggctcccgcgatccctttcctcaaagcaatgcccccatcatggacgaggaaagagagattcctgaacggtcttggaactccgggcacgagtgggtgacagatttcaagggaaagaccgtctggtttgtgccgagcatcaaagccggcaatgacatcgctgcctgcctgagaaagaacgggaaaaaggttattcagctgtctcgcaaaacgttcgatagcgaatacgtgaagacacgggcgaatgactgggattttgtcgtgaccaccgacatctccgagatgggagctaacttcaaggccgagagagtgattgatccccgccggtgtatgaaacctgtcatcctcacagacggcgaagagagagttattctggccgggcccatgcctgtgacccattctagcgctgcccagcgccggggcagaatcggacgcaatcccaagaacgaaaatgaccaatatatctacatgggcgagccgcttgaaaacgatgaggactgcgcgcactggaaagaggccaagatgctgctcgataatattaacacacctgaagggatcattccctccatgtttgagcctgaaagagagaaagtggacgctatcgatggagaataccggctgcgcggcgaggccagaaagaccttcgtcgacctgatgcggcgcggggatctccccgtgtggcttgcttatagagttgccgctgagggaattaattacgccgaccggagatggtgttttgatggcatcaaaaacaatcagattctggaagagaacgtggaagtcgagatctggacgaaggagggggaacgcaagaaactgaagcctcggtggctcgacgcgagaatctattctgatcccctggcccttaaagagttcaaggaattcgctgccggccgcaaaagcctgacactcaacctgattaccgagatgggacggctgccgacatttatgacccagaaggctagagacgccctcgataatcttgccgtgctgcatacggctgaagcgggcgggcgggcctacaaccacgctctgtccgagctccctgagaccctggaaacacttctgctcctgaccctgctcgccgccgttacaggaggcatcttcctttttctgatgagcgggaagggaattggcaaaatgaccctgggcatgtgctgcatcattacagcttctatcctcctgtggtatgcccagatccaaccccactggattgcggcctccatcattcttgagttctttctgatcgtgctcctgattcccgaacctgagaagcagcgcaccccgcaggacaatcagctgacgtacgtcgtgatcgctatcctcacagtcgtggccgctaccatggccaacgaaatggggttccttgagaaaaccaagaaagacctgggactgggcagcattacaacccaagagtccgaatctaatatcctcgatattgacctgagacccgcgagcgcctggacactttatgctgttgccacgacctttgtgacacctatgctgcggcattccatcgagaactctagcgtgaatgtctccctcaccgctattgccaaccaggctacagttctgatggggctgggaaagggctggcccctcagcaagatggatatcggggtgcctcttctggccattggatgttactctcaggtgaatcccatcaccctgacggcggccctcctgcttctggtcgctcactacgccatcattggccctggcctccaggctaaagccacccgcgaagcccaaaagagagcggctgccgggatcatgaaaaacccgacagtggacggaattaccgttatcgatctggagcccattccttatgaccccaagttcgaaaaacagctgggccaggtgatgctccttatcctgtgcgtcacacaggtgctgatgatgcggaccacgtgggctctctgtgaggccctgacacttgccaccgggcctatctccacactgtgggagggaaatcccggccgcttttggaacaccaccattgctgtcagcatggccaatatcttcagagggtcttacctcgcgggagccggcctgctgttttccattatgaagaacacaacgaatacccggcgcggcacagggaacatcggagaaaccctcggcgagaagtggaaaagcagacttaatgctctggggaagtctgaattccaaatttataaaaagagcggaatccaggaggtggatcggacactggccaaagagggcatcaagagaggggaaaccgaccatcacgctgtttcccgcggatctgccaaactccggtggtttgtggagagaaacatggtcacgccggaaggcaaggtggttgatctgggctgcgggcgcggaggctggagctactattgtgggggacttaagaacgtgcgggaggtcaaaggcctgacaaaggggggacctggccatgaagagcccattcccatgtccacctacggctggaatctcgtgagactgcagagcggggtggacgttttcttcacccctcccgagaaatgcgatacactgctctgtgacatcggagaatcctctcctaacccgaccattgaggcgggccgcacacttcgggtcctgaatctggtggaaaactggctcaataacaatacgcaattttgcatcaaggtgctgaacccctatatgcctagcgtcattgagaaaatggaaacccttcagagaaagtacgggggagccctggttcgcaatcccctctcccggaactctacacacgagatgtactgggtgagcaatgctaccggcaacatcgtgtcctctgtcaatatgatcagcagaatgctgattaaccgcttcacaatgaagcacaaaaaggccacctatgagcctgatgtggacctggggtccggaacgcggaatatcggcattgaaagcgagatccccaacctcgacattatcggcaaaagaattgaaaagatcaaacaggagcatgaaacctcttggcactacgatcaggaccatccgtataagacatgggcttaccacgggtcctatgagaccaagcaaacaggaagcgcctcttccatggttaacggcgtggtccgccttctgaccaaaccttgggatgtggttcccatggtgacacagatggctatgaccgacacgacaccttttgggcagcagagagtcttcaaggagaaagtggatacccggacccaagaacccaaggagggaacaaaaaagctgatgaagatcacggccgaatggctctggaaagagctgggcaagaaaaagacccctcgcatgtgtacaagagaggaatttacccggaaagtgagaagcaatgcggcccttggggctattttcacagacgagaacaagtggaaatctgcccgggaagctgtcgaggattcccgcttttgggaactgatcgacagagagcggaatctccacctggagggaaagtgcgaaacctgtgtttacaacatgatgggcaagcgcgagaaaaagctgggcgaattcgggaaagccaagggaagcagagccatttggtatatgtggctcggcgcgcggtttctggagttcgaagctcttgggtttctgaatgaggatcattggttctcccgcggaaacagcctctctggcgtggagggggaaggcctgcacagacttggatacatcctgcgggacgtgagcaaaaaggagggcggggccatgtacgccgatgacacagctggatgggacacccgcattacgctcgaagatctgaagaatgaggaaatggtcaccaaccatatgaaaggcgagcacaagaaactggccgaggctatctttaagctcacatatcagaataaagtggttagagtgcagcggcccaccccgcgcgggacagtcatggacatcatttccagacgggatcagcgcggatctggccaagtggggacctacggcctgaacacgttcacaaatatggaagcccagcttatcagacagatggagggagaaggcattttcaagagcatccaacatctgaccgttacagaggagattgcggtgcagaactggctcgcccgggtcgggagagaacgcctgtcccggatggctatctctggagacgattgcgtggttaagcctcttgacgatagatttgccagcgctctgaccgccctcaatgacatgggcaaagtgcgcaaggatatccagcagtgggagccctcccgggggtggaacgactggacgcaagtccccttctgctctcaccactttcatgaactggtgatgaaagatggaagagtcctggtggttccttgtcgcaatcaggacgagctcattggccgggcgagaatcagccagggggccggctggtccctgaaggaaaccgcttgccttggaaaaagctatgcccagatgtggacactgatgtacttccaccgccgggatctcagactggctgccaacgctatttgttctgccgtgccgtcccattgggtccccaccagccgcacaacctggtctatccacgcgaagcacgagtggatgacaaccgaggacatgcttgccgtgtggaaccgggtgtggattcaagaaaatccttggatggaggacaagacgcccgttgaatcctgggaggaagtgccttatctgggcaaaagagaggatcagtggtgcgggagcctcatcggactgacatcccgggctacctgggccaagaacattcagaccgccatcaatcaggtcagatctctgatcggcaacgaggaatacacagactatatgcccagcatgaaacgctttcggagagaggaagaggaagctggggtgctctggtga

SEQ ID NO: 20000 - RNA, 9876 nt, synthetic construct
  misc_feature 1..9876: note = derived and/or modified CDS sequence (opt5) from DENV-2__EU482744__SS-prME
  source 1..9876: mol_type = other RNA
acagccggcgtgatcattatgctgatccccacagctatggccttccacctcacgacccggaatggggagcctcatatgattgtcggacggcaggaaaagggcaagtccctgctttttaagacagaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagaataaagaactgaagtgcggctccgggatcttcattaccgataacgtgcacacatggacggagcagtacaagtttcagcctgaaagcccctccaaacttgcttctgccatccaaaaggctcatgaggaaggcatttgtggaatcagaagcgtcacccgcctggagaatctcatgtggaaacagatcacaccggagctgaaccacattctgtccgaaaatgaggtgaaacttaccatcatgacaggcgacattaaagggatcatgcaggccggaaagcggtctctcagacctcagcccaccgaactgaaatatagctggaagacgtggggcaaggcgaaaatgctgtccaccgagagccataaccaaacattcctcattgatgggcctgaaaccgccgagtgccccaatacaaaccgcgcttggaactctctggaggttgaagactacggatttggcgtgttcaccacaaacatctggcttaagctgcgggagaaacaggacgtcttttgtgattccaagctcatgagcgccgctatcaaagacaatagagccgtgcacgcggatatgggctattggattgaatctgccctgaacgacacctggaagatggagaaggcttccttcatcgaggttaaaagctgccactggcctaagtctcatacgctgtggagcaatggggtgcttgaatccgagatgattatccccaaaaacttcgccggaccggtcagccagcacaactaccgccctggctatcatacacagaccgctgggccctggcacctcggaaagctggaaatggattttgacttctgtgagggcaccacagtggtggtcaccgaagattgcgggaatcggggaccctctctgagaacgacaaccgcctccggcaaactcattacagagtggtgctgtcggagctgcaccctgcctccgcttcgctacagaggcgaggacgggtgttggtacggaatggaaatccggcccctgaaggagaaggaagagaacctcgttaattccctggtgacagccggccatgggcaaattgataacttttctctgggagtgcttggcatggctctcttcctggaagagatgctgagaacccgcgtcgggacgaaacacgcgatcctcctggtggccgttagctttgtgacccttatcacaggaaatatgtccttccgggacctgggcagagtcatggtgatggttggcgctaccatgacagatgacattgggatgggagtgacctatctcgccctgctggccgcttttaaggtccgccctacgttcgccgcgggccttctgctcagaaaactgacatctaaggagctcatgatggctaccatcgggattgccctgcttagccagtccacaatccccgaaaccattctggagctcaccgatgccctggctctgggaatgatggtgcttaaaatcgttcggaacatggaaaagtaccagctggccgtgtctatcatggcgattagctgcgtccctaatgctgtgatcctccaaaacgcctggaaggtgtcctgtacaattctggccgctgtcagcgtttctcccctcctgcttacgtccagccagcagaaagccgactggatccctctggctctcaccattaagggcctgaatcccacagccatctttctgaccacactttctcgcacctccaaaaagagaagctggccgctgaacgaggcgatcatggccgtggggatggtgtctattctcgcttccagcctgctcaaaaatgacatccctatgacgggacccctggtcgccggcggccttctgacagtgtgctatgttctgaccgggcggtccgctgatctcgaactggagcgcgccgccgacgtgaagtgggaggatcaggctgaaattagcggatctagccctatcctttccattaccatctctgaggacggcagcatgtccattaaaaacgaagaggaggaacaaacactgaccatcctcatcagaacagggctgctcgtcatttctggagtgttccccgttagcatcccgattacggcggccgcttggtacctgtgggaggtgaagaagcagcgggccggcgtcctttgggatgtgccttctccccctcccgtcgggaaagccgaactggaggacggagcttatcgcatcaagcagagaggcattctgggctacagccagatcggggccggagtgtataaagaaggcacctttcacacaatgtggcatgttaccagaggggcggtgctcatgcaccgcggaaagagaatcgagcccagctgggctgatgtcaaaaaggacctgatttcctacggcgggggatggaaacttgagggcgaatggaaagagggcgaagaggtgcaagttctggccctcgaacctgggaagaatccgcgggccgtgcagacaaaacccggactgttcaagaccaacacgggcaccatcggggctgtcagcctcgatttttctcctggaacatccggcagccccattgtggacagaaaagggaaggtggttggactgtacggcaatggcgtcgtgacccgctctggggcctatgtgtccgcgatcgctcagacagaaaagagcattgaggataaccctgaaatcgaggacgatatcttccggaaaaagagacttaccattatggacctgcatcccggagccggcaaaacaaagcgctacctgcctgccatcgtccgggaagctattaaaagagggctccgcacgctgatccttgccccgacccgggtggttgctgccgagatggaagaggcgctgagaggactccccattcgctatcagacccctgccatccgggctgagcacaccggcagagaaattgtggacctgatgtgtcatgccaccttcacaatgcggctcctgtcccccgtccgcgtgcctaactacaatcttatcatcatggatgaggctcactttacggaccccgcctctattgccgctagagggtatatcagcacccgggttgaaatgggcgaggcggccggaattttcatgacagctaccccgcctggctcccgcgatccctttccccaaagcaacgcccctatcatggacgaggaaagagagattcccgaacggtcttggaactccgggcacgagtgggtgacagatttcaagggaaagaccgtctggtttgtgcctagcatcaaagccggcaacgacatcgctgcctgcctgagaaagaatgggaaaaaggttattcagctgtctcgcaaaacgttcgatagcgaatacgtgaagacacgggcgaacgactgggattttgtcgtgaccaccgacatctccgagatgggagctaatttcaaggccgagagagtgattgatccgcgccggtgtatgaaacccgtcatcctcacagacggcgaagagagagttattctggccgggcctatgcccgtgacccattctagcgctgcccagcgccggggcagaatcggacgcaaccctaagaatgaaaacgaccaatatatctacatgggcgagccccttgaaaatgatgaggactgcgcgcactggaaagaggccaagatgctgctcgataacattaatacaccggaagggatcattccttccatgtttgagcccgaaagagagaaagtggacgctatcgatggagaataccggctgcgcggcgaggccagaaagaccttcgtcgacctgatgcggcgcggggatctccctgtgtggcttgcttatagagttgccgctgagggaattaactacgccgaccggagatggtgttttgatggcatcaaaaataaccagattctggaagagaacgtggaagtcgagatctggacgaaggagggggaacgcaagaaactgaagccccggtggctcgacgcgagaatctattctgatcctctggcccttaaagagttcaaggagttcgctgccggccgcaaaagcctgacactcaatctgattaccgagatgggacggctgcccacatttatgacccagaaggctagagacgccctcgataaccttgccgtgctgcatacggctgaagcgggcgggcgggcctacaatcacgctctgtccgagctcccggagaccctggaaacacttctgctcctgaccctgctcgccacagttaccggaggcatcttcctttttctgatgagcgggaagggaattggcaaaatgacactgggcatgtgctgcatcattaccgcctctatcctcctgtggtatgctcagatccaacctcactggattgccgcgtccatcattcttgagttctttctgatcgtgctcctgattcccgaacccgagaagcagcgcacgcctcaggacaaccagctgacatacgtcgtgatcgccatcctcaccgtcgtggctgccaccatggctaatgaaatggggttccttgagaaaacaaagaaagacctgggactgggcagcattaccacacaagagtccgaatctaacatcctcgatattgacctgagaccggccagcgcgtggacgctttatgccgttgctaccacatttgtgacccccatgctgcggcattccatcgaaaattctagcgtgaacgtctccctcacagccattgctaatcaggccaccgttctgatggggctgggaaagggctggcctctcagcaagatggatatcggggtgccccttctggctattggatgttactctcaggtgaaccctatcacgctgaccgccgcgctcctgcttctggtcgcccactacgctatcattggccccggcctccaggccaaagctacacgcgaagcccaaaagagagccgcggctgggatcatgaaaaatcctaccgtggacggaattacagttatcgatctggagccgattccctatgaccctaagttcgaaaaacagctgggccaggtgatgctccttatcctgtgcgtcacccaggtgctgatgatgcggacgacatgggccctctgtgaggctctgacccttgccacagggcccatctccaccctgtgggagggaaaccctggccgcttttggaataccacaattgccgtcagcatggctaacatcttcagagggtcttacctcgccggagcgggcctgctgttttccattatgaagaatacgaccaacacacggcgcggcaccgggaatatcggagaaacactcggcgagaagtggaaaagcagacttaacgccctggggaagtctgagttccaaatttataaaaagagcggaatccaggaggtggatcggaccctggctaaagagggcatcaagagaggggaaacggaccatcacgccgtttcccgcggatctgctaaactccggtggtttgtggagagaaacatggtcacacccgaaggcaaggtggttgatctgggctgcgggcgcggaggctggagctactattgtgggggacttaagaatgtgcgggaggtcaaaggcctgaccaaagggggaccgggccatgaagaacctattcccatgtccacctacggctggaacctcgtgagactgcagagcggggtggacgttttcttcacaccccctgagaaatgcgataccctgctctgtgacatcggagaatcctctcccaatcctacaattgaggccggccgcacgcttcgggtcctgaacctggtggaaaattggctcaacaataacacccaattttgcatcaaggtgctgaatccgtatatgcccagcgtcattgagaaaatggaaacacttcagagaaagtacgggggagcgctggttcgcaaccctctctccagaaattctacccacgagatgtactgggtgagcaacgccacaggcaatatcgtgtcctctgtcaacatgatcagcagaatgctgattaatcgcttcaccatgaagcacaaaaaggctacgtatgagcccgatgtggacctggggtccggaacccggaacatcggcattgaaagcgagatccctaacctcgacattatcggcaaaagaattgaaaagatcaaacaggagcatgaaacatcttggcactacgatcaggaccatccctataagacctgggcctaccacgggtcctatgagacaaagcaaaccggaagcgcttcttccatggttaatggcgtggtccgccttctgacaaaaccgtgggatgtggttcctatggtgacccagatggccatgacggacacaaccccctttgggcagcagagagtcttcaaggagaaagtggatacccggacacaagaacctaaggagggaacgaaaaagctgatgaagatcaccgctgaatggctctggaaagagctgggcaagaaaaagacaccccgcatgtgtaccagagaggaatttacacggaaagtgagaagcaacgccgcgcttggggccattttcaccgacgagaataagtggaaatctgctcgggaagccgtcgaggattcccgcttttgggaactgatcgacagagagcggaacctccacctggagggaaagtgcgaaacatgtgtttacaatatgatgggcaagcgcgagaaaaagctgggcgagttcgggaaagctaagggaagcagagccatttggtatatgtggctcggcgcccggtttctggagttcgaagcgcttgggtttctgaacgaggatcattggttctcccgcggaaatagcctctctggcgtggagggggaaggcctgcacagacttggatacatcctgcgggacgtgagcaaaaaggagggcggggctatgtacgccgatgacaccgccggatgggacacgcgcattaccctcgaagatctgaagaacgaggaaatggtcacaaatcatatgaaaggcgagcacaagaaactggctgaggccatctttaagctcacctatcagaacaaagtggttagagtgcagcggcctacaccccgcgggaccgtcatggacatcatttccagacgggatcagcgcggatctggccaagtggggacgtacggcctgaatacattcaccaacatggaagctcagcttatcagacagatggagggagaaggcattttcaagagcatccaacatctgacagttaccgaggagattgccgtgcagaattggctcgcgcgggtcgggagagaacgcctgtcccggatggccatctctggagacgattgcgtggttaagccgcttgacgatagatttgctagcgccctgacggctctcaacgacatgggcaaagtgcgcaaggatatccagcagtgggagccttcccgggggtggaatgactggacccaagtccccttctgctctcaccactttcatgaactggtgatgaaagatggaagagtcctggtggttccctgtcgcaaccaggacgagctcattggccgggccagaatcagccagggggcgggctggtccctgaaggaaacagcctgccttggaaaaagctatgctcagatgtggaccctgatgtacttccaccgccgggatctcagactggccgctaacgccatttgttctgctgtgccttcccattgggtcccgacaagccgcaccacatggtctatccacgccaagcacgagtggatgaccacggaggacatgcttgcggtgtggaatcgggtgtggattcaagaaaacccctggatggaggacaagacacctgttgaatcctgggaggaagtgccctatctgggcaaaagagaggatcagtggtgcgggagcctcatcggactgacctcccgggccacctgggctaagaatattcagacagccatcaaccaggtcagatctctgatcggcaatgaggaatacaccgactatatgcctagcatgaaacgctttcggaaggaggaagaggaagccggggtgctctggtga

SEQ ID NO: 20001 - RNA, 9876 nt, synthetic construct
  misc_feature 1..9876: note = derived and/or modified CDS sequence (opt5) from DENV-2__EU482745__SS-prME
  source 1..9876: mol_type = other RNA
accgccggcgtgatcattatgctgatccccacggctatggccttccacctcacgaccagaaacggggagcctcatatgattgtcggacggcaggaaaagggcaaaagcctgctttttaagaccgaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagtccaaagaactgaagtgcggcagcgggatcttcattaccgataatgtgcacacatggacggagcagtacaagtttcagcctgaatccccctctaaacttgctagcgccatccaaaaggctcatgaggaaggcatttgtggaatcagatccgtcacccgcctggagaacctcatgtggaaacagatcacaccggagctgaatcacattctgtctgaaaacgaggtgaaacttaccatcatgacaggcgacattaaagggatcatgcaggccggaaagcggagcctcagacctcagcccaccgaactgaaatattcctggaagacgtggggcaaggcgaaaatgctgagcaccgagtctcataatcgcacattcctcattgatgggcctgaaaccgccgagtgccccaacacaaatcgggcttggaactccctggaggttgaagactacggatttggcgtgttcaccacaaatatctggcttaagctgagagagaaacaagacgtcttttgtgatagcaagctcatgtctgccgctatcaaagacaaccgcgccgtgcacgcggatatgggctattggattgaatccgccctgaatgacacctggaagatggagaaggctagcttcatcgaggttaaatcttgccactggcctaagagccatacgctgtggtccaacggggtgcttgaaagcgagatgattatccccaaaaatttcgccggaccggtctctcagcacaactaccggcctggctatcatacacagaccgctgggccctggcacctcggaaagctggaaatggattttgacttctgtgagggcaccacagtggtggtcaccgaagattgcgggaacagaggaccctccctgcggacgacaaccgccagcggcaaactcattacagagtggtgctgtcgctcctgcaccctgcctccgcttagataccggggcgaggacgggtgttggtacggaatggaaatcagacccctgaaggagaaggaagagaatctcgttaactctctggtgacagccggccatgggcagattgataattttagcctgggagtgcttggcatggctctcttcctggaagagatgctgcgcacccgggtcgggacgaaacacgcgatcctcctggtggccgtttcctttgtgacccttatcacaggaaacatgtctttcagagacctgggccgcgtcatggtgatggttggcgctaccatgacagatgacattgggatgggagtgacctatctcgccctgctggccgcttttaaggtcagacctacgttcgccgcgggccttctgctccggaaactgacaagcaaggagctcatgatggctaccatcgggattgccctgctttcccaatctacaatccccgaaaccattctggagctcaccgatgccctggctctgggaatgatggtgcttaaaatcgttcgcaatatggaaaagtaccagctggccgtgacaatcatggcgattagctgcgtccctaacgctgtgatcctccagaatgcctggaaggtgtcctgtacgattctggccgctgtcagcgtttctcccctcctgcttacctccagccaacagaaagccgactggatccctctggctctcacaattaagggcctgaaccccaccgccatctttctgacaaccctttctagaacgtccaaaaagcggagctggccgctgaatgaggcgatcatggccgtggggatggtgtctattctcgcttccagcctgctcaaaaacgacatccctatgacaggacccctggtcgccggcggccttctgaccgtgtgctatgttctgaccgggcgctccgctgatctcgaactggagagagccgccgacgtgaagtgggaggatcaggctgaaattagcggatctagccctatcctttccattacaatctctgaggacggcagcatgtccattaaaaatgaagaggaggaacagaccctgacaatcctcatccggacggggctgctcgtcatttctggagtgttccccgttagcatcccgattaccgcggccgcttggtacctgtgggaggtgaagaagcaacgcgccggcgtcctttgggatgtgccttctccccctcccgtcgggaaagccgaactggaggacggagcttatagaatcaagcagcggggcattctgggctacagccagatcggggccggagtgtataaagaaggcacatttcacaccatgtggcatgttacacgcggggcggtgctcatgcacagaggaaagcggatcgagcccagctgggctgatgtcaaaaaggacctgatttcctacggcgggggatggaaacttgagggcgaatggaaagagggcgaagaggtgcaggttctggccctcgaacctgggaagaacccgagagccgtgcaaaccaaacccggactgttcaagacgaataccggcacaatcggggctgtcagcctcgatttttctcctggaacctccggcagccccattgtggaccgcaaagggaaggtggttggactgtacggcaacggcgtcgtgacacggtctggggcctatgtgtccgcgatcgctcagaccgaaaagagcattgaggataatcctgaaatcgaggacgatatcttccgcaagaagcgccttacaattatggacctgcatcccggagccggcaaaacgaagcggtacctgcctgccatcgtcagagaagctattaaacgcgggctccggaccctgatccttgccccgacaagagtggttgctgccgagatggaagaggcgctgcgcggactccccattcggtatcagacccctgccatcagagctgagcacaccggccgggaaattgtggacctgatgtgtcatgccacattcacgatgcgcctcctgtcccccgtcagagtgcctaactacaaccttatcatcatggatgaggctcactttaccgaccccgcctctattgccgctcgggggtatatcagcacacgcgttgaaatgggcgaggcggccggaattttcatgaccgctacaccgcctggctccagagatccctttccccagagcaatgcccctatcatggacgaggaacgggagattcccgaaagatcttggaactccgggcacgagtgggtgaccgatttcaagggaaagacggtctggtttgtgcctagcatcaaagccggcaatgacatcgctgcctgcctgcgcaagaacgggaaaaaggttattcaactgtctcggaaaacattcgatagcgaatacgtgaagaccagagcgaatgactgggattttgtcgtgaccacagacatctccgagatgggagctaacttcaaggccgagcgcgtgattgatccgcggagatgtatgaaacccgtcatcctcaccgacggcgaagaaagagttattctggccgggcctatgcccgtgacacattctagcgctgcccagcggagaggccgcatcggaagaaatcctaagaacgaaaatgaccagtatatctacatgggcgagccccttgaaaacgatgaggactgcgcgcactggaaagaggccaagatgctgctcgataatattaacaccccggaagggatcattccttccatgtttgagcccgaacgggagaaagtggacgctatcgatggagaataccgcctgagaggcgaggcccggaagacgttcgtcgacctgatgcgcagaggggatctccctgtgtggcttgcttatcgggttgccgctgagggaattaattacgccgacagacgctggtgttttgatggcatcaaaaacaatcaaattctggaagagaacgtggaagtcgagatctggacaaaggagggggaacggaagaaactgaagcccagatggctcgacgcgcgcatctattctgatcctctggcccttaaagagttcaaggagttcgctgccggccggaaaagcctgaccctcaacctgattacagagatgggaagactgcccacctttatgacgcagaaggctcgggacgccctcgataatcttgccgtgctgcataccgctgaagcgggcgggcgcgcctacaaccacgctctgtccgagctcccggagacactggaaacccttctgctcctgacactgctcgccaccgttacaggaggcatcttcctttttctgatgagcgggaagggaattggcaaaatgaccctgggcatgtgctgcatcattacggcctctatcctcctgtggtatgctcagatccagcctcactggattgccgcgtccatcattcttgagttctttctgatcgtgctcctgattcccgaacccgagaagcaaagaacacctcaggacaatcagctgacctacgtcgtgatcgccatcctcaccgtcgtggctgccacaatggctaacgaaatggggttccttgagaaaaccaagaaagacctgggactgggcagcattacaacgaaggagtccgaatctaatatcctcgatattgacctgcggccggccagcgcgtggaccctttatgccgttgctacaacctttgtgacacccatgctgcgccattccatcgagaactctagcgtgaatgtctccctcaccgccattgctaaccaggccacggttctgatggggctgggaaagggctggcctctcagcaaaatggatatcggggtgccccttctggctattggatgttactctcaagtgaatcctatcaccctgacagccgcgctcctgcttctggtcgcccactacgctatcattggccccggcctccaggccaaggctaccagagaagcccagaaacgggccgcggctgggatcatgaagaaccctacagtggacggaattaccgttatcgatctggagccgattccctatgaccctaaattcgaaaagcagctgggccaagtgatgctccttatcctgtgcgtcacacaggtgctgatgatgcgcacaacctgggccctctgtgaggctctgacacttgccaccgggcccatctccaccctgtgggagggaaatcctggcagattttggaacacaacgattgccgtcagcatggctaatatcttccgggggtcttacctcgccggagcgggcctgctgttttccattatgaagaacaccacaaatacccgcagaggcacagggaacatcggagaaaccctcggcgagaaatggaagtcccggcttaatgccctggggaaatctgagttccagatttataagaaaagcggaatccaggaggtggatagaacgctggctaaggagggcatcaaacgcggggaaacagaccatcacgccgtttcccggggatctgctaagctcagatggtttgtggagcgcaacatggtcacccccgaaggcaaggtggttgatctgggctgcgggcggggaggctggagctactattgtgggggacttaaaaacgtgagagaggtcaagggcctgaccaaagggggaccgggccatgaagaacctattcccatgtccacatacggctggaatctcgtgcgcctgcaaagcggggtggacgttttcttcacaccccctgagaagtgcgatacactgctctgtgacatcggagaatcctctcccaaccctacgattgaggccggccggacccttagagtcctgaatctggtggaaaactggctcaataacaatacacagttttgcatcaaagtgctgaacccgtatatgcccagcgtcattgagaagatggaaacccttcagcgcaagtacgggggagcgctggttcggaatcctctctccagaaactctacacacgagatgtactgggtgagcaatgccaccggcaacatcgtgtcctctgtcaatatgatcagccgcatgctgattaaccggttcacgatgaaacacaagaaagctacctatgagcccgatgtggacctggggtccggaacaagaaatatcggcattgaaagcgagatccctaacctcgacattatcggcaagcgcattgagaagatcaagcaagagcatgaaacctcttggcactacgatcaggaccatccctataagacatgggcctaccacgggtcctatgagaccaaacagacaggaagcgcttcttccatggttaacggcgtggtcagacttctgaccaagccgtgggatgtggttcctatggtgacgcagatggccatgacagacaccaccccctttgggcaacagcgggtcttcaaagagaaggtggatacacgcacgcaggaacctaaagagggaaccaagaagctgatgaaaatcacagctgaatggctctggaaggagctgggcaaaaagaaaacccccagaatgtgtacacgggaggaatttaccagaaaggtgcggagcaatgccgcgcttggggccattttcacagacgagaacaaatggaagtctgctcgcgaagccgtcgaggattccagattttgggaactgatcgaccgggagcgcaatctccacctggagggaaagtgcgaaacctgtgtttacaacatgatgggcaaaagagagaagaaactgggcgagttcgggaaggctaaaggaagccgggccatttggtatatgtggctcggcgcccgctttctggagttcgaagcgcttgggtttctgaatgaggatcattggttctccagaggaaacagcctctctggcgtggagggggaaggcctgcaccggcttggatacatcctgcgcgacgtgagcaagaaggagggcggggctatgtacgccgatgacacggccggatgggacaccagaattacactcgaagatctgaaaaatgaggaaatggtcaccaaccatatgaagggcgagcacaaaaagctggctgaggccatctttaaactcacatatcagaataaggtggttcgggtgcaacgccctacccccagagggacggtcatggacatcatttcccggcgcgatcagagaggatctggccaggtggggacatacggcctgaacaccttcacaaatatggaagctcagcttatccggcaaatggagggagaaggcattttcaagagcatccagcatctgaccgttacggaggagattgccgtgcagaactggctcgcgagagtcgggcgcgaacggctgtccagaatggccatctctggagacgattgcgtggttaaaccgcttgacgatcgctttgctagcgccctgaccgctctcaatgacatgggcaaggtgcggaaagatatccaacagtgggagccttccagagggtggaacgactggacacaggtccccttctgctctcaccactttcatgaactggtgatgaaggatggacgcgtcctggtggttccctgtcggaatcaggacgagctcattggcagagcccgcatcagccaaggggcgggctggtccctgaaagaaaccgcctgccttggaaagagctatgctcagatgtggacactgatgtacttccaccggagagatctccgcctggccgctaacgccatttgttctgctgtgccttcccattgggtcccgaccagccggacaacctggtctatccacgccaagcacgagtggatgacgacagaggacatgcttgcggtgtggaacagagtgtggattcaggaaaatccctggatggaggacaaaacccctgttgaatcctgggaggaagtgccctatctgggcaagcgggaggatcagtggtgcgggagcctcatcggactgacctccagagccacatgggctaaaaacattcaaaccgccatcaatcaggtcaagtctctgatcggcaacgaggaatacacagactatatgcctagcatgaaacgctttcggagagaggaagaggaagccggggtgctctggtga

SEQ ID NO: 20002 - RNA, 9876 nt, synthetic construct
  misc_feature 1..9876: note = derived and/or modified CDS sequence (opt5) from DENV-2__EU482746__SS-prME
  source 1..9876: mol_type = other RNA
accgccggcgtgatcattatgctgatccccacggctatggccttccacctcacgaccagaaacggggagcctcatatgattgtcggacggcaggaaaagggcaagtccctgctttttaagaccgaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagtccaaagaactgaagtgcggcagcgggatcttcattaccgataatgtgcacacatggacggagcagtacaagtttcagcctgaatccccctctaaacttgctagcgccatccaaaaggctcatgaggaaggcatttgtggaatcagatccgtcacccgcctggagaacctcatgtggaaacagatcacaccggagctgaatcacattctgtctgaaaacgaggtgaaacttaccatcatgacaggcgacattaaagggatcatgcaggccggaaagcggagcctcagacctcagcccaccgaactgaaatattcctggaagacgtggggcaaggcgaaaatgctgagcaccgagtctcataatcgcacattcctcattgatgggcctgaaaccgccgagtgccccaacacaaatcgggcttggaactccctggaggttgaagactacggatttggcgtgttcaccacaaatatctggcttaagctgagagagaaacaagacgtcttttgtgatagcaagctcatgtctgccgctatcaaagacaaccgcgccgtgcacgcggatatgggctattggattgaatccgccctgaatgacacctggaagatggagaaggctagcttcatcgaggttaaatcttgccactggcctaagagccatacgctgtggtccaacggggtgcttgaaagcgagatgattatccccaaaaatttcgccggaccggtctctcagcacaactaccggcctggctatcatacacagaccgctgggccctggcacctcggaaagctggaaatggattttgacttctgtgagggcaccacagtggtggtcaccgaagattgcgggaacagaggaccctccctgcggacgacaaccgccagcggcaaactcattacagagtggtgctgtcgctcctgcaccctgcctccgcttagataccggggcgaggacgggtgttggtacggaatggaaatcagacccctgaaggagaaggaagagaatctcgttaactctctggtgacagccggccatgggcagattgataattttagcctgggagtgcttggcatggctctcttcctggaagagatgctgcgcacccgggtcgggacgaaacacgcgatcctcctggtggccgtttcctttgtgacccttatcacaggaaacatgtctttcagagacctgggccgcgtcatggtgatggttggcgctaccatgacagatgacattgggatgggagtgacctatctcgccctgctggccgcttttaaggtcagacctacgttcgccgcgggccttctgctccggaaactgacaagcaaggagctcatgatggctaccatcgggattgccctgctttcccaatctacaatccccgaaaccattctggagctcaccgatgccctggctctgggaatgatggtgcttaaaatcgttcgcaatatggaaaagtaccagctggccgtgacaatcatggcgattagctgcgtccctaacgctgtgatcctccagaatgcctggaaggtgtcctgtacgattctggccgctgtcagcgtttctcccctcctgcttacctccagccaacagaaagccgactggatccctctggctctcacaattaagggcctgaaccccaccgccatctttctgacaaccctttctagaacgtccaaaaagcggagctggccgctgaatgaggcgatcatggccgtggggatggtgtctattctcgcttccagcctgctcaaaaacgacatccctatgacaggacccctggtcgccggcggccttctgaccgtgtgctatgttctgaccgggcgctccgctgatctcgaactggagagagccgccgacgtgaagtgggaggatcaggctgaaattagcggatctagccctatcctttccattacaatctctgaggacggcagcatgtccattaaaaatgaagaggaggaacagaccctgacaatcctcatccggacggggctgctcgtcatttctggagtgttccccgttagcatcccgattaccgcggccgcttggtacctgtgggaggtgaagaagcaacgcgccggcgtcctttgggatgtgccttctccccctcccgtcgggaaagccgaactggaggacggagcttatagaatcaagcagcggggcattctgggctacagccagatcggggccggagtgtataaagaaggcacatttcacaccatgtggcatgttacacgcggggcggtgctcatgcacagaggaaagcggatcgagcccagctgggctgatgtcaaaaaggacctgatttcctacggcgggggatggaaacttgagggcgaatggaaagagggcgaagaggtgcaggttctggccctcgaacctgggaagaacccgagagccgtgcaaaccaaacccggactgttcaagacgaataccggcacaatcggggctgtcagcctcgatttttctcctggaacctccggcagccccattgtggaccgcaaagggaaggtggttggactgtacggcaacggcgtcgtgacacggtctggggcctatgtgtccgcgatcgctcagaccgaaaagagcattgaggataatcctgaaatcgaggacgatatcttccgcaagaagcgccttacaattatggacctgcatcccggagccggcaaaacgaagcggtacctgcctgccatcgtcagagaagctattaaacgcgggctccggaccctgatccttgccccgacaagagtggttgctgccgagatggaagaggcgctgcgcggactccccattcggtatcagacccctgccatcagagctgagcacaccggccgggaaattgtggacctgatgtgtcatgccacattcacgatgcgcctcctgtcccccgtcagagtgcctaactacaaccttatcatcatggatgaggctcactttaccgaccccgcctctattgccgctcgggggtatatcagcacacgcgttgaaatgggcgaggcggccggaattttcatgaccgctacaccgcctggctccagagatccctttccccagagcaatgcccctatcatggacgaggaacgggagattcccgaaagatcttggaactccgggcacgagtgggtgaccgatttcaagggaaagacggtctggtttgtgcctagcatcaaagccggcaatgacatcgctgcctgcctgcgcaagaacgggaaaaaggttattcaactgtctcggaaaacattcgatagcgaatacgtgaagaccagagcgaatgactgggattttgtcgtgaccacagacatctccgagatgggagctaacttcaaggccgagcgcgtgattgatccgcggagatgtatgaaacccgtcatcctcaccgacggcgaagaaagagttattctggccgggcctatgcccgtgacacattctagcgctgcccagcggagaggccgcatcggaagaaatcctaagaacgaaaatgaccagtatatctacatgggcgagccccttgaaaacgatgaggactgcgcgcactggaaagaggccaagatgctgctcgataatattaacaccccggaagggatcattccttccatgtttgagcccgaacgggagaaagtggacgctatcgatggagaataccgcctgagaggcgaggcccggaagacgttcgtcgacctgatgcgcagaggggatctccctgtgtggcttgcttatcgggttgccgctgagggaattaattacgccgacagacgctggtgttttgatggcatcaaaaacaatcaaattctggaagagaacgtggaagtcgagatctggacaaaggagggggaacggaagaaactgaagcccagatggctcgacgcgcgcatctattctgatcctctggcccttaaagagttcaaggagttcgctgccggccggaaaagcctgaccctcaacctgattacagagatgggaagactgcccacctttatgacgcagaaggctcgggacgccctcgataatcttgccgtgctgcataccgctgaagcgggcgggcgcgcctacaaccacgctctgtccgagctcccggagacactggaaacccttctgctcctgacactgctcgccaccgttacaggaggcatcttcctttttctgatgagcgggaagggaattggcaaaatgaccctgggcatgtgctgcatcattacggcctctatcctcctgtggtatgctcagatccagcctcactggattgccgcgtccatcattcttgagttctttctgatcgtgctcctgattcccgaacccgagaagcaaagaacacctcaggacaatcagctgacctacgtcgtgatcgccatcctcaccgtcgtggctgccacaatggctaacgaaatggggttccttgagaaaaccaagaaagacctgggactgggcagcattacaacgcaggagtccgaatctaatatcctcgatattgacctgcggccggccagcgcgtggaccctttatgccgttgctacaacctttgtgacacccatgctgcgccattccatcgagaactctagcgtgaatgtctccctcaccgccattgctaaccaagccacggttctgatggggctgggaaagggctggcctctcagcaagatggatatcggggtgccccttctggctattggatgttactctcaggtgaatcctatcaccctgacagccgcgctcctgcttctggtcgcccactacgctatcattggccccggcctccaggccaaagctaccagagaagcccagaagcgggccgcggctgggatcatgaaaaaccctacagtggacggaattaccgttatcgatctggagccgattccctatgaccctaagttcgaaaaacaactgggccaggtgatgctccttatcctgtgcgtcacacaggtgctgatgatgcgcacaacctgggccctctgtgaggctctgacacttgccaccgggcccatctccaccctgtgggagggaaatcctggcagattttggaacacaacgattgccgtcagcatggctaatatcttccgggggtcttacctcgccggagcgggcctgctgttttccattatgaagaacaccacaaatacccgcagaggcacagggaacatcggagaaaccctcggcgagaagtggaaaagccggcttaatgccctggggaagtctgagttccagatttataaaaagagcggaatccaagaggtggatagaacgctggctaaagagggcatcaagcgcggggaaacagaccatcacgccgtttcccggggatctgctaaactcagatggtttgtggagcgcaacatggtcacccccgaaggcaaggtggttgatctgggctgcgggcggggaggctggagctactattgtgggggacttaagaacgtgagagaggtcaaaggcctgaccaaagggggaccgggccatgaggaacctattcccatgtccacatacggctggaatctcgtgcgcctgcagagcggggtggacgttttcttcacaccccctgagaaatgcgatacactgctctgtgacatcggagaatcctctcccaaccctacgattgaggccggccggacccttagagtcctgaatctggtggaaaactggctcaataacaatacacagttttgcatcaaggtgctgaacccgtatatgcccagcgtcattgagaaaatggaaacccttcaacgcaagtacgggggagcgctggttcggaatcctctctccagaaactctacacacgagatgtactgggtgagcaatgccaccggcaacatcgtgtcctctgtcaatatgatcagccgcatgctgattaaccggttcacgatgaagcacaaaaaggctacctatgagcccgatgtggacctggggtccggaacaagaaatatcggcattgaaagcgagatccctaacctcgacattatcggcaaacgcattgaaaagatcaaacaggagcatgaaacctcttggcactacgatcaggaccatccctataagacatgggcctaccacgggtcctatgagaccaagcagacaggaagcgcttcttccatggttaacggcgtggtcagacttctgaccaaaccgtgggatgtggttcctatggtgacgcaaatggccatgacagacaccaccccctttgggcagcagcgggtcttcaaggagaaagtggatacacgcacgcaggaacctaaggagggaaccaaaaagctgatgaagatcacagctgaatggctctggaaagagctgggcaagaaaaagacccccagaatgtgtacacgggaggaatttaccagaaaagtgcggagcaatgccgcgcttggggccattttcacagacgagaacaagtggaaatctgctcgcgaagccgtcgaggattccagattttgggaactgatcgaccgggagcgcaatctccacctggagggaaagtgcgaaacctgtgtttacaacatgatgggcaagagagagaaaaagctgggcgagttcgggaaagctaagggaagccgggccatttggtatatgtggctcggcgcccgctttctggagttcgaagcgcttgggtttctgaatgaggatcattggttctccagaggaaacagcctctctggcgtggagggggaaggcctgcaccggcttggatacatcctgcgcgacgtgagcaaaaaggagggcggggctatgtacgccgatgacacggccggatgggacaccagaattacactcgaagatctgaagaatgaggaaatggtcaccaaccatatgaaaggcgagcacaagaaactggctgaggccatctttaagctcacatatcaaaataaagtggttcgggtgcagcgccctacccccagagggacggtcatggacatcatttcccggcgcgatcagagaggatctggccaggtggggacatacggcctgaacaccttcacaaatatggaagctcaacttatccggcagatggagggagaaggcattttcaagagcatccagcatctgaccgttacggaggagattgccgtgcaaaactggctcgcgagagtcgggcgcgaacggctgtccagaatggccatctctggagacgattgcgtggttaagccgcttgacgatcgctttgctagcgccctgaccgctctcaatgacatgggcaaagtgcggaaggatatccagcagtgggagccttccagagggtggaacgactggacacaggtccccttctgctctcaccactttcatgaactggtgatgaaagatggacgcgtcctggtggttccctgtcggaatcaagacgagctcattggcagagcccgcatcagccagggggcgggctggtccctgaaggaaaccgcctgccttggaaaaagctatgctcagatgtggacactgatgtacttccaccggagagatctccgcctggccgctaacgccatttgttctgctgtgccttcccattgggtcccgaccagccggacaacctggtctatccacgccaagcacgagtggatgacgacagaggacatgcttgcggtgtggaacagagtgtggattcaggaaaatccctggatggaggacaagacccctgttgaatcctgggaggaagtgccctatctgggcaaacgggaggatcaatggtgcgggagcctcatcggactgacctccagagccacatgggctaagaacattcagaccgccatcaatcaggtccgctctctgatcggcaacgaggaatacacagactatatgcctagcatgaaacggtttagacgcgaggaagaggaagccggggtgctctggtga

SEQ ID NO: 20003 - RNA, 9876 nt, synthetic construct
  misc_feature 1..9876: note = derived and/or modified CDS sequence (opt5) from DENV-2__EU482590__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagagcaggacaaacgctttgtgtgcaagcattccatggtggatagaggctggggcaacgggtgtggactgttcggcaaggggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaagcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccgttctgggcgacaccgcctgggatttcgggtctctcggaggcgtgtttacgagcattgggaaggctctgcaccaagtcttcggcgccatctacggagcggctttttccggcgtgtcttggacaatgaaaattctgatcggggtgattatcacctggatcggaatgaacagccggtccaccagcctttctgtttccctcgtcctggtgggcgtggtcacactgtatctcggggccatggtgcaggccgacagcggatgtgttgtgtcttggaagaataaagaactgaagtgcggctccgggattttcatcaccgataacgtccacacatggacggagcagtacaagtttcagcctgaaagcccctccaaacttgcttctgccattcaaaaggctcatgaggaaggcatctgtggaattagaagcgtgacccgcctggagaatctcatgtggaaacagatcacaccggagctgaaccacatcctgtccgaaaatgaggttaagcttaccattatgacaggcgacatcaaagggattatgcaggccggaaagcggtctctcagacctcagcccaccgaactgaaatatagctggaagacgtggggcaaggcgaaaatgctgtccaccgagcctcataaccaaacattcctcatcgatgggcccgaaaccgccgagtgccctaatacaaaccgcgcttggaatagcctggaggtggaagactacggatttggcgtcttcaccacaaacatttggcttaagctgcgggagaaacaggacgtgttttgtgattctaagctcatgtccgccgctatcaaagacaatagagccgttcacgcggatatgggctattggatcgaaagcgccctgaacgacacctggaagatggagaaggcttctttcattgaggtgaaatcctgccactggcccaagagccatacgctgtggtctaatggggtccttgaaagcgagatgatcattccgaaaaacttcgccggacctgtgtcccagcacaactaccgccccggctatcatacacagaccgctgggccctggcacctcggaaagctggaaatggattttgacttctgtgagggcaccacagtggtcgttaccgaagattgcgggaatcggggacctagcctgagaacgacaaccgcctctggcaaactcatcacagagtggtgctgtcggtcctgcaccctgccgccccttcgctacagaggcgaggacgggtgttggtacggaatggaaattcggcctctgaaggagaaggaagagaacctcgtgaatagcctggtgacagccggccatgggcaaatcgataacttttccctgggagtccttggcatggctctcttcctggaagagatgctgagaacccgcgtggggacgaaacacgcgattctcctggttgccgtgtcttttgtcacccttatcacaggaaatatgagcttccgggacctgggcagagtgatggttatggtgggcgctaccatgacagatgacatcgggatgggagtcacctatctcgccctgctggccgcttttaaggtgcgccccacgttcgccgcgggccttctgctcagaaaactgacatccaaggagctcatgatggctaccattgggatcgccctgctttctcagagcacaattcctgaaaccatcctggagctcaccgatgccctggctctgggaatgatggttcttaaaattgtgcggaacatggaaaagtaccagctggccgtcacaatcatggcgatctcctgcgtgcccaatgctgtgattctccaaaacgcctggaaggtctcttgtacgatcctggccgctgttagcgtgtcccctctcctgcttaccagctctcagcagaaagccgactggattcccctggctctcacaatcaagggcctgaatccgaccgccatttttctgacaaccctttcccgcacgagcaaaaagagatcttggcctctgaacgaggcgatcatggccgtggggatggtctccatcctcgctagctctctgctcaaaaatgacattcccatgacaggacctctggtggccggcggccttctgaccgtttgctatgtgctgaccgggcggtccgctgatctcgaactggagcgcgccgccgacgtcaagtgggaggatcaggctgaaatcagcggatccagccccattctttctatcacaattagcgaggacggctccatgtctatcaaaaacgaagaggaggaacaaaccctgacaattctcatcagaacggggctgctcgtgatcagcggagttttcccggtgtccattcctatcaccgcggccgcttggtacctgtgggaggtcaagaagcagcgggccggcgtgctttgggatgtcccctctcctccccccgtggggaaagccgaactggaggacggagcttatcgcattaagcagagaggcatcctgggctacagccagattggggccggagtttataaagaaggcacatttcacaccatgtggcatgtgacacggggggcggtcctcatgcaccgcggaaagagaatcgagccttcctgggctgatgtgaaaaaggacctgatctcttacggcgggggatggaagcttgagggcgaatggaaagagggcgaagaggttcaagtgctggccctcgaaccggggaagaatccccgggccgtccagaccaaacctggactgttcaagacgaacaccggcacaattggggctgtgagcctcgatttttcccccggaaccagcggctctcctatcgtggacagaaaagggaaggttgtcggactgtacggcaatggcgtggtgacacgctccggggcctatgtcagcgcgattgctcagaccgagaagtctatcgaggataaccccgaaattgaggacgatatcttccggaaaaagagacttacaatcatggacctgcatcctggagccggcaaaacgaagcgctacctgccggccattgtgcgggaagctatcaaaagagggctccgcaccctgattcttgcccccacacgggttgtggctgccgagatggaagaggcgctgagaggactccctatccgctatcagacccccgccattcgggctgagcacaccggcagagaaatcgtcgacctgatgtgtcatgccacattcacgatgcggctcctgtcccctgtgcgcgttcccaactacaatcttattatcatggatgaggctcactttaccgacccggccagcatcgccgctagagggtatatttccacacgggtggaaatgggcgaggcggccggaatcttcatgaccgctacacctcccggctctcgcgatccctttcctcaaagcaacgcccccattctggacgaggaaagagagatccctgaacggtcctggaatagcgggcacgagtgggtcaccgatttcaagggaaagacggtgtggtttgttccgtctattaaagccggcaacgacatcgctgcctgcctgagaaagaatgggaaaaaggtgatccagctctcccgcaaaacattcgatagcgaatacgtcaagacccgggcgaacgactgggattttgtggtgaccacagacatttctgagatgggagctaatttcaaggccgagagagtcatcgatccccgccggtgtatgaaacctgttattctgaccgacggcgaagagagagtgatccttgccgggcccatgcctgtgacacatagctccgctgcccagcgccggggcagaattggacgcaaccccaagaatgaaaacgaccaatatatctacatgggcgagccgctggaaaatgatgaggactgcgcgcactggaaagaggccaagatgctcctggataacatcaatacccctgaagggattatcccctctatgtttgagcctgaaagagagaaagtcgacgctattgatggagaataccggctgcgcggcgaggccagaaagacgttcgtggacctcatgcggcgcggggatcttcccgtttggctggcttatagagtggccgctgagggaatcaactacgccgaccggagatggtgttttgatggcattaaaaataaccagatcctggaagagaacgtcgaagtggagatttggacaaaggagggggaacgcaagaaactcaagcctcggtggctggacgcgagaatctatagcgatccccttgccctgaaagagttcaaggaattcgctgccggccgcaaatccctcaccctgaatctgatcacagagatgggacggctcccgacctttatgacgcagaaggctagagacgcccttgataacctggccgttctgcataccgctgaagtgggcgggcgggcgtacaatcacgccctctctgagctgcctgagacacttgaaaccctgctcctgctgacactccttgctaccgtcacaggaggcattttcctgtttctgatgagcgggaagggaatcggcaaaatgaccctcggcatgtgctgcattatcacggcctccattctgctttggtatgcccagatccaaccccactggatcgctgccagcattatcctggagttctttctcattgtgctgctgatccccgaacctgagaagcagcgcacaccgcaggacaaccagctcacctacgtcgtgattgcgatccttaccgttgtggccgctacaatggccaatgaaatggggttcctggagaaaaccaagaaagacctgggactcggctctatcacaacgcaagagtccgaaagcaacattctggatatcgaccttagacccgcttccgcctggaccctgtatgcggtggccacaacctttgtcacacctatgctccggcattctattgagaatagctccgttaacatctctctgaccgctattgccaatcaggctacggtgctgatggggctcggaaagggctggccccttagcaagatggatatcggggtgcctctgctggccattggatgttactcccaggtcaaccccatcaccctcacagctgccctgcttctgctcgtggcgcactacgccatcattggccctggcctgcaggctaaagccacccgcgaagctcaaaagagagccgccgcggggatcatgaaaaatccgacagttgacggaattaccgtgatcgatctggagcccattccttatgaccccaagttcgaaaaacagctcggccaggtcatgcttctgatcctgtgcgtgacgcaggtcctcatgatgcggacaacctgggctctgtgtgaggcccttacactggctaccgggcctatcagcaccctctgggagggaaaccccggccgcttttggaatacaacgattgccgtgtctatggccaacatcttcagagggtcctacctggctggagccggcctgctctttagcattatgaagaataccacaaacacccggcgcggcacagggaatatcggagaaacccttggcgagaagtggaaatctagactgaacgcgctggggaagtccgaattccaaatttataaaaagagcggaatccaggaggttgatcggacgctcgccaaagagggcatcaagagaggggaaacagaccatcacgctgtgtctcgcggaagcgccaaactgcggtggtttgtcgagagaaacatggtgaccccggaaggcaaggttgtggatcttggctgcgggcgcggaggctggtcctactattgtgggggactgaagaatgtccgggaggtgaaaggcctcaccaaggggggacctggccatgaagagcccattcccatgtctacatacggctggaacctggtgagactgcagagcggggttgacgtcttcttcacccctcccgagaaatgcgatacactcctttgtgacatcggagaatccagccctaatccgacgattgaggctggccgcaccctgcgggtgctgaacctcgtggaaaattggctgaacaataacacacaattttgcatcaaggtccttaatccctatatgccttccgttattgagaaaatggaaaccctgcagagaaagtacgggggagccctcgtgcgcaaccccctgtctcggaatagcacacacgagatgtactgggtgtccaacgcgaccggcaatatcgtctctagcgtgaacatgatctccagaatgctgattaatcgcttcacgatgaagcacaaaaaggccacctatgagcctgatgttgacctcgggtctggaacacggaacatcggcattgaaagcgagatccccaaccttgacattatcggcaaaagaattgaaaagatcaaacaggagcatgaaacctcctggcactacgatcaggaccatccgtataagacatgggcttaccacgggagctatgagaccaagcaaacaggatctgcctccagcatggtgaatggcgtcgtgcgcctgctgaccaaaccttgggatgttgtgcccatggtcacgcagatggctatgacagacaccaccccttttgggcagcagagagtgttcaaggagaaagtggatacacggacgcaagaacccaaggagggaaccaaaaagctcatgaagatcacagccgaatggctgtggaaagagcttggcaagaaaaagacccctcgcatgtgtacaagagaggaatttacccggaaagtcagatctaacgctgccctgggggcgattttcacagacgagaataagtggaaatccgcccgggaagctgttgaggatagccgcttttgggaactcatcgacagagagcggaacctgcacctggagggaaagtgcgaaacctgtgtgtacaatatgatgggcaagcgcgagaaaaagctcggcgaattcgggaaagccaagggatctagagctatttggtatatgtggctgggcgcccggtttcttgagttcgaagccctggggtttctcaacgaggatcattggttctcccgcggaaatagcctgtccggcgtggagggggaaggccttcacagactgggatacatcctccgggacgtcagcaaaaaggagggcggggcgatgtacgctgatgacacggccggatgggacacccgcattacactggaagatctgaagaacgaggaaatggtgaccaatcatatgaaaggcgagcacaagaaactcgccgaggctatctttaagctgacatatcagaacaaagttgtgagagtccagcggcccaccccgcgcgggacggtgatggacatcatttctagacgggatcagcgcggaagcggccaagttgggacatacggccttaataccttcacaaacatggaagcccagctgatcagacagatggagggagaaggcattttcaagtccatccaacatctcaccgtgacggaggagattgctgtccagaattggctggcccgggtggggagagaacgcctttctcggatggcgatcagcggagacgattgcgttgtgaagcctctggacgatagatttgcctccgctctcaccgccctgaacgacatgggcaaagtccgcaaggatatccagcagtgggagccctctcgggggtggaatgactggacacaagtgcccttctgcagccaccactttcatgaactggtcatgaaagatggaagagtgctcgttgtgccttgtcgcaaccaggacgagctgattggccgggctagaatctcccagggggccggctggtctcttaaggaaaccgcgtgcctgggaaaaagctatgcccagatgtggacactcatgtacttccaccgccgggatctgagacttgctgccaacgctatttgttccgccgtcccgagccattgggtgcccacctctcgcacaacctggtccatccacgctaagcacgagtggatgacgacagaggacatgctggccgtgtggaatcgggtttggattcaagaaaacccttggatggaggacaagacccccgtggaaagctgggaggaagtcccttatctcggcaaaagagaggatcagtggtgcgggtctctgatcggactgacctcccgggcgacatgggccaagaatattcagaccgctatcaaccaggtgagaagcctcatcggcaatgaggaatacacagactatatgccctccatgaaacgctttcggagagaggaagaggaagccggggttctgtggtga

SEQ ID NO: 20004 - RNA, 9876 nt, synthetic construct
  misc_feature 1..9876: note = derived and/or modified CDS sequence (opt5) from DENV-2__EU482594__SS-prME
  source 1..9876: mol_type = other RNA
accgcgggcgtgatcattatgctgatccccaccgctatggccttccacctcacgacccggaacggggaacctcatatgattgtcggacggcaggaaaagggcaaatccctgctttttaagaccgaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtggccgaaaaggacagcccggtcaacattgaggctgaacccccttttggggattcttacatcattatcggcgtggagcccggacagctgaaacttaattggttcaagaagggctccagcatcgggcagatgtttgagacaaccatgagaggagccaaacgcatggccattctgggcgacacagcttgggatttcgggtctctcggaggcgtttttaccagcatcgggaaggccctgcaccaagtgttcggcgcgatttacggagctgccttttccggcgtctcttggacgatgaaaatcctgattggggtgatcatcacatggattggaatgaacagccggtccaccagcctttctgtgtccctcgttctggtcggcgtggtgaccctgtatctcggggccatggtccaggctgacagcggatgtgtggtttcttggaagtccaaagaactgaagtgcggcagcgggatcttcattacagataatgtgcacacctggacagagcagtacaagtttcagcctgaatccccctctaaacttgccagcgctatccaaaaggcccatgaggaaggcatttgtggaatcagatccgtcacgcgcctggagaacctcatgtggaaacagatcaccccggagctgaatcacattctgtctgaaaacgaggtgaaacttacaatcatgaccggcgacattaaagggatcatgcaggcgggaaagcggagcctcagacctcagcccacagaactgaaatattcctggaagacctggggcaaggccaaaatgctgagcacggagtctcataatcaaaccttcctcattgatgggcctgaaacagctgagtgccccaacaccaatcgcgcctggaactccctggaggttgaagactacggatttggcgtgttcacaaccaatatctggcttaagctgcgggagaaacaggacgtcttttgtgatagcaagctcatgtctgctgccatcaaagacaacagagcggtgcacgccgatatgggctattggattgaatccgctctgaatgacacatggaagatggagaaggccagcttcatcgaggttaaatcttgccactggcctaagagccataccctgtggtccaacggggtgcttgaaagcgagatgattatccccaaaaatttcgctggaccggtctctcagcacaactaccgccctggctatcatacgcagacagccgggccctggcacctcggaaagctggaaatggattttgacttctgtgagggcaccaccgtggtggtcacagaagattgcgggaaccggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaatctcgttaactctctggtgaccgctggccatgggcaaattgataattttagcctgggagtgcttggcatggccctcttcctggaagagatgctgagaacacgcgtcgggaccaaacacgccatcctcctggtggctgtttcctttgtgacgcttatcaccggaaacatgtctttccgggacctgggcagagtcatggtgatggttggcgccacaatgaccgatgacattgggatgggaatcacatatctcgccctgctggctgcctttaaggtgcgccctaccttcgcggctggccttctgctcaaaaagctgacgagcaaagagctcatgatggccacaattgggatcgccctgctttcccagtctaccattcccgaaacaatcctggagctcaccgatgctctggccctgggaatgatggtccttaagatcgtgagaaatatggaaaagtaccagctggcggttaccattatggctatcagctgcgtgcctaacgccgtcattctccaaaatgcctggaaagtgtcctgtacaatcctggctgccgtgagcgtctctcccctcctgcttacgtccagccagcagaaggctgactggattcctctggccctcaccatcaaaggcctgaaccccacagcgatctttctgaccacactttctcggacctccaagaaacgcagctggccgctgaatgaggccattatggctgttgggatggtgtctatcctcgcctccagcctgctcaagaacgacattcctatgacgggacccctggtggctggcggccttctgacagtctgctatgtgctgaccgggagatccgccgatctcgaactggagcgggccgctgacgttaaatgggaggatcaggcggaaatcagcggatctagccctattctttccatcaccatttctgaggacggcagcatgtccatcaagaatgaagaggaggaacaaacactgaccatcctcattcgcacagggctgctcgtgatctctggagtcttccccgtgagcattccgatcacggccgctgcctggtacctgtgggaggttaagaaacagagagccggcgtgctttgggatgtcccttctccccctcccgtggggaaggctgaactggaggacggagcctatcggattaaacagcgcggcatcctgggctacagccagatcggggcgggagtctataaggaaggcacctttcacacaatgtggcatgtgaccagaggggctgttctcatgcaccggggaaaacgcattgagcccagctgggccgatgtgaagaaggacctgatctcctacggcgggggatggaaacttgagggcgaatggaaggagggcgaagaggtccaagtgctggccctcgaacctgggaaaaacccgagagctgttcagacaaagcccggactgttcaaaaccaatacgggcaccattggggccgtgagcctcgatttttctcctggaacatccggcagccccatcgtcgaccggaaggggaaggtggtgggactgtacggcaacggcgttgtcaccagatctggggcgtatgtgtccgctattgcccagacagagaaaagcatcgaggataatcctgaaatcgaggacgatattttccgcaagaaacggcttaccatcatggacctgcatcccggagccggcaagacaaaaagatacctgcctgctattgtgcgcgaagccatcaagcgggggctcagaacgctgattcttgctccgacccgcgtcgtggccgcggagatggaagaggccctgcggggactccccatcagatatcagacccctgctattcgcgccgagcacaccggccgggaaatcgttgacctgatgtgtcatgctaccttcacaatgagactcctgtcccccgtgcgggtccctaactacaaccttatcattatggatgaggcccactttacggaccccgcctctatcgctgcgcgcgggtatattagcaccagagtggaaatgggcgaggccgctggaatcttcatgacagccaccccgcctggctcccgggatccctttccccaaagcaatgcccctattatggacgaggaacgcgagatccccgaaagatcttggaactccgggcacgagtgggttacagatttcaagggaaaaaccgtgtggtttgtccctagcatcaaggctggcaatgacattgccgcgtgcctgcggaaaaacgggaagaaagtgatccagctgtctagaaagacgttcgatagcgaatacgttaagacacgcgctaatgactgggattttgtggtcaccaccgacatttccgagatgggagccaacttcaaagccgagcgggtgatcgatccgagacgctgtatgaagcccgtgattctcacagaaggcgaggaacgggtcatcctggctgggcctatgcccgttacccattctagcgccgcgcagagacgcggccggatcggaagaaatcctaaaaacgagaatgaccaatatatttacatgggcgaaccccttgagaacgacgaggattgcgcccactggaaggaagctaaaatgctgctcgacaatatcaacacaccggaggggattatcccttccatgtttgaacccgagcgcgaaaaggtggatgccattgacggagagtacagactgcggggcgaggctcgcaaaaccttcgtggatctgatgagaagaggggacctccctgtctggcttgcctatcgcgtggctgccgaaggaatcaattacgcggatagacggtggtgttttgacggcattaagaacaatcagatcctggaggaaaacgttgaggtggagatctggacgaaggaaggggagcgcaagaagctgaaaccccgctggctcgatgcccggatttattctgaccctctggctcttaaggagttcaaagagttcgccgctggcagaaagagcctgacactcaacctgatcaccgaaatgggacgcctgcccacatttatgacccagaaggcccgggatgccctcgacaatcttgctgtcctgcatacggcggaggccggcgggagagcttacaaccacgccctgtccgagctcccggaaaccctggagacacttctgctcctgaccctgctcgccacagtgaccggaggcattttcctttttctgatgagcgggaaaggaatcggcaagatgacactgggcatgtgctgcattatcaccgcttctatcctcctgtggtatgcccagattcaacctcactggatcgcggcctccattatccttgagttctttctgattgttctcctgatccccgagcccgaaaaacagcggacgcctcaggataatcagctgacatacgtggtcatcgctattctcaccgtggtcgccgctaccatggccaacgagatggggttccttgagaagaccaaaaaggacctgggactgggcagcatcgcgacccaagaatccgagtctaatattctcgacatcgatctgcgcccggccagcgcttggacactttatgccgtggctacgacctttgttacacccatgctgagacattccattgaaaactctagcgtgaatgtgtccctcaccgccatcgctaaccaggccacagtcctgatggggctgggaaagggctggcctctcagcaaaatggacattggggttccccttctggcgatcggatgttactctcaggtgaatcctatcaccctgacggccgctctcctgcttctggtggcccactacgctattatcggccccggcctccaggccaaggccacccgggaggcgcaaaaacgcgctgccgctgggattatgaagaaccctacagtcgatggaatcaccgtgattgacctggaaccgatcccctatgatcctaaattcgagaagcagctgggccaggttatgctccttatcctgtgcgtgacacaggtcctgatgatgagaaccacgtgggccctctgtgaggccctgacacttgctaccgggcccatttccacactgtgggaaggaaatcctggccggttttggaacaccaccatcgccgtgagcatggcgaatattttccgcgggtcttacctcgccggagctggcctgctgttttccatcatgaagaacacaacgaataccagacggggcacagggaacattggagagaccctcggcgaaaaatggaaaagccgccttaatgccctggggaagtctgagttccaaatctataagaaaagcggaatccaggaggtcgacagaacactggctaaggaaggcattaaaagaggggaaaccgatcatcacgccgtgtccagaggatctgcgaagctccgctggtttgttgaacggaacatggtgacgcccgagggcaaggtcgtggacctgggctgcgggagaggaggctggagctactattgtgggggacttaaaaacgttcgcgaagtgaagggcctgacaaaagggggaccgggccatgaggagcctatccccatgtccacctacggctggaatctcgtccggctgcagagcggggtggatgtgttcttcacaccccctgaaaagtgcgacacactgctctgtgatattggagagtcctctcccaaccctaccatcgaagccggcagaacacttcgcgttctgaatctggtcgagaactggctcaataacaatacgcaattttgcattaaagtgctgaacccgtatatgcccagcgtgatcgaaaagatggagacccttcagcggaagtacgggggagctctggtcagaaatcctctctcccgcaactctacacacgagatgtactgggttagcaatgccaccggcaacatcgtgtcctctgtgaatatgattagccggatgctgatcaacagattcacaatgaaacacaagaaagctacctatgaacccgacgtcgatctggggtccggaacgcgcaatattggcatcgagagcgaaattcctaacctcgacatcattggcaagcggatcgagaaaatcaagcaggaacatgagacctcttggcactacgaccaggatcatccctataagacatgggcctaccacgggtcctatgagaccaaacaaacaggaagcgcttcttccatggtgaacggcgttgtgagacttctgaccaagccgtgggacgtcgtgcctatggttacacagatggccatgaccgatacgacaccctttgggcagcagcgcgtgttcaaagaaaaggtcgacaccagaacccaagagcctaaagaaggaacaaagaagctgatgaaaattacggcggagtggctctggaaggagctgggcaaaaagaaaacaccccggatgtgtacacgcgaagagtttaccagaaaggtgcggagcaatgccgctcttggggccatcttcacagatgaaaacaaatggaagtctgctagagaggccgtggaagactcccggttttgggagctgattgatcgcgagagaaatctccacctggaaggaaagtgcgagacctgtgtctacaacatgatgggcaaacgggaaaagaaactgggcgagttcgggaaggccaaaggaagccgcgcgatctggtatatgtggctcggcgctagatttctggagttcgaggcccttgggtttctgaatgaggaccattggttctcccggggaaacagcctctctggcgttgaaggggagggcctgcaccgccttggatacattctgagagatgtgagcaagaaggaaggcggggccatgtacgctgacgatacagccggatgggacacccggatcacgctcgaggacctgaaaaatgaagagatggtgaccaaccatatgaagggcgagcacaaaaagctggctgaagccatctttaaactcacatatcagaataaggtcgtgcgcgttcagagacctacaccccgggggacagtgatggatattatctcccgcagagaccagcggggatctggccaagtcgggacctacggcctgaacacgttcacaaatatggaggcgcagcttattcgccagatggaaggagagggcatcttcaagagcattcaacatctgaccgtgacagaggaaatcgccgttcagaactggctcgctagagtggggcgggagagactgtcccgcatggccatctctggagatgactgcgtcgtgaaaccgcttgatgaccggtttgctagcgccctgaccgcgctcaatgatatgggcaaggttagaaaagacattcagcagtgggaaccttcccgcgggtggaacgattggacgcaagtgcccttctgctctcaccactttcatgagctggtcatgaaggacggacgggtgctggtcgtgccctgtagaaatcaggatgaactcatcggccgcgcccggattagccagggggctggctggtccctgaaagagaccgcctgccttggaaagagctatgctcagatgtggacactgatgtacttccacagacgcgacctccggctggccgctaacgccatctgttctgcggttccttcccattgggtgccgaccagcagaacaacctggtctattcacgccaagcacgagtggatgacaaccgaagatatgcttgctgtctggaaccgcgtgtggatccaagagaatccctggatggaagacaaaacgcctgtggagtcctgggaagaggttccctatctgggcaagcgggaggaccagtggtgcgggagcctcattggactgacatccagagccacctgggccaaaaacatccagaccgctatcaatcaggtgcggtctctgattggcaacgaagagtacacagattatatgcctagcatgaagagatttcgccgggaagaggaagaggccggggtcctctggtga

SEQ ID NO: 20005 - RNA, 9876 nt, synthetic construct
  misc_feature 1..9876: note = derived and/or modified CDS sequence (opt5) from DENV-2__EU482604__SS-prME
  source 1..9876: mol_type = other RNA
accgccggcgtgatcattatgctgatccccacagctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgagacaaaatgaacccgaggatatcgactgttggtgcaatagcacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatctgtggaattagaagcgtgacccgccttgagaatctgatgtggaaacagatcacaccggagctcaaccacattctgtccgaaaatgaggtcaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccgtgagctttgttacactgattaccggaaatatgtccttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatggtcctgaaaatcgtgcggaacatggaaaagtaccaacttgctgttaccattatggccatctcttgcgtgcctaatgcggtcattctgcgcaacgcttggaaggtgagctgtacaatcctcgccgccgtgtccgtcagccccctgctcctgacctcttcccagcagaaagctgactggattcctcttgccctgacaatcaagggcctcaatcccaccgctatctttctgacgacactgagcagaacctctaaaaagcggtcctggccgcttaacgaggccattatggcggttgggatggtgagcatcctggcctcttccctcctgaaaaatgacattcctatgaccggacccctcgtggctggcggcctgcttacagtctgctatgtgctgaccgggcgcagcgccgatctggaactcgagagagctgccgacgttaagtgggaggatcaggccgaaatctccggaagctctcctattctgagcatcacaatttccgaggacggctctatgagcatcaaaaacgaagaggaggaacaaacgcttaccatcctgattcggacagggctcctggtgatctccggagtcttccccgtgtctattccgatcaccgctgcggcctggtacctctgggaggttaagaagcagcgcgctggcgtgctgtgggatgtcccttctccccctcccgtggggaaagccgaacttgaggacggagcctatagaattaagcagcggggcatcctgggctactcccagatcggggctggagtctataaagaaggcacatttcacaccatgtggcatgtgacgcgcggggccgttctgatgcacagaggaaagcggattgagccctcctgggcggatgtgaaaaaggacctcatcagctacggcgggggatggaagctggagggcgaatggaaagagggcgaagaggtccaagtgcttgctctggaacctgggaagaatccgagagccgttcagaccaaacccggaattttcaagacaaacaccggcacaatcggggccgtgtccctcgattttagccctggaacctctggctcccccattgtcgaccgcaaagggaaggtggtgggactgtacggcaatggcgttgtcacacggagcggggcttatgtgtctgccatcgcgcagacggagaagtccatcgaggataaccctgaaattgaggacgatatcttccgcaagaagcgcctcaccattatggacctgcatcccggagctggcaaaacaaagcggtaccttcctgccatcgtgagagaagccattaaacgcgggctgcggaccctgatcctcgctccgaccagagtcgtggccgctgagatggaagaggccctgcgcggacttcccattcggtatcagacccctgcgatcaaggccgagcacacgggcagagaaatcgttgacctgatgtgtcatgctaccttcacaatgcggctcctgagccccgtgcgcgtccctaactacaatctcattatcatggatgaggcccactttaccgaccccgcttccattgccgccagagggtatatctctacacgggtggaaatgggcgaggctgcgggaattttcatgaccgccacgccgcctggcagccgcgatccctttccccaatccaacgctcctatcatggacgaggaaagagagatccccgaacggagctggaactctgggcacgagtgggttacagatttcaagggaaaaaccgtgtggtttgtcccttccattaaggccggcaacgacatcgccgcttgcctgcgcaagaatgggaagaaagtgattcagcttagccgcaagaccttcgattctgaatacgttaagacacgggccaacgactgggattttgtggtcaccacagacatcagcgagatgggagcgaatttcaaagctgagagagtgattgatccgcgccggtgtatgaagcccgtgatcctgaccgacggcgaagagagagtcatcctggccgggcctatgcccgttacgcattcctctgccgctcagcgccggggcagaattggacgcaaccctaaaaatgaaaacgaccaatatatctacatgggcgagcccctcgaaaatgatgaggactgcgcccactggaaggaggcgaaaatgctgcttgataacattaatacaccggaagggatcattcctagcatgtttgagcccgaaagagagaaggtggacgccatcgatggagaataccggctgcgcggcgaggctagaaaaaccttcgtggacctcatgcggcgcggggatctgcctgtctggctggcctataaggtggctgccgagggaattaactacgctgacagaaagtggtgttttgatggcatcaaaaataaccagatcctcgaagagaacgttgaagtggagatttggacaaaggagggggaacggaagaaacttaaacccagatggctggacgcccgcatctattccgatcctctggcgctcaaagagttcaaggagttcgccgctggccggaaatctctgacccttaatctgattacggagatgggaagactccccacctttatgacacagaaggcccgcaacgctctggacaatctggccgtcctccataccgccgaagctggcgggcgggcgtacaaccacgcccttagcgagctgccggagacactggaaaccctcctgcttctgacactcctggctaccgtgacgggaggcatcttcctgtttctcatgtccgggaaaggaattggcaagatgacacttggcatgtgctgcatcatcaccgccagcgttctgctgtggtatgcccagattcaacctcactggatcgctgcctctattatcctcgagttctttctgattgtgcttctgatccccgaacccgagaaacagagaacccctcaggataatcagctcacatacgtcgtgatcgcgattctgaccgtcgtggccgctacaatggccaacgaaatggggttcctggagaagacgaagaaagacctcggacttggctccatcaccacacaagagagcgaatccaatattctggacatcgatctgcggccggcttctgcctggaccctctatgcggttgccacaacctttgtgacgcccatgctgcgccatagcattgagaactcctctgtgaatgtcagccttaccgctatcgccaaccaggctacagttctgatggggctcggaaagggctggcctctgtccaaaatggacattggggtgcccctgctcgccatcggatgttacagccaggtgaatcctatcacccttacagctgccctgctgctcctggtcgcgcactacgccattatcggccccggccttcaggctaaggccaccagagaagctcaaaaacgggccgccgcggggattatgaagaaccctacggtggatggaatcacagttattgacctggagccgatcccctatgatcctaagttcgaaaaacagctcggccaggtgatgctgctgatcctctgcgtcacccaggtgcttatgatgcgcacaacctgggctctgtgtgaggccctgaccctcgctacagggcccatttctacgctgtgggagggaaatcctggcagattttggaacaccacaatcgccgtctccatggccaatattttccgggggagctaccttgctggagccggcctgctcttttctatcatgaagaacaccacaaatacccgcagaggcacggggaacattggagaaacactgggcgagaaatggaagtcccggctgaacgcgctcgggaaaagcgagttccaaatctataagaaatctggaatccaggaggtggaccgcacccttgccaaggagggcattaagagaggggaaaccgatcatcacgctgttagccggggatccgccaaactgagatggtttgtggagcgcaatatggtcacacccgaaggcaaggtggttgacctgggctgcgggcggggaggctggtcttactattgtgggggactcaaaaacgtgagagaggtcaagggcctgaccaaagggggaccgggccatgaagaacctatccccatgagcacatacggctggaatcttgtgcgcctgcagtccggggtggatgttttcttcacgccccctgagaagtgcgacaccctcctgtgtgatattggagaaagctcccccaaccctacaatcgaggctggccggaccctgagagtcctcaatcttgtggaaaactggctgaataacaatacacaattttgcattaaggtgctgaacccgtatatgccctctgtcatcgagaaaatggaaaccctccagcgcaagtacgggggagccctggttcggaatcctcttagcagaaactccacgcacgagatgtactgggtgtctaatgcgaccggcaacatcgtgagctccgtcaatatgatttctcgcatgctgatcaaccggttcacaatgaaacacaagaaagccacctatgagcccgacgtggatctcgggagcggaacaagaaacattggcatcgaatccgagattcctaatctggacatcattggcaagcgcatcgaaaagatcaaacaggagcatgaaaccagctggcactacgaccaggatcatccctataagacatgggcttaccacgggtcttatgagaccaaacaaacgggatccgccagctctatggttaacggcgtggtccggctgctcacaaagccgtgggacgtggttcctatggtgacccagatggctatgaccgatacaacgccctttgggcagcagagagtcttcaaagagaaggtggacacccgcacacaagaacctaaggagggaaccaagaaacttatgagaattacagccgaatggctgtggaaagagctgggcaaaaagaaaacaccccggatgtgtacacgcgaggaatttaccagaaaagtgcggtccaatgctgccctcggggcgatcttcacggatgagaacaagtggaaaagcgccagagaagctgtcgaggacggacggttttgggaactggttgataaagagcgcaatcttcacctggagggcaagtgcgaaacctgtgtgtacaacatgatgggcaaaagagagaagaaactcggggagttcggaaaggccaagggctctcgggctatttggtatatgtggctgggggcccgctttctggagttcgaagccctcggatttctgaatgaggaccattggttctccagaggcaacagcctttccggggtggagggcgaaggactgcaccggctcggctacatcctgcgcgatgtcgggaaaaaggagggaggcgcgatgtacgctgacgatacagccgggtgggacaccagaattacacttgaagacctgaaaaatgaggaaatggtgaccaaccatatgaagggagagcacaaaaagctcgccgaggctatctttaagctgacgtatcagaataaagttgtgcgggtccagcgccctacacccagaggcaccgtgatggatatcattagccggcgcgaccagagagggtctggccaagttggaacatacggcctgaacaccttcacgaatatggaagcccagctcatccggcagatggagggggaaggaattttcaagagcatccaacatctgaccgctacagaggagattgccgtgcagaactggcttgcgcgcgtcggcagagaacggctgtccagaatggccatctctggggatgactgcgtggttaaaccgatcgatgaccgctttgctagcgccctcaccgctctgaatgatatgggaaaggtgcggaaagacattcagcagtgggagccttccagaggctggaacgattggacacaagtccccttctgctctcaccactttcatgaacttgtgatgaaggacgggcgcgtcctggtggttccctgtcggaaccaggatgagctcatcggcagagcccgcattagccagggagcgggctggtccctgaaggaaaccgcctgcctggggaaatcttatgctcagatgtggacactcatgtacttccaccggagagacctgcgccttgccgctaatgccatctgtagcgctgtgccttcccattgggtcccgaccagccggacgacatggtctattcacgccaagcacgagtggatgaccaccgaggatatgctggcggtgtggaacagagtgtggatccaagaaaatccctggatggaggacaaaacacctgttgaatcctgggaggaagtgccctatctcggaaagcgcgaggaccagtggtgcggcagcctgattgggcttacctctcgggccacatgggctaaaaacatccagacggccatcaatcaggtcagatccctgattggaaacgaggaatacaccgattatatgcctagcatgaagcggtttagacgcgaggaagaggaagccggcgtgctctggtga

SEQ ID NO: 20006 - RNA, 9876 nt, synthetic construct
  misc_feature 1..9876: note = derived and/or modified CDS sequence (opt5) from DENV-2__EU482605__SS-prME
  source 1..9876: mol_type = other RNA
accgccggcgtgatcattatgctgatccccacagctatggccttccacctcacgaccagaaatggggaacctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctggtgaccggccatctcaaatgcagactgcggatggataaacttcaactgaaagggatgtcttacagcatgtgtaccggaaagtttaagattgtcaaagaaatcgcggagacacagcacggcacgatcgtgattagaatccagtatgagggggacggatccccctgcaagattcccttcgaaatcaccgatctcgagaaacgccatgtcctgggccggctgattacagtgaaccctatcgttattgaaaaggacagcccggtgaacatcgaggccgaaccccctttcggggattcttacatcattatcggcgtcgagcccggacagctcaaactgaattggtttaagaagggctccagcattgggcaaatgttcgagaccacaatgagaggagctaaacgcatggccatccttggcgacaccgcctgggattttgggtctctgggaggcgtgttcacgagcattgggaaggctctccaccaggtttttggcgccatctacggagcggctttctccggcgtgtcttggacaatgaaaatcctgattggggtcgtgatcacctggattggaatgaacagccggtccaccagcctgtctgtgtcccttgttctcgtcggcgtggtgacactgtatctgggggccatggtccaggccgacagcggatgtgtggtttcttggaagaataaagaactcaagtgcggctccgggatctttattaccgataacgtgcacacatggacggagcagtacaagttccaacctgaaagcccctccaaactggcttctgccatccagaaggctcatgaggaaggcatctgtggaattagaagcgtcacccgccttgagaatctgatgtggaaacagatcacaccggagctcaaccacattctgtccgaaaatgaggtgaagctgaccatcatgacaggcgacaccaaagggattatgcaggccggaaagcggtctcttagacctcaacccacggaactcaaatatagctggaagacctggggcaaggcgaaaatgctgtccacagagagccataaccagacctttctgatcgatgggcctgaaacagccgagtgccccaataccaaccgcgcttggaactctctcgaggttgaagactacggattcggcgtgtttacaaccaacatctggctgaaacttcgggagaaacaggacgtcttctgtgattccaagctgatgagcgccgctattaaagacaatagagccgtgcacgcggatatgggctattggatcgaatctgccctcaacgacacgtggaagatggagaaggcttcctttattgaggttaaaagctgccactggcctaagtctcatacactgtggagcaatggggtgctggaatccgagatgatcattcccaaaaacttcgccggaccggtcagccagcacaactaccgccctggctatcatacccaaaccgctgggccctggcaccttggaaagctcgaaatggatttcgacttttgtgagggcacaaccgtggtggtcacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggttaattccctcgtgaccgccggccatgggcagatcgataacttctctctgggagtgctgggcatggctctttttctcgaagagatgctgagaacgcgcgtcgggaccaaacacgcgatcctgctcgtggccgttagcttcgtgacactgattaccggaaatatgtcctttcgggaccttggcagagtcatggtgatggttggcgctacaatgaccgatgacatcgggatgggagtgacgtatctggccctcctggccgctttcaaggtccgccctacatttgccgcgggcctgcttctgagaaaactcacctctaaggagctgatgatggctacaattgggatcaccctcctgagccagtccaccattcccgaaacaatccttgagctgacggatgccctcgccctgggaatgatggtgctgaaaatcgttcggaacatggaaaagtaccaacttgctgtgaccattatggccatctcttgcgtccctaatgcggtgattctgcgcaacgcttggaaggtgagctgtacaatcctcgccgccgtctccgttagccccctgctcctgacctcttcccagcagaaagctgactggattcctcttgccctgacaatcaagggcctcaatcccaccgctatcttcctgacgacactgagcagaacctctaaaaagcggtcctggccgcttaacgaggccattatggcggtggggatggtgagcatcctggcctcttccctcctgaaaaatgacattcctatgaccggacccctcgtcgctggcggcctgcttacagtgtgctatgttctgaccgggcgcagcgccgatctggaactcgagagagctgccgacgtgaagtgggaggatcaggccgaaatctccggaagctctcctattctgagcatcacaatttccgaggacggctctatgagcatcaaaaacgaagaggaggaacaaacgcttaccatcctgattcggacagggctcctggtcatctccggagtgtttcccgtttctattccgatcaccgctgcggcctggtacctctgggaggtgaagaagcagcgcgctggcgtcctgtgggatgtgccttctccccctcccgtcgggaaagccgaacttgaggacggagcctatagaattaagcagcggggcatcctgggctactcccagatcggggctggagtgtataaagaaggcacattccacaccatgtggcatgttacgcgcggggccgtgctgatgcacagaggaaagcggattgagccctcctgggcggatgtcaaaaaggacctcatcagctacggcgggggatggaagctggagggcgaatggaaagagggcgaagaggtgcaagttcttgctctggaacctgggaagaatccgagagccgtgcagaccaaacccggaatttttaagacaaacaccggcacaatcggggccgtctccctcgatttcagccctggaacctctggctcccccattgtggaccgcaaagggaaggtggttggactgtacggcaatggcgtcgtgacacggagcggggcttatgtgtctgccatcgcgcagacggagaagtccatcgaggctaaccctgaaattgaggatgccatctttcgcaagaagcgcctcaccattatggacctgcatcccggagccggcaaacctaagcggagccttccggctatcgtcagagaagccattaaacgcgggctgcggcccctgatcctcgctcctcccagagtggttcctgccgagatggaggaacccctgcgcggacttccgattcggtaccagacccctgcgatcaagcccgatcacaccggcagagagatcgtggccctgatgtgtcatgctcccttcaccatgcggctcctgtcccctgtccgcgtgcccaactataatctcattatcatggacgaagcccacttcacagaccctgcttctattgccgccagagggtacatcagcacgcgggttgagatgggcgaagctgcgggaatttttatgaccgccacaccgcccggctcccgcgatcctttcccccaaagcaacgctcctatcatggacgaggagagagaaatccccgagcggtcttggaatagcgggcacgaatgggtgaccgattttaagggaaaaacagtctggttcgtgccgagcattaaggccggcaacgacatcgccgcttgcctgcgcaagaatgggaagaaagttattcagctttctcgcaagacctttgatagcgagtatgtgaagacgcgggccaacgactgggatttcgtcgtgacaaccgacatctccgaaatgggagcgaattttaaagctgagagagtgattgatcctcgccggtgtatgaagcccgtcatcctgaccgacggcgaggaaagagttatcctggccgggcctatgcccgtgacacattctagcgccgctcagcgccggggcagaattggacgcaaccctaaaaatgagaacgatcaatacatctatatgggcgaacccctcgagaatgacgaagactgcgcccactggaaggaggcgaaaatgctgcttgataacattaataccccggaggggatcattccttccatgttcgaacccgagagagaaaaggtggacgccatcgatggagagtaccggctgcgcggcgaagctagaaaaacatttgtcgacctcatgcggcgcggggatctgcccgtgtggctggcctacaaggttgctgccgagggaattaactatgctgacagaaagtggtgtttcgatggcatcaaaaataaccagatcctcgaggaaaacgtggaggtcgaaatttggaccaaggagggggagcggaagaaacttaaacctagatggctggacgcccgcatctactctgatccgctggcgctcaaagaatttaaggagttcgccgctggccggaaaagcctgacgcttaatctgattacagaaatgggaagactccccaccttcatgacacagaaggcccgcaacgctctggacaatctggccgtgctccataccgccgaggctggcgggcgggcgtataaccacgccctttccgaactgcctgagacgctggagaccctcctgcttctgacactcctggctaccgttacaggaggcatctttctgttcctcatgagcgggaaaggaattggcaagatgacccttggcatgtgctgcatcatcacagcctctgtgctgctgtggtacgcccagattcaaccccactggatcgctgcctccattatcctcgaatttttcctgattgtccttctgatccctgagcccgaaaaacagagaacccctcaggataatcagctcacgtatgtggtcatcgcgattctgacagtggttgccgctaccatggccaacgagatggggtttctggaaaagaccaagaaagacctcggacttggcagcatcacaacccaagagtccgagtctaatattctggatatcgacctgcggccggctagcgcctggacactctacgcggtggccacgaccttcgtgacacccatgctgcgccattccattgaaaactctagcgtcaatgtttcccttaccgctatcgccaaccaggctacagtgctgatggggctcggaaagggctggcctctgagcaaaatggacattggggtgcccctgctcgccatcggatgttattctcaggtcaatcctatcacccttacggctgccctgctgctcctggtggcgcactacgccattatcggccccggccttcaggctaaggccaccagagaggctcaaaaacgggccgccgcggggattatgaagaacccgacagttgatggaatcaccgtgattgacctggaacctatcccctacgatcccaagtttgagaaacagctcggccaggtcatgctgctgatcctctgcgtgacacaggtccttatgatgcgcaccacgtgggctctgtgtgaagccctgacactcgctaccgggcctatttccacactgtgggagggaaatcccggcagattctggaacaccaccatcgccgtgagcatggccaatatttttcgggggtcttatcttgctggagccggcctcctgttctccatcatgaagaacacaacgaatacccgcagaggcacagggaacattggagagaccctgggcgaaaaatggaaaagccggctgaacgcgctcgggaaatctgagtttcaaatctacaagaaaagcggaatccaggaagttgaccgcacacttgccaaggagggcattaagagaggggagaccgatcatcacgctgtgtcccggggatctgccaaactgagatggttcgtcgaacgcaatatggtgacgcctgagggcaaggttgtggacctgggctgcgggcggggaggctggagctattactgtgggggactcaaaaacgtcagagaagtgaagggcctgacaaaagggggaccgggccatgaggaacccatccctatgtccacctatggctggaatcttgtgcgcctgcagagcggggttgatgtctttttcacaccccctgagaagtgcgacaccctcctgtgtgatattggagagtcctctcccaacccgaccatcgaagctggccggacactgagagtgctcaatcttgtggagaactggctgaataacaatacgcaattctgcattaaggtcctgaacccttacatgcccagcgttatcgagaagatggagaccctccagcgcaagtatgggggagccctggtgcggaatcctctttccagaaactctacacacgaaatgtactgggtgagcaatgcgaccggcaacatcgtctcctctgtgaatatgattagccgcatgctgatcaaccggtttacaatgaaacacaagaaagccacctacgagcccgacgttgatctcgggtccggaacgagaaacattggcatcgagagcgaaattcctaatctggacatcattggcaagcgcatcgagaagatcaaacaggaacatgagacctcttggcactatgatcaggaccatccctacaagacatgggcttatcacgggtcctacgaaaccaaacaaacaggaagcgcctcttccatggtgaacggcgtcgtgcggctgctcaccaagccgtgggacgttgtgcctatggtcacacagatggctatgaccgatacgacacccttcgggcagcagagagtgtttaaagagaaggtggacacccgcacccaagagcccaaggaaggaacaaaaagacttatgcggattacggccgagtggctgtggaaggaactgggcaaaaagaaaacccctcgcatgtgtacaagagaggagttcacccggaaggtcagaagcaatgctgccctcggggcgatctttacagatgaaaacaaatggaagtctgcccgggaggctgttgaagacggacgcttctgggagctggtggataaggaaagaaatcttcacctggagggcaaatgcgagacctgtgtgtataacatgatgggcaagcgggagaagaagctcggggagtttggaaaagccaagggctcccgcgctatttggtacatgtggctgggggccagattcctggaatttgaggccctcggattcctgaatgaagaccattggtttagccggggcaactcccttagcggggtcgagggcgagggactgcaccgcctcggctatatcctgagagatgtggggaagaaagaaggaggcgcgatgtacgctgacgatacagccgggtgggacacccggattacgcttgaggatctgaagaatgaagagatggttaccaaccatatgaaaggagaacacaagaaactcgccgaggctatcttcaagctgacataccagaataaggtggtccgcgtgcagagaccgacaccccggggcacagttatggacatcatttctcgcagagaccagcgggggagcggccaagtgggaacctatggcctgaacacgtttacaaatatggaggcccagctcatccgccagatggaaggggagggaattttcaaatccatccaacatctgaccgctacagaagagattgccgtccagaactggcttgcgagagtgggccgggagagactgtctcgcatggccatcagcggggatgactgcgttgtgaagcctatcgatgaccggttcgcttccgccctcaccgctctgaatgatatgggaaaagtcagaaaggacattcagcagtgggaaccctctcgcggctggaacgattggacgcaagtgcctttttgcagccaccacttccatgagcttgtcatgaaagacgggcgggtgctggttgtgccctgtagaaaccaggatgaactcatcggccgcgcccggatttcccagggagcgggctggtctctgaaggagaccgcctgcctgggaaagagctacgctcagatgtggacactcatgtattttcacagacgcgacctgcggcttgccgctaatgccatctgttccgctgtccctagccattgggtgcccacctctagaacaacctggtccattcacgccaaacacgaatggatgacaaccgaggatatgctggcggtgtggaaccgcgtttggatccaagagaatccgtggatggaagacaagacgcctgtggagagctgggaagaggtcccctacctcggaaaacgggaagatcagtggtgcggctctctgattgggcttacatccagagccacctgggctaagaacatccagaccgccatcaatcaggtgcggagcctgattggaaacgaggagtatacagactacatgccttccatgaaaagattccgccgggaagaggaagaggccggcgttctctggtga

SEQ ID NO: 20007 - RNA, 9876 nt, synthetic construct
  misc_feature 1..9876: note = derived and/or modified CDS sequence (opt5) from DENV-2__EU482606__SS-prME
  source 1..9876: mol_type = other RNA
acagccggcgtgatcattatgctgatccccacagctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgagacaaaatgaacccgaggatatcgactgttggtgcaatagcacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatctgtggaattagaagcgtgacccgccttgagaatctgatgtggaaacagatcacaccggagctcaaccacattctgtccgaaaatgaggtcaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccgtgagctttgttacactgattaccggaaatatgtccttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatggtcctgaaaatcgtgcggaacatggaaaagtaccaacttgctgttaccattatggccatctcttgcgtgcctaatgcggtcattctgcgcaacgcttggaaggtgagctgtacaatcctcgccgccgtgtccgtcagccccctgctcctgacctcttcccagcagaaagctgactggattcctcttgccctgacaatcaagggcctcaatcccaccgctatctttctgacgacactgagcagaacctctaaaaagcggtcctggccgcttaacgaggccattatggcggttgggatggtgagcatcctggcctcttccctcctgaaaaatgacattcctatgaccggacccctcgtggctggcggcctgcttacagtctgctatgtgctgaccgggcgcagcgccgatctggaactcgagagagctgccgacgttaagtgggaggatcaggccgaaatctccggaagctctcctattctgagcatcacaatttccgaggacggctctatgagcatcaaaaacgaagaggaggaacaaacgcttaccatcctgattcggacagggctcctggtgatctccggagtcttccccgtgtctattccgatcaccgctgcggcctggtacctctgggaggttaagaagcagcgcgctggcgtgctgtgggatgtcccttctccccctcccgtggggaaagccgaacttgaggacggagcctatagaattaagcagcggggcatcctgggctactcccagatcggggctggagtctataaagaaggcacatttcacaccatgtggcatgtgacgcgcggggccgttctgatgcacagaggaaagcggattgagccctcctgggcggatgtgaaaaaggacctcatcagctacggcgggggatggaagctggagggcgaatggaaagagggcgaagaggtccaagtgcttgctctggaacctgggaagaatccgagagccgttcagaccaaacccggaattttcaagacaaacaccggcacaatcggggccgtgtccctcgattttagccctggaacctctggctcccccattgtcgaccgcaaagggaaggtggtgggactgtacggcaatggcgttgtcacacggagcggggcttatgtgtctgccatcgcgcagacggagaagtccatcgaggataaccctgaaattgaggacgatatcttccgcaagaagcgcctcaccattatggacctgcatcccggagctggcaaaacaaagcggtaccttcctgccatcgtgagagaagccattaaacgcgggctgcggaccctgatcctcgctccgaccagagtcgtggccgctgagatggaagaggccctgcgcggacttcccattcggtatcagacccctgcgatcaaggccgagcacacgggcagagaaatcgttgacctgatgtgtcatcccaccttcacaatgcggctcctgagccctgtgcgcgtccccaactacaatctcattatcatggatgaggctcactttaccgacccggcctccattgctgccagagggtatatctctacacgggtggaaatgggcgaggccgctggaattttcatgaccgcgacgcctcccggcagccgcgatccctttcctcaatccaacgcccccatcatggacgaggaaagagagatccctgaacggagctggaactctgggcacgagtgggttacagatttcaagggaaaaaccgtgtggtttgtcccgtccattaaggctggcaacgacatcgccgcctgcctgcgcaagaatgggaagaaagtgattcagcttagccgcaagaccttcgattctgaatacgttaagacacgggctaacgactgggattttgtggtcaccacagacatcagcgagatgggagccaatttcaaagcggagagagtgattgatccccgccggtgtatgaagcctgtgatcctgaccgacggcgaagagagagtcatcctggctgggcccatgcctgttacgcattcctctgccgcccagcgccggggcagaattggacgcaaccccaaaaatgaaaacgaccaatatatctacatgggcgagccgctcgaaaatgatgaggactgcgctcactggaaggaggccaaaatgctgcttgataacattaatacacctgaagggatcattcccagcatgtttgagcctgaaagagagaaggtggacgcgatcgatggagaataccggctgcgcggcgaggccagaaaaaccttcgtggacctcatgcggcgcggggatctgcccgtctggctggcttataaggtggccgctgagggaattaactacgccgacagaaagtggtgttttgatggcatcaaaaataaccagatcctcgaagagaacgttgaagtggagatttggacaaaggagggggaacggaagaaacttaaacctagatggctggacgctcgcatctattccgatcccctggccctcaaagagttcaaggagttcgcggccggccggaaatctctgacccttaatctgattacggagatgggaagactcccgacctttatgacacagaaggctcgcaacgccctggacaatctggctgtcctccataccgccgaagccggcgggcgggcttacaaccacgcgcttagcgagctgcctgagacactggaaaccctcctgcttctgacactcctggccaccgtgacgggaggcatcttcctgtttctcatgtccgggaaaggaattggcaagatgacacttggcatgtgctgcatcatcaccgctagcgttctgctgtggtatgcccagattcaaccccactggatcgccgcttctattatcctcgagttctttctgattgtgcttctgatccccgaacctgagaaacagagaaccccgcaggataatcagctcacatacgtcgtgatcgccattctgaccgtcgtggcggccacaatggctaacgaaatggggttcctggagaagacgaagaaagacctcggacttggctccatcaccacacaagagagcgaatccaatattctggacatcgatctgcggcccgcctctgcttggaccctctatgccgttgcgacaacctttgtgacgcctatgctgcgccatagcattgagaactcctctgtgaatgtcagccttaccgccatcgctaaccaggccacagttctgatggggctcggaaagggctggcccctgtccaaaatggacattggggtgcctctgctcgctatcggatgttacagccaggtgaatcccatcacccttacagccgctctgctgctcctggtcgcccactacgcgattatcggccctggccttcaggccaaggctaccagagaagcccaaaaacgggctgccgccgggattatgaagaacccgacggtggatggaatcacagttattgacctggagcccatcccttatgatcccaagttcgaaaaacagctcggccaggtgatgctgctgatcctctgcgtcacccaggtgcttatgatgcgcacaacctgggcgctgtgtgaggctctgaccctcgccacagggcctatttctacgctgtgggagggaaatcccggcagattttggaacaccacaatcgctgtctccatggccaatattttccgggggagctaccttgccggagctggcctgctcttttctatcatgaagaacaccacaaatacccgcagaggcacggggaacattggagaaacactgggcgagaaatggaagtcccggctgaacgccctcgggaaaagcgagttccaaatctataagaaatctggaatccaggaggtggaccgcacccttgcgaaggagggcattaagagaggggaaaccgatcatcacgccgttagccggggatccgctaaactgagatggtttgtggagcgcaatatggtcacaccggaaggcaaggtggttgacctgggctgcgggcggggaggctggtcttactattgtgggggactcaaaaacgtgagagaggtcaagggcctgaccaaagggggacctggccatgaagaacccatccccatgagcacatacggctggaatcttgtgcgcctgcagtccggggtggatgttttcttcacgcctcccgagaagtgcgacaccctcctgtgtgatattggagaaagctcccctaacccgacaatcgaggccggccggaccctgagagtcctcaatcttgtggaaaactggctgaataacaatacacaattttgcattaaggtgctgaacccctatatgccttctgtcatcgagaaaatggaaaccctccagcgcaagtacgggggagctctggttcggaatccccttagcagaaactccacgcacgagatgtactgggtgtctaatgccaccggcaacatcgtgagctccgtcaatatgatttctcgcatgctgatcaaccggttcacaatgaaacacaagaaagcgacctatgagcctgacgtggatctcgggagcggaacaagaaacattggcatcgaatccgagattcccaatctggacatcattggcaagcgcatcgaaaagatcaaacaggagcatgaaaccagctggcactacgaccaggatcatccgtataagacatgggcctaccacgggtcttatgagaccaaacaaacgggatccgctagctctatggttaacggcgtggtccggctgctcacaaagccttgggacgtggttcccatggtgacccagatggccatgaccgatacaacgccttttgggcagcagagagtcttcaaagagaaggtggacacccgcacacaagaacccaaggagggaaccaagaaacttatgagaattacagctgaatggctgtggaaagagctgggcaaaaagaaaacccctcggatgtgtacacgcgaggaatttaccagaaaagtgcggtccaatgccgctctcggggccatcttcacggatgagaacaagtggaaaagcgcgagagaagccgtcgaggacggacggttttgggaactggttgataaagagcgcaatcttcacctggagggcaagtgcgaaacctgtgtgtacaacatgatgggcaaaagagagaagaaactcggggagttcggaaaggctaagggctctcgggccatttggtatatgtggctgggggctcgctttctggagttcgaagccctcggatttctgaatgaggaccattggttctccagaggcaacagcctttccggggtggagggcgaaggactgcaccggctcggctacatcctgcgcgatgtcgggaaaaaggagggaggcgccatgtacgcggacgatacagctgggtgggacaccagaattacacttgaagacctgaaaaatgaggaaatggtgaccaaccatatgaagggagagcacaaaaagctcgccgaggccatctttaagctgacgtatcagaataaagttgtgcgggtccagcgccccacaccgagaggcaccgtgatggatatcattagccggcgcgaccagagagggtctggccaagttggaacatacggcctgaacaccttcacgaatatggaagctcagctcatccggcagatggagggggaaggaattttcaagagcatccaacatctgaccgccacagaggagattgctgtgcagaactggcttgcccgcgtcggcagagaacggctgtccagaatggcgatctctggggatgactgcgtggttaaacctatcgatgaccgctttgccagcgctctcaccgccctgaatgatatgggaaaggtgcggaaagacattcagcagtgggagccctccagaggctggaacgattggacacaagtccccttctgctctcaccactttcatgaacttgtgatgaaggacgggcgcgtcctggtggttccttgtcggaaccaggatgagctcatcggcagagctcgcattagccagggagccggctggtccctgaaggaaaccgcgtgcctggggaaatcttatgcccagatgtggacactcatgtacttccaccggagagacctgcgccttgctgccaatgctatctgtagcgccgtgccgtcccattgggtccccaccagccggacgacatggtctattcacgctaagcacgagtggatgaccaccgaggatatgctggccgtgtggaacagagtgtggatccaagaaaatccttggatggaggacaaaacacccgttgaatcctgggaggaagtgccttatctcggaaagcgcgaggaccagtggtgcggcagcctgattgggcttacctctcgggcgacatgggccaaaaacatccagacggctatcaatcaggtcagatccctgattggaaacgaggaatacaccgattatatgcccagcatgaagcggtttagacgcgaggaagaggaagccggcgtgctctggtga

SEQ ID NO: 20008 - RNA, 9876 nt, synthetic construct
  misc_feature 1..9876: note = derived and/or modified CDS sequence (opt5) from DENV-2__EU482607__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaagacacaatcacctacaaatgcccgcttctgagacaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcgtgtccaaccgcgattttgttgaaggggtgtctggaggcagctgggtcgacattgtgctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtcgatagaggctggggcaacgggtgtggactgttcggcaaagggggaatcgttacatgcgccatgtttacgtgcaaaaagaatatggaaggcaaagtggtgcagcctgagaacctcgaatacaccattgtcatcacaccccacagcggggaggagcatgcggtgggaaatgacaccggcaagcacggcaaagaaattaagatcacacctcagtcttccatcattgaggccgaactgaccgggtatggaacggttaccatggagtgtagcccccggacaggccttgatttcaacgaaatggtgctgctccaaatggaggacaaggcttggctggtccaccgccagtggtttcttgatctgccgctcccttggctgcccggggccgacacccagggatctaattggatccagaaggagacactggtgaccttcaagaaccctcatgctaaaaagcaagacgttgtggtcctcggctcccaggaaggggccatgcacacggccctgacaggcgctaccgagattcagatgagctccggaaatcttctgtttacaggccatctcaaatgcagactgcggatggataaacttcaactgaaagggatgtcttacagcatgtgtaccggaaagttcaagatcgtgaaagaaattgcggagacccagcacggcacaatcgtcatcagagtgcagtatgagggggacggatccccctgcaagattcccttcgaaatcacggatctcgagaaacgccatgttctgggccggctgattaccgtgaaccctatcgtcacagggaaggacagcccggtgaacattgaagccgagcccccttttggcgattcttacatcattatcggagttgaacccggccagctcaaactgaattggttcaagaaggggtccagcatcggacaaatgtttgagaccacaatgagaggcgctaaacgcatggccattcttggggacaccgcctgggatttcggatctctgggcggggtgtttacgagcatcggcaaggctctccaccaggtcttcggagccatttacggcgcggctttttccggggtgtcttggacaatgaaaatcctgattggagtgatcatcacctggattggcatgaacagccggtccaccagcctgtctgtttcccttgtcctcgtgggggtggtcacactgtatctgggagccatggtgcaggccgacagcggctgtgttgtgtcttggaagaataaagagctcaagtgcgggtccggcatcttcattaccgataacgtccacacatggacggaacagtacaagtttcaacctgagagcccctccaaactggcttctgccatccagaaggctcatgaagagggaatttgtggcatcagaagcgtgacccgccttgaaaatctgatgtggaaacagatcacaccggagctcaaccacattctgtccgagaatgaagttaagctgaccatcatgacaggggacattaaaggaatcatgcaggccggcaagcggtctcttagacctcaacccaccgagctcaaatatagctggaagacgtgggggaaggcgaaaatgctgtccaccgaaagccataaccagacattcctgattgatggacctgagaccgccgaatgccccaatacaaaccgcgcttggaactctctcgaggtggaggactacggctttggcgtcttcaccacaaacatctggctgaaacttcgggaaaaacaggacgtgttttgtgattccaagctgatgagcgccgctatcaaagacaatagagccgttcacgcggatatggggtattggattgagtctgccctcaacgacacctggaagatggaaaaggcttccttcatcgaggtgaaaagctgccactggcctaagtctcatacgctgtggagcaatggagtcctggagtccgaaatgattatccccaaaaacttcgccggcccggtgagccagcacaactaccgccctgggtatcatacacaaaccgctggaccctggcaccttggcaagctcgagatggattttgacttctgtgaagggaccacagtggtcgttaccgaggattgcggaaatcggggcccctctctgagaacgacaaccgcctccggcaaactgattacagaatggtgctgtcggagctgcaccctccctccgctgcgctacagaggggaggacggatgttggtacggcatggagatccggccccttaaggaaaaggaggaaaacctggtgaatagcctcgtgacagccgggcatggacagattgataacttttctctgggcgtcctggggatggctcttttcctcgaggaaatgctgagaacccgcgtgggaacgaaacacgcgatcctgctcgttgccgtgagctttgtcaccctgatcacaggcaatatgtccttccgggaccttggcagagtgatggttatggtgggggctaccatgacagatgacattggaatgggcgtcacctatctggccctcctggccgcttttaaggtgcgccctacgttcgccgcggggctgcttctgagaaaactcacatctaaggagctgatgatggctaccatcggaattgccctcctgagccagtccacaatccccgagaccattcttgaactgaccgatgccctcgctctgggcatgatggttctgaaaatcgtgcggaacatggagaagtaccaacttgccgtcacagtgatggcgatctcttgcgtgcctaatgctgtcattctgcagaacgcctggaaggttagctgtacgatcctcgccgctgtgtccgtgagccccctgctcctgacctcttcccagcagaaagccgactggattcctcttgctctgacaatcaaggggctcaatcccaccgccatttttctgacaaccctgagccgcacgtctaaaaagagatcctggccgcttaacgaagcgatcatggccgtcggaatggtgagcatcctggcttcttccctcctgaaaaatgacattcctatgacaggccccctcgttgccggcgggctgcttaccgtgtgctatgtcctgaccggacggagcgctgatctggagctcgaacgcgccgccgacgtgaagtgggaggatcaagctgagatctccggcagctctcctattctgagcatcacaatttccgaagacgggtctatgagcatcaaaaacgaggaagaggagcagacccttacaattctgatcagaacgggactcctggttatctccggcgtgttccccgtctctattccgatcaccgcggccgcttggtacctctgggaagtgaagaagcagcgggccggggtcctgtgggatgtgccttctccccctcccgttggaaaagccgagcttgaagacggcgcttatcgcattaagcagagaggcatcctggggtactcccaaattggagccggcgtgtataaagaggggacatttcacaccatgtggcatgtcacacggggagcggtgctgatgcaccgcggcaagagaatcgaaccctcctgggctgatgttaaaaaggacctcatcagctacgggggaggctggaagctggagggcgagtggaaagaaggggaggaagtgcaggtccttgccctggagcctggaaagaatccgcgggccgtgcagaccaaacccggcattttcaagacggataccgggacaatcggagctgtgtccctcgactttagccctggcacctctgggtcccccattgttgatagaaaaggaaaggtcgtgggcctgtacggcaacggggtggtcacacgcagcggagcctatgtgtctgcgatcgctcagaccgaaaagtccattgaggacaatcctgagatcgaagatgacatcttccggaaaaagagactcacaattatggacctgcatcccggcgccgggaaaacgaagcgctaccttcctgccatcgttcgggaggctattaaaagaggactgcgcaccctgatcctcgccccgacacgggtggtcgctgccgaaatggaggaagcgctgagaggccttcccattcgctatcaaacccctgccatcaaggctgagcacaccgggcgggagattgtggatctgatgtgtcatgccacattcacgatgagactcctgagccccgttcgggtgcctaactacaacctcatcatcatggacgaagctcactttaccgatcccgcctccattgccgctcgcggctatatctctacaagagtcgagatgggagaagcggccggcattttcatgaccgctacaccgcctgggagccgggacccctttccccagtccaatgcccctatcatggatgaggagcgcgaaattcccgagagaagctggaactctggacacgaatgggtgaccgacttcaagggcaaaacggtttggtttgtgccttccatcaaggccgggaatgatatcgctgcctgcctgcggaaaaacggaaagaaagtcattcagcttagcagaaagacattcgactctgagtacgtgaagacccgcgcgaatgattgggactttgtggtcaccacagatatcagcgaaatgggcgctaacttcaaagccgagcgggttattgacccgagacgctgtatgaagcccgtgatcctgaccgacggggaggaacgggtgattctggccggccctatgcccgtcacacattcctctgctgcccaaagacgcggacggatcggcagaaatcctaaaaacgagaatgatcagtatatctacatgggggaacccctcgagaacgacgaagattgcgcgcactggaaggaggccaaaatgctgcttgacaatattaacaccccggagggaatcattcctagcatgtttgaacccgagcgcgaaaaggtggatgctatcgacggcgagtacagactgagaggggaagcccgcaaaacgttcgttgatctcatgagacggggagacctgcctgtgtggctggcttataaggtcgccgctgagggcattaattacgccgatcgcaagtggtgttttgacgggatcaaaaacaatcagattctcgaggaaaacgtggaggttgaaatctggacaaaggagggcgagcgcaagaaacttaaaccccggtggctggatgcgagaatctattccgaccctctggccctcaaggagttcaaggagttcgctgccggacgcaaatctctggctcttaacctgattaccgaaatgggccggctccccacatttatgacccagaaggccagaaatgccctggataacctggctgtgctccatacggcggaggccgggggacgcgcttacaatcacgcccttagcgaactgccggagaccctggagacactcctgcttctgaccctcctggccacagtcaccggcgggatcttcctgtttctcatgtccggaaaaggcattggcaagatgacacttgggatgtgctgcatcattaccgctagcgtgctgctgtggtatgcccaaatccagcctcactggatcgcggcctctattatcctcgagttctttctgattgtccttctgatccccgagcccgaaaaacagcggacgcctcaggacaaccaactcacatacgtggttattgctatcctgaccgtggtggccgctaccatggccaatgagatgggattcctggaaaagacaaagaaagacctcggccttgggtccatcaccacacaggagagcgagtccaacattctggatatcgacctgagaccggcgtctgcctggacgctctatgctgtcgccaccacatttgttacccccatgctgcggcatagcattgaaaattcctctgtgaacgtgagccttacagctatcgccaatcaggctaccgtcctgatgggactcggcaaggggtggcctctgtccaaaatggatattggagtgcccctgctcgccatcggctgttacagccaggttaaccctattacgcttaccgcggccctgctgctcctggtggctcactacgccatcatcggccccgggcttcaagctaaggccacacgcgaggcccagaaaagagcggctgccggaattatgaagaatcctaccgtcgacggcatcacagtgattgatctggaaccgatcccctatgaccctaagttcgagaaacagctcgggcaggtcatgctgctgattctctgcgtgacccaagttcttatgatgcggacgacatgggctctgtgtgaagccctgaccctcgccacaggacccatctctaccctgtgggagggcaaccctgggcgcttttggaataccacaatcgctgtgtccatggccaacattttcagaggaagctaccttgcgggcgccggcctgctcttttctatcatgaagaatacgaccaacacacggcgcgggaccggaaatattggcgagacactgggggaaaaatggaagtccagactgaacgctctcggaaaaagcgagttccagatctataagaaatctggcattcaggaagtcgatcggacccttgccaaggaggggatcaagcgcggagagacggaccatcacgctgtgagcagaggctccgccaaactgcggtggtttgttgaaagaaacatggtgacacccgagggcaaggtcgtggatctggggtgcggacgcggcgggtggtcttactattgtggaggcctcaaaaatgtgcgggaagttaaggggctgaccaaaggaggcccgggccatgaggaacctatccccatgagcacctacgggtggaaccttgtcagactgcaatccggagtggacgtgttcttcacaccccctgagaagtgcgataccctcctgtgtgacattggcgagagctcccccaatcctacaatcgaagcggggcgcacgctgcgggtcctcaaccttgttgagaattggctgaacaataacacccagttttgcattaaggtgctgaatccgtatatgccctctgtgatcgagaagatggagacactccagagaaagtacggaggcgccctggtccgcaaccctcttagcagaaattccacccacgaaatgtactgggtgtctaacgctacagggaatattgttagctccgtgaacatgatctctagaatgctgatcaatcgcttcaccatgaaacacaagaaagccacgtatgagcccgatgtcgacctcggaagcggcacccggaacattggcatcgagtccgaaattcctaacctggacatcattgggaagagaatcgagaagattaaacaggaacatgagacaagctggcactacgatcaagaccatccctataagacctgggcttaccacggatcttatgaaacaaaacagaccggctccgccagctctatggtgaatggggttgtgcgcctgctcacaaagccgtgggatgtcgtgcctatggtgacccagatggctatgacggacacaaccccctttggacagcaacgggtcttcaaagagaaggttgataccagaacacaggagcctaaggaaggcacgaagaaacttatgaaaatcaccgccgagtggctgtggaaagaactggggaaaaagaaaacaccccgcatgtgtaccagagaggagtttacacggaaggtgcgctccaacgcggccctcggagctatcttcaccgacgaaaataagtggaaaagcgccagagaggctgtggaagatggccggttttgggagctggtcgacagagaacggaaccttcacctggagggcaagtgcgagacatgtgtgtacaatatgatggggaaacgcgaaaagaaactcggagagttcggcaaggccaaggggtctagagccatttggtatatgtggctgggagcgcggtttctggagttcgaggctctcggctttctgaacgaagatcattggttctcccgcgggaatagcctttccggcgttgagggagagggcctgcacagactcgggtacatcctgcgggacgtgggcaagaaggaaggcggggccatgtacgccgatgacaccgctggatgggacacgcgcattacccttgaggatctgaaaaacgaagagatggtcacaaatcatatgaagggcgaacacaaaaagctcgccgaggctatctttaagctgacctatcagaacaaagtggttagagtgcagcggcctacaccccgcgggaccgtcatggacattatcagcagaaaggatcaacggggctctggacaggtgggcacgtacgggctgaatacattcaccaacatggaggcccagctcatccgccaaatggaaggagagggcattttcaaaagcatccagcatctgacagcgaccgaagagattgccgttcagaattggcttacgagagtggggcgggagcgcctgtccagaatggctatctctggagacgattgcgtcgtgaagccgattgacgatcggtttgccagcgctctcaccgccctgaacgacatgggcaaagtcagaaaggatatccagcaatgggaaccttcccgcgggtggaatgactggacacaggtgcccttctgctctcaccactttcatgagcttgttatgaaggatggccgggtgctggtcgtgccctgtagaaaccaggacgaactcatcggacgcgcgcggattagccagggcgccgggtggtccctgaaagagaccgcttgcctgggaaagtcttatgcccaaatgtggacactcatgtacttccacagacgcgatctgcggcttgctgccaacgctatctgtagcgccgtgccttcccattgggttccgaccagcagaacaacctggtctattcacgcgaaacacgaatggatgacgacagaggacatgctggccgtgtggaatcgcgtctggatccaggagaacccctggatggaagacaagacccctgtggagtcctgggaagaggttccctatctcggcaaacgggaagatcagtggtgcgggagcctgattggacttacctctagagctacatgggccaagaatatccagaccgccattaaccaagtgcgctccctgatcggcaatgaggagtacacagactatatgcctagcatgaagcggtttagacgggaagaggaagaggctggggtcctctggtga

SEQ ID NO: 20009 - RNA, 9876 nt, synthetic construct
  misc_feature 1..9876: note = derived and/or modified CDS sequence (opt5) from DENV-2__EU482608__SS-prME
  source 1..9876: mol_type = other RNA
accgccggcgtgatcattatgctgatccccacagctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgagacaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatctgtggaattagaagcgtgacccgccttgagaatctgatgtggaaacagatcacaccggagctcaaccacattctgtccgaaaatgaggtcaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccgtgagctttgttacactgattaccggaaatatgtccttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatggtcctgaaaatcgtgcggaacatggaaaagtaccaacttgctgttaccattatggccatctcttgcgtgcctaatgcggtcattctgcgcaacgcttggaaggtgagctgtacaatcctcgccgccgtgtccgtcagccccctgctcctgacctcttcccagcagaaagctgactggattcctcttgccctgacaatcaagggcctcaatcccaccgctatctttctgacgacactgagcagaacctctaaaaagcggtcctggccgcttaacgaggccattatggcggttgggatggtgagcatcctggcctcttccctcctgaaaaatgacattcctatgaccggacccctcgtggctggcggcctgcttacagtctgctatgtgctgaccgggcgcagcgccgatctggaactcgagagagctgccgacgttaagtgggaggatcaggccgaaatctccggaagctctcctattctgagcatcacaatttccgaggacggctctatgagcatcaaaaacgaagaggaggaacaaacgcttaccatcctgattcggacagggctcctggtgatctccggagtcttccccgtgtctattccgatcaccgctgcggcctggtacctctgggaggttaagaagcagcgcgctggcgtgctgtgggatgtcccttctccccctcccgtggggaaagccgaacttgaggacggagcctatagaattaagcagcggggcatcctgggctactcccagatcggggctggagtctataaagaaggcacatttcacaccatgtggcatgtgacgcgcggggccgttctgatgcacagaggaaagcggattgagccctcctgggcggatgtgaaaaaggacctcatcagctacggcgggggatggaagctggagggcgaatggaaagagggcgaagaggtccaagtgcttgctctggaacctgggaagaatccgagagccgttcagaccaaacccggaattttcaagacaaacaccggcacaatcggggccgtgtccctcgattttagccctggaacctctggctcccccattgtcgaccgcaaagggaaggtggtgggactgtacggcaatggcgttgtcacacggagcggggcttatgtgtctgccatcgcgcagacggagaagtccatcgaggataaccctgaaattgaggacgatatcttccgcaagaagcgcctcaccattatggacctgcatcccggagctggcaaaacaaagcggtaccttcctgccatcgtgagagaagccattaaacgcgggctgcggaccctgatcctcgctccgaccagagtcgtggccgctgagatggaagaggccctgcgcggacttcccattcggtatcagacccctgcgatcaaggccgagcacacgggcagagaaatcgttgacctgatgtgtcatgctaccttcacaatgcggctcctgagccccgtgcgcgtccctaactacaatctcattatcatggatgaggcccactttaccgaccccgcttccattgccgccagagggtatatctctacacgggtggaaatgggcgaggctgcgggaattttcatgaccgccacgccgcctggcagccgcgatccctttccccaatccaacgctcctatcatggacgaggaaagagagatccccgaacggagctggaactctgggcacgagtgggttacagatttcaagggaaaaaccgtgtggtttgtcccttccattaaggccggcaacgacatcgccgcttgcctgcgcaagaatgggaagaaagtgattcagcttagccgcaagaccttcgattctgaatacgttaagacacgggccaacgactgggattttgtggtcaccacagacatcagcgagatgggagcgaatttcaaagctgagagagtgattgatccgcgccggtgtatgaagcccgtgatcctgaccgacggcgaagagagagtcatcctggccgggcctatgcccgttacgcattcctctgccgctcagcgccggggcagaattggacgcaaccctaaaaatgaaaacgaccaatatatctacatgggcgagcccctcgaaaatgatgaggactgcgcccactggaaggaggcgaaaatgctgcttgataacattaatacaccggaagggatcattcctagcatgtttgagcccgaaagagagaaggtggacgccatcgatggagaataccggctgcgcggcgaggctagaaaaaccttcgtggacctcatgcggcgcggggatctgcctgtctggctggcctataaggtggctgccgagggaattaactacgctgacagaaagtggtgttttgatggcatcaaaaataaccagatcctcgaagagaacgttgaagtggagatttggacaaaggagggggaacggaagaaacttaaacccagatggctggacgcccgcatctattccgatcctctggcgctcaaagagttcaaggagttcgccgctggccggaaatctctgacccttaatctgattacggagatgggaagactccccacctttatgacacagaaggcccgcaacgctctggacaatctggccgtcctccataccgccgaagctggcgggcgggcgtacaaccacgcccttagcgagctgccggagacactggaaaccctcctgcttctgacactcctggctaccgtgacgggaggcatcttcctgtttctcatgtccgggaaaggaattggcaagatgacacttggcatgtgctgcatcatcaccgccagcgttctgctgtggtatgcccagattcaacctcactggatcgctgcctctattatcctcgagttctttctgattgtgcttctgatccccgaacccgagaaacagagaacccctcaggataatcagctcacatacgtcgtgatcgcgattctgaccgtcgtggccgctacaatggccaacgaaatggggttcctggagaagacgaagaaagacctcggacttggctccatcaccacacaagagagcgaatccaatattctggacatcgatctgcggccggcttctgcctggaccctctatgcggttgccacaacctttgtgacgcccatgctgcgccatagcattgagaactcctctgtgaatgtcagccttaccgctatcgccaaccaggctacagttctgatggggctcggaaagggctggcctctgtccaaaatggacattggggtgcccctgctcgccatcggatgttacagccaggtgaatcctatcacccttacagctgccctgctgctcctggtcgcgcactacgccattatcggccccggccttcaggctaaggccaccagagaagctcaaaaacgggccgccgcggggattatgaagaaccctacggtggatggaatcacagttattgacctggagccgatcccctatgatcctaagttcgaaaaacagctcggccaggtgatgctgctgatcctctgcgtcacccaggtgcttatgatgcgcacaacctgggctctgtgtgaggccctgaccctcgctacagggcccatttctacgctgtgggagggaaatcctggcagattttggaacaccacaatcgccgtctccatggccaatattttccgggggagctaccttgctggagccggcctgctcttttctatcatgaagaacaccacaaatacccgcagaggcacggggaacattggagaaacactgggcgagaaatggaagtcccggctgaacgcgctcgggaaaagcgagttccaaatctataagaaatctggaatccaggaggtggaccgcacccttgccaaggagggcattaagagaggggaaaccgatcatcacgctgttagccggggatccgccaaactgagatggtttgtggagcgcaatatggtcacacccgaaggcaaggtggttgacctgggctgcgggcggggaggctggtcttactattgtgggggactcaaaaacgtgagagaggtcaagggcctgaccaaagggggaccgggccatgaagaacctatccccatgagcacatacggctggaatcttgtgcgcctgcagtccggggtggatgttttcttcacgccccctgagaagtgcgacaccctcctgtgtgatattggagaaagctcccccaaccctacaatcgaggctggccggaccctgagagtcctcaatcttgtggaaaactggctgaataacaatacacaattttgcattaaggtgctgaacccgtatatgccctctgtcatcgagaaaatggaaaccctccagcgcaagtacgggggagccctggttcggaatcctcttagcagaaactccacgcacgagatgtactgggtgtctaatgcgaccggcaacatcgtgagctccgtcaatatgatttctcgcatgctgatcaaccggttcacaatgaaacacaagaaagccacctatgagcccgacgtggatctcgggagcggaacaagaaacattggcatcgaatccgagattcctaatctggacatcattggcaagcgcatcgaaaagatcaaacaggagcatgaaaccagctggcactacgaccaggatcatccctataagacatgggcttaccacgggtcttatgagaccaaacaaacgggatccgccagctctatggttaacggcgtggtccggctgctcacaaagccgtgggacgtggttcctatggtgacccagatggctatgaccgatacaacgccctttgggcagcagagagtcttcaaagagaaggtggacacccgcacacaagaacctaaggagggaaccaaaagacttatgcggattacagccgaatggctgtggaaggagctgggcaaaaagaaaacacccagaatgtgtacaagagaggaatttacccggaaggtgagatccaatgctgccctcggggcgatcttcacggatgagaacaaatggaaaagcgcccgggaagctgtcgaggacggacgcttttgggaactggttgataaggagagaaatcttcacctggagggcaaatgcgaaacctgtgtgtacaacatgatgggcaagcgggagaaaaagctcggggagttcggaaaagccaagggctctcgcgctatttggtatatgtggctgggggccagatttctggagttcgaagccctcggatttctgaatgaggaccattggttctcccggggcaacagcctttccggggtggagggcgaaggactgcaccgcctcggctacatcctgagagatgtcgggaagaaagagggaggcgcgatgtacgctgacgatacagccgggtgggacacccggattacacttgaagacctgaagaatgaggaaatggtgaccaaccatatgaaaggagagcacaagaaactcgccgaggctatctttaagctgacgtatcagatcaaggttgtgcgcgtccagagacctacaccccggggcaccgtgatggatattatcagccgcagagaccagcgggggtctggccaagttggaacatacggcctgaataccttcacgaacatggaagcccagctcattcgccagatggagggggaaggaatcttcaaaagcattcaacatctgaccgctacagaggagatcgccgtgcagaattggcttgcgagagtcggccgggaaagactgtcccgcatggccatctctggggatgactgcgtggttaagccgattgatgaccggtttgctagcgccctcaccgctctgaacgatatgggaaaagtgagaaaggacatccagcagtgggagccttcccgcggctggaatgattggacacaagtccccttctgctctcaccactttcatgaacttgtgatgaaagacgggcgggtcctggtggttccctgtagaaaccaggatgagctcattggccgcgcccggatcagccagggagcgggctggtccctgaaggaaaccgcctgcctggggaagtcttatgctcagatgtggacactcatgtacttccacagacgcgacctgcggcttgccgctaacgccatttgtagcgctgtgccttcccattgggtcccgaccagcagaacgacatggtctatccacgccaaacacgagtggatgaccaccgaggatatgctggcggtgtggaatcgcgtgtggattcaagaaaacccctggatggaggacaagacacctgttgaatcctgggaggaagtgccctatctcggaaaacgggaggaccagtggtgcggcagcctgatcgggcttacctctagagccacatgggctaagaatatccagacggccattaaccaggtccggtccctgatcggaaatgaggaatacaccgattatatgcctagcatgaaaagatttcgccgggaggaagaggaagccggcgtgctctggtga

SEQ ID NO: 20010 - RNA, 9876 nt, synthetic construct
  misc_feature 1..9876: note = derived and/or modified CDS sequence (opt5) from DENV-2__EU687220__SS-prME
  source 1..9876: mol_type = other RNA
accgcgggagtgatcattatgctgatccccacggctatggccttccacctcacgacccggaatggggaacctcatatgattgttggacggcaggaaaagggcaagagcctgctttttaagaccgaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgctccgtggctctcgtgcctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagaaggccctgattttcatccttctgacagcggtggcccctagcatgacgatgagatgcattggcatctccaaccgggattttgtcgaaggggtgtctggaggcagctgggttgacatcgtgctcgagcacgggtcctgtgtcaccacaatggctaagaataaacccaccctggatttcgaacttattaagacagaggccaaacagcctgctaccctgcgcaagtattgcatcgaagccaaactcacgaacacaaccaccgagagcagatgtccgacacaaggagagccctctctgaatgaagaacaggacaagcggtttatttgcaagcattccatggtggatcgcggctggggcaacgggtgtggactgttcggcaaagggggaatcgtgacctgcgcgatgtttacatgcaagaaaaatatggaaggcaaggtcgttctccctgagaacctggaatacacgattgtgatcacaccccacagcggggaggagcatgccgtgggaaatgacacaggcaaacacggcaaggaaatcaaaattacccctcagtcttccatcacagaggctgaacttaccgggtatggaacggtcaccatggagtgtagccccagaacaggcctggatttcaacgaaatggtgctcctgcagatggaggagaaggcctggcttgttcaccggcaatggtttctggacctcccgctgccttggctgcccggggctgatacccagggatctaattggattcagaaggaaacactcgtgaccttcaaaaaccctcatgccaagaaacaggacgtcgtggttctgggctcccaagagggggccatgcacacggctcttacaggcgcgaccgaaatccagatgagctccggaaatctgctctttacaggccatctgaagtgccgccttagaatggacaaactgcagctcaaggggatgtcttacagcatgtgtaccggaaagttcaaaattgtgaaggagatcgccgagacccaacacggcacaatcgtcattcgggtgcagtatgaaggggatggatccccctgcaaaatccccttcgagattatggacctggaaaagagacatgtcctgggccgcctcatcacggtgaaccctattgttaccgagaaagatagcccgatcaacattgaagctgagcccccttttggggactcttacatcatcattggcgtggagcccggacagctgaaacttaattggttcaagaaaggctccagcatcgggcagatgtttgaaacaaccatgcggggagccaagagaatggccattctgggcgatacagcttgggacttcgggtctctcggaggcgtctttaccagcatcgggaaagccctgcaccaagtgttcggcgcgatttacggagctgccttttccggcgtttcttggacgatgaagatcctgatcggggtgattatcacatggattggaatgaacagccgctccaccagcctttctgtctccctcgtgctggtgggcgttgtcaccctgtatctcggggccatggtgcaggctgatagcggatgtgtggtctcttggaaaaataaggagctgaagtgcggctccgggatcttcattacagacaacgtgcacacctggacagaacagtacaaatttcagcctgagagcccctccaaacttgcctctgctatccaaaaagcccatgaagagggcatctgtggcattcggagcgttacgagactggagaatctcatgtggaagcagatcaccccggaactgaaccacattctgtccgagaatgaagtgaaacttacaatcatgaccggcgatattaaggggatcatgcaggcgggaaaacgctctctccggcctcagcccacagagctgaagtatagctggaagacctggggcaaagccaagatgctgtccacggaaagccataaccaaaccttcctcatcgacgggcctgagacagctgagtgccccaataccaacagagcctggaactctctggaagtcgaggattacggatttggcgtgttctccacaaacatttggcttaaactgcgcgaaaagcaggacgtcttttgtgacagcaaactcatgtctgctgccatcaaggataatcgggcggtgcacgccgacatgggctattggattgagtccgctctgaacgatacctggaagatggagaaagccagcttcatcgaagtcaagtcttgccactggcctaaaagccatacactgtggtccaatggggtgcttgagagcgaaatgattatccccaagaacttcgctggaccggtttctcagcacaactacagacctggctatcatacccagacggccgggccctggcacctcggaaaactggagatggactttgatttctgtgaaggcacaaccgtggtcgtgaccgaggactgcgggaatcgcggaccctccctgcggacaaccacggccagcggcaagctcattacagagtggtgctgtagatcctgcaccctgcctccgcttcggtaccgcggcgaagatgggtgttggtacggaatggagatcagacccctgaaggaaaaagaggaaaacctcgtcaattctctggtcacagctggccatgggcaaatcgacaactttagcctgggagttcttggcatggccctcttcctggaggagatgctgcggaccagagtggggacaaagcacgccattctcctggtggctgtctcctttgtgacccttatcacgggaaatatgtctttccgcgatctgggccgggttatggtgatggtcggcgccaccatgacagacgatattgggatgggagtgacctatctcgccctgctggctgcctttaaagttagacctacattcgcggctggccttctgctccgcaagctgaccagcaaagaactcatgatggccacgatcgggattgccctgctttcccagtctacaatccccgagaccatcctggaactcacagacgctctggccctgggaatgatggtgcttaagattgtcagaaacatggagaagtaccagctggcggtgaccatcatggctattagctgcgttcctaatgccgtgatcctcctgaacgcctggaaagtctcctgtaccattctcgctgccgtgagcgtgtctcccctgcttctgacatccagccaacagaaggctgattggatccctctcgccctgacgatcaaaggcctgaatcccaccgcgatttttcttacaaccctgtctcggacatccaagaaacgcagctggccgctcaacgaagccgtcatggctgttgggatggtgtctatcctggcctccagcctcctgaagaatgacattcctatgaccggaccccttgtggctggcggcctgctgacggtctgctatgtgctcacagggagatccgccgacctggagcttgagcgggccgctgatgttaaatgggaagaccacgcggagatcagcggatctagccctattctgtccatcaccatttctgaagatggcagcatgtccatcaagaacgaggaggaagaacagaccctcacaatcctgattcgcaccgggctcctggtgatctctggagtcttccccgtgagcattccgatcacagccgctgcctggtacctttgggaagttaagaaacagagagccggcgtgctgtgggacgtcccttctccccctcccgtggggaaggctgagctggaagatggagcctatcggattaaacaacgcggcatcctcggctacagccagatcggggcgggagtctataaggagggcacgtttcataccatgtggcacgtgacaagaggggctgttctgatgcatcggggaaaacgcattgagcccagctgggccgacgtgaagaaggatcttatctcctacggcgggggatggaaactggaaggcgagtggaaggaaggcgaggaagtccaggtgctcgccctggagcctgggaaaaatccgagagctgttcagaccaagcccggactcttcaaaacaaacaccggcacgattggggccgtgagcctggacttttctcctggaacctccggcagccccatcgtcgatcggaaggggaaggtggtgggactttacggcaatggcgttgtcacaagatctggggcgtatgtgtccgctattgcccaaaccgagaaaagcatcgaagacaaccctgagatcgaagatgacattttccgcaagaaacggctgacaatcatggatctgcaccccggagccggcaagaccaaaagatacctccctgctattgtgcgcgaggccatcaagcgggggctgagaacacttattctggctccgacgcgcgtcgtggccgcggaaatggaggaggccctccggggactgcccatcagatatcagacccctgctattcgcgccgaacatacaggccgggagatcgttgacctcatgtgtcacgctaccttcaccatgagactgctttcccccgtgcgggtccctaactacaatctgatcattatggacgaagcccactttacagatcccgcctctatcgctgcgcgcgggtatattagcacgagagtggagatgggcgaggccgctggaatcttcatgaccgccacaccgcctggctcccgggacccctttccccagagcaacgcccctattatggatgaagaacgcgaaatccccgagagatcttggaactccgggcatgaatgggttaccgacttcaagggaaaaacagtgtggtttgtccctagcatcaaggctggcaacgatattgccgcgtgcctgcggaaaaatgggaagaaagtgatccagctctctagaaagaccttcgacagcgagtacgttaagacgcgcgctaacgattgggactttgtggtcacaaccgatatttccgagatgggagccaatttccgggccgaaagagtgatcgacccgcgccggtgtatgaaacccgtgattctgaccgatggcgaggaaagagtcatccttgctgggcctatgcccgttacacactctagcgccgcgcaacgccggggcagaatcggacgcaaccctaagaatgagaacgaccagtatatttacatgggcgaacccctggagaatgacgaggattgcgcccattggaaagaagctaagatgctcctggacaacatcaataccccggaggggattatcccttccatgtttgaacccgagagagaaaaagtggatgccattgacggagagtaccggctgcgcggcgaggctagaaagacattcgtggatctcatgcggcgcggggaccttcctgtctggctggcctatagagtggctgccgaaggaatcaactacgcggatcggagatggtgttttgacggcattaaaaataaccagatcctggaggaaaacgttgaggtggagatctggaccaaggaaggggagcgcaagaaactcaagccccggtggctggatgccagaatttattctgaccctcttgctctgaaagagttcaaggagttcgccgctggccgcaaaagcctcacgctgaatctgatcacagaaatgggacggctccccacctttatgacacaaaaggccagagatgcccttgacaacctggctgtcctgcacaccgcggaggccggcgggcgggcttacaatcacgccctctccgagctgccggaaacgcttgagaccctgctcctgctgacactccttgccaccgtgacaggaggcattttcctgtttctgatgagcgggaagggaatcggcaaaatgaccctcggcatgtgctgcattatcacagcttctatcctgctttggtatgcccagattcagcctcattggatcgcggcctccattatcctggagttctttctcattgttctgctgatccccgagcccgaaaagcagcgcacccctcaagataaccagctcacgtacgtggtcatcgctattcttacagtggtcgccgctaccatggccaatgagatggggttcctggagaaaaccaagaaagacctgggactcggcagcatcacaacccaggaatccgagtctaacattctggacatcgatcttagaccggcgagcgcctggacactgtatgctgtggccacgacctttgttacacccatgctccggcactccattgaaaattctagcgtgaacgtgtccctgaccgctatcgccaatcaggctacagtcctgatggggctcggaaagggctggcctcttagcaagatggacattggggttcccctgctggccatcggatgttactctcaagtgaaccctatcaccctcacggcggccctgcttctgctcgtggctcattacgccattatcggccccggcctgcaggctaaagccacccgcgaggcccagaagagagcggctgccgggattatgaaaaatcctacagtcgatggaatcaccgtgattgacctggaaccgatcccctatgatcctaagttcgagaaacagctcggccaagttatgcttctgatcctgtgcgtgacacaggtcctcatgatgcggaccacgtgggctctgtgtgaggcccttacactggccaccgggcccatttccacactctgggaaggaaaccctggccgcttttggaataccaccatcgctgtgagcatggccaacattttcagagggtcttacctggcgggagccggcctgctcttttccatcatgaagaatacaacgaacacccggcgcggcacagggaatattggagagacccttggcgaaaagtggaaaagcagactgaacgctctggggaagtctgagttccagatctataaaaagagcggaatccaggaggtcgaccggacactcgccaaagaaggcattaagagaggggagaccgatcaccatgctgtgtcccgcggatctgccaaactgcggtggtttgttgaaagaaacatggtgacgcccgagggcaaggtcgtggaccttggctgcgggcgcggaggctggagctactattgtgggggactgaagaatgttcgggaagtgaaaggcctcacaaaagggggaccgggccacgaggagcctatccccatgtccacctacggctggaacctggtcagactgcaaagcggggtggatgtgttcttcacaccccctgaaaaatgcgacacactcctttgtgatattggagagtcctctcccaatcctaccatcgaagcgggccgcacactgcgggttctgaacctcgtcgagaattggctgaacaataacacgcagttttgcattaaggtgcttaatccgtatatgcccagcgtgatcgagaagatggagaccctgcagagaaagtacgggggagccctcgtccgcaaccctctgtccagaaattctacacacgagatgtactgggttagcaacgctaccggcaatatcgtgtcctctgtgaacatgattagcagaatgctgatcaatcgcttcacaatgaagcataaaaaggccacctatgaacccgacgtcgatctcgggtccggaacgcggaacattggcatcgagagcgaaattcctaaccttgacatcattggcaaaagaatcgagaagatcaaacaagaacacgagacctcttggcattacgaccaggatcacccctataagacatgggcttaccacgggtcctatgagaccaagcagacaggaagcgcctcttccatggtgaatggcgttgtgcgcctgctgaccaaaccgtgggacgtcgtgcctatggttacacagatggctatgaccgatacgacaccctttgggcaacagagagtgttcaaggaaaaagtcgacacccggacccaggagcctaaggaaggaaccaagaagctcatgcgcattacggccgagtggctgtggaaggagcttggcaaaaagaaaacccccagaatgtgtacacgggaagagtttaccagaaaggtgcggagcaacgcggccctgggggctatcttcacagatgaaaataaatggaagtctgcccgcgaggctgtggaagactccagattttgggagctcgtcgatcgggagcgcaacctgcatctggaaggaaaatgcgagacctgtgtttacaatatgatgggcaagagagaaaagaaactcggcgagttcgggaaggccaaaggaagccgggccatttggtatatgtggctgggcgcgcgctttcttgagttcgaggctctggggtttctcaacgaggaccactggttctccagaggaaatagcctgtctggcgtggaaggggagggccttcatcggctgggatacatcctccgcgatgtgagcaagaaagaaggcggggccatgtacgccgacgatacagctggatgggacaccagaattacgctggaggacctgaagaacgaagagatggtcaccaatcacatgaagggcgagcataaaaagctcgccgaagctatctttaaactgacatatcagaacaaggtggttcgggtgcaacgccctacccccagagggacagtcatggatatcatttcccggcgcgaccagagaggatctggccaggtggggacctacggccttaatacgttcacaaacatggaggcccagctgatccggcaaatggaaggagagggcattttcaaaagcatccagcacctcaccgttacagaggaaattgcggtgcagaattggctggtcagagtggggcgcgagcggctttccagaatggccatctctggagatgactgcgttgtgaagccgctggatgaccgctttgctagcgccctcaccgctctgaacgatatgggcaaggtccggaaagacatccaacagtgggaaccttccagagggtggaatgattggacacaggtgcccttctgctctcaccattttcacgagctggtcatgaaggacggacgcgtgctcgttgtgccctgtcggaaccaggatgaactgattggcagagcccgcatcagccaaggggcgggctggtcccttaaagagaccgcctgcctgggaaagagctatgctcagatgtggacactcatgtacttccatcggagagacctgcgccttgccgctaacgccatttgttctgctgtcccttcccactgggtgccgaccagccggacaacctggtctatccacgccaaacatgagtggatgacaaccgaagatatgctggcggtgtggaatagagtttggattcaggagaacccctggatggaagacaagacgcctgtggagtcctgggaagaggtcccctatctcggcaagcgggaggaccagtggtgcgggagcctgatcggactgacatccagagccacctgggctaaaaatattcaaaccgccatcaaccaggtgcgctctctcatcggcaatgaagagtacacagattatatgcctagcatgaagcggtttagacgcgaagaggaagaggccggggttctgtggtga

SEQ ID NO: 20011 - RNA, 9876 nt, synthetic construct
  misc_feature 1..9876: note = derived and/or modified CDS sequence (opt5) from DENV-2__EU726775__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaagaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacttctgtgagggcacaaccgtggtggtcacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggttaattccctcgtgaccgccggccatgggcagattgataacttttctctgggagtgctgggcatggctcttttcctcgaagagatgctgagaacgcgcgtcgggaccaaacacgcgatcctgctcgtggccgttagctttgtgacactgatcaccggaaatatgtccttccgggaccttggcagagtcatggtgatggttggcgctacaatgaccgatgacattgggatgggagtgacgtatctggccctcctggccgcttttaaggtccgccctacattcgccgcgggcctgcttctgagaaaactcacctctaaggagctgatgatggctacaatcgggattgccctcctgagccagtccaccatccccgaaaccattcttgagctgacagatgccctcgctctgggaatgatggtgctgaaaatcgttcggaacatggaaaagtaccaacttgccgtgacgatcatggcgatttcttgcgtccctaatgctgtgatcctgcagaacgcctggaaggtgagctgtaccattctcgccgctgtctccgttagccccctgctcctgacatcttcccagcagaaagccgactggatccctcttgctctgaccattaagggcctcaatcccacagccatctttctgaccacgctgagccgcacatctaaaaagagatcctggccgcttaacgaggcgatcatggccgtggggatggtgagcattctggcttcttccctcctgaaaaatgacatccctatgaccggacccctcgtcgccggcggcctgcttaccgtgtgctatgttctgacagggcggagcgctgatctggaactcgagcgcgccgccgacgtgaagtgggaggatcaagctgaaatttccggaagctctcctatcctgagcattaccatctccgaggacggctctatgagcattaaaaacgaagaggaggaacagacacttacgatcctgatcagaaccgggctcctggtcatttccggagtgttccccgtttctatcccgattacagcggccgcttggtacctctgggaggtgaagaagcagcgggccggcgtcctgtgggatgtgccttctccccctcccgtcgggaaagccgaacttgaggacggagcttatcgcatcaagcagagaggcattctgggctactcccaaatcggggccggagtgtataaagaaggcacctttcacacaatgtggcatgttaccagaggggcggtgctgatgcaccgcggaaagagaatcgagccctcctgggctgatgtcaaaaaggacctcattagctacggcgggggatggaagctggagggcgaatggaaagagggcgaagaggtgcaggttcttgccctggaacctgggaagaatccgcgggccgtgcagacgaaacccggaatcttcagaaccaacacaggcaccattggggctatctccctcgattttagccctggaacatctggctcccccattgtcgaccgcaaggggaaagtggtgggactgtacggcaatggcgttgtcacccggagcggggcctatgtgtctgcgatcgctcagacagagaagtccatcgaggataaccctgaaattgaggacgatatcttcagaaagaaacgcctcacgattatggacctgcatcccggagccggcaagaccaaacggtaccttcctgccatcgtgagagaagctattaagcgcgggctgcggacactgatcctcgccccgaccagagtcgtggctgccgagatggaagaggcgctgcgcggacttcccattcggtatcaaacccctgccatcaaagctgagcacacaggcagagaaatcgttgacctgatgtgtcatgccacgttcaccatgcggctcctgagccccgtgcgcgtccctaactacaatctcattatcatggatgaggctcactttacagaccccgcctccattgccgctagagggtatatctctacccgggtggaaatgggcgaggcggccggaattttcatgacagctaccccgcctggcagccgcgatccctttccccagtccaacgcccctatcatggacgaggaaagagagatccccgaacggagctggaactctgggcacgagtgggttacggatttcaagggaaagacagtgtggtttgtcccttccattaaagccggcaacgacatcgctgcctgcctgagaaagaatgggaaaaaggtgattcagcttagccgcaaaaccttcgattctgaatacgttaagacccgggcgaacgactgggattttgtggtcacaaccgacatcagcgagatgggagctaatttcaaggccgagagagtgattgatccgcgccggtgtatgaaacccgtgatcctgacagacggcgaagagagagtcatcctggccgggcctatgcccgttacccattcctctgctgcccaacgccggggcagaattggacgcaaccctaagaatgaaaacgaccagtatatctacatgggcgagcccctcgaaaatgatgaggactgcgcgcactggaaagaggccaagatgctgcttgataacattaatacgccggaagggatcattcctagcatgtttgagcccgaaagagagaaagtggacgctatcgatggagaataccggctgcgcggcgaggccagaaagacattcgtggacctcatgcggcgcggggatctgcctgtctggctggcttataaagtggccgctgagggaattaactacgccgacagaaagtggtgttttgatggcatcaagaataaccagatcctcgaagagaacgttgaagtggagatttggaccaaagagggggaacggaagaaacttaagcccagatggctggacgcgcgcatctattccgatcctctggccctcaaagagttcaaggagttcgctgccggccggaagtctctgacacttaatctgattaccgagatgggaagactccccacgtttatgacccagaaagctcgcaacgccctggacaatctggccgtcctccatacagctgaagcgggcgggcgggcctacaaccacgctcttagcgagctgccggagaccctggaaacactcctgcttctgaccctcctggccacagtgaccggaggcatcttcctgtttctcatgtccgggaagggaattggcaaaatgacgcttggcatgtgctgcatcatcacagccagcattctgctgtggtatgctcaaatccagcctcactggattgccgcgtctatcattctcgagttctttctgatcgttcttctgatccccgaacccgagaagcagagaacccctcaggataatcaactcacctacgtggtcattgccatcctgacagtggtcgctgccaccatggctaacgaaatggggttcctggagaaaacaaagaaggacctcggacttggctccattacgacccaggagagcgaatccaatatcctggacattgatctgcggccggcctctgcgtggacactctatgccgtggctaccacatttgttacccccatgctgcgccatagcatcgagaactcctctgtgaatgtgagccttacggccattgctaaccaggccaccgtcctgatggggctcggaaaaggctggcctctgtccaagatggacatcggggttcccctgctcgctatcggatgttacagccaggtgaatcctattacacttaccgccgcgctgctgctcctggtggcccactacgctatcattggccccggccttcaagccaaagctacaagagaagcccagaagcgggccgcggctgggatcatgaaaaaccctaccgtcgatggaattacggtgatcgacctggagccgatcccctatgatcctaagttcgaaaagcagctcggccaggttatgctgctgattctctgcgtgacacaagtccttatgatgcgcaccacatgggccctgtgtgaggctctgaccctcgccaccgggcccatctctacactgtgggagggaaatcctggcagattttggaacacgaccattgccgtgtccatggctaatatcttccgggggagctaccttgccggagcgggcctgctcttttctattatgaaaaacacaaccaatacacgcagaggcaccgggaacatcggagaaacgctgggcgagaagtggaaatcccggctgaacgccctcggaaagagcgagttccagatctataaaaagtctggcattcaggaggtcgaccgcacacttgctaaagagggcatcaagagaggggaaaccgatcatcacgccgtgagccggggatccgctaagctgagatggtttgttgagcgcaatatggtgacccccgaaggcaaagtcgtggacctgggctgcgggcggggaggctggtcttactattgtgggggactcaagaacgttagagaggtgaaaggcctgacaaaagggggaccgggccatgaagaacctattcccatgagcacctacggctggaatcttgtccgcctgcaatccggggtggatgtgttcttcacaccccctgagaaatgcgacacgctcctgtgtgatatcggagaaagctcccccaaccctaccattgaggccggccggacactgagagttctcaatcttgtcgaaaactggctgaataacaatacccagttttgcatcaaggtgctgaacccgtatatgccctctgtgatcgagaagatggaaacactccagcgcaaatacgggggagcgctggtccggaatcctcttagcagaaactccacccacgagatgtactgggtttctaatgccacgggcaacattgtgagctccgtgaatatgatctctcgcatgctgattaaccggttcaccatgaagcacaaaaaggctacatatgagcccgacgtcgatctcgggagcggaaccagaaacatcggcattgaatccgagatccctaatctggacattatcggcaaacgcatcgaaaagattaagcaggagcatgaaacaagctggcactacgaccaagatcatccctataaaacctgggcctaccacgggtcttatgagacaaagcagaccggatccgctagctctatggtgaacggcgttgtgcggctgctcacgaaaccgtgggacgtcgtgcctatggttacacagatggccatgaccgataccacaccctttgggcagcaaagagtgttcaaggagaaagtcgacacgcgcacccaggaacctaaggagggaacaaagaaacttatgaagatcaccgctgaatggctgtggaaagagctgggcaagaaaaagacacccagaatgtgtacccgggaggaatttacacgcaaagtgagatccaatgccgcgctcggggccattttcaccgatgagaacaagtggaaaagcgctcgggaagccgtggaggacggaagattttgggaactggtcgatcgggagcgcaatcttcacctggagggcaaatgcgaaacgtgtgtttacaacatgatgggcaagagagagaaaaagctcggggagttcggaaaagctaagggctctcgggccatctggtatatgtggctgggggcccgctttctggagttcgaagcgctcggatttctgaatgaggaccattggttctccagaggcaacagcctttccggggtggagggcgaaggactgcaccggctcggctacattctgcgcgatgtggggaagaaagagggaggcgctatgtacgccgacgataccgccgggtgggacacaagaatcacccttgaagacctgaagaatgaggaaatggtcacaaaccatatgaaaggagagcacaagaaactcgctgaggccatctttaagctgacctatcagaataaggtggttcgggtgcagcgccctacgcccagaggcacagtcatggatattatcagccggcgcgaccaaagagggtctggccaggtgggaacctacggcctgaacacattcaccaatatggaagctcagctcattcggcaaatggagggggaaggaatcttccgcagcattcagcatctgacggccaccgaggagatcgcggttcagaactggcttgccagagtgggccgggaaagactgtcccgcatggctatctctggggatgactgcgtcgtgaaaccgattgatgaccggtttgccagcgctctcacagccctgaatgatatgggaaaggttagaaaagacatccagcaatgggagccttcccgcggctggaacgattggacccaggtgcccttctgctctcaccactttcatgaacttgtcatgaaggacgggcgggtgctggtcgtgccctgtagaaaccaggatgagctcattggccgcgcgcggatcagccagggagccggctggtccctgaaagaaacagcttgcctggggaagtcttatgcccaaatgtggaccctcatgtacttccacagacgcgacctgcggcttgctgccaatgctatttgtagcgccgttccttcccattgggtgccgacaagcagaaccacgtggtctatccacgcgaagcacgagtggatgacaaccgaggatatgctggccgtctggaaccgcgtgtggattcaggaaaatccctggatggaggacaaaacccctgtggaatcctgggaggaagttccctatctcggaaagcgggaggaccagtggtgcggcagcctgatcgggcttacatctagagctacctgggccaaaaacatccagacagccattaatcaagtgcggtccctgatcggaaacgaggaatacacggattatatgcctagcatgaagagatttcgccgggaggaagaggaagctggcgtcctctggtga

SEQ ID NO: 20012 - RNA, 9876 nt, synthetic construct
  misc_feature 1..9876: note = derived and/or modified CDS sequence (opt5) from DENV-2__FJ639732__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtggtgatcacctggattggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggttaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctgttaaagacaatagagccgtgcacgcggatatgggctattggatcgaatctgccctcaacgacacgtggaagatggagaaggcttccttcatcgaggtcaaaagctgccactggcctaagtctcatacactgtggagcaatggggtgctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtcgttgtgacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtcaccgccggccatgggcagattgataacttttctctgggagtgctgggcatggctcttttcctcgaagagatgctgagaacgcgcgttgggaccaaacacgcgatcctgctcgtggccgtcagctttgtgacactgattaccggaaatatgtccttccgggaccttggcagagttatggtgatggtcggcgctacaatgaccgatgacatcgggatgggagtgacgtatctggccctcctggccgcttttaaggttcgccctacattcgccgcgggcctgcttctgagaaaactcacctctaaggagctgatgatggctacaatcgggattaccctcctgagccagtccaccatccccgaaacaattcttgagctgacggatgccctcgccctgggaatgatggtgctgaaaatcgtccggaacatggaaaagtaccaacttgctgtgaccattatggccatctcttgcgtgcctaatgcggtcatcctgcgcaacgcttggaaggttagctgtacaattctcgccgccgtgtccgtgagccccctgctcctgacctcttcccagcagaaagctgactggatccctcttgccctgacaattaagggcctcaatcccaccgctatctttctgacgacactgagcagaacctctaaaaagcggtcctggccgcttaacgaggccattatggcggtcgggatggtgagcatcctggcctcttccctcctgaaaaatgacatccctatgaccggacccctcgttgctggcggcctgcttacagtgtgctatgtcctgaccgggcgcagcgccgatctggaactcgagagagctgccgacgtgaagtgggaggatcaggccgaaatttccggaagctctcctatcctgagcattacaatctccgaggacggctctatgagcattaaaaacgaagaggaggaacaaacgcttaccatcctgattcggacagggctcctggttatctccggagtgttccccgtctctatcccgattaccgctgcggcctggtacctctgggaggtgaagaagcagcgcgctggcgtcctgtgggatgtgccttctccccctcccgttgggaaagccgaacttgaggacggagcctatagaatcaagcagcggggcattctgggctactcccagatcggggctggagtgtataaagaaggcacatttcacaccatgtggcatgtcacgcgcggggccgtgctgatgcacagaggaaagcggattgagccctcctgggcggatgttaaaaaggacctcatcagctacggcgggggatggaagctggagggcgaatggaaagagggcgaagaggtgcaagtccttgctctggaacctgggaagaatccgagagccgtgcagaccaaacccggaatcttcaagacaaacaccggcacaattggggccgtgtccctcgattttagccctggaacctctggctcccccatcgttgaccgcaaagggaaggtcgtgggactgtacggcaatggcgtggtcacacggagcggggcttatgtgtctgccattgcgcagacggagaagtccatcgaggataaccctgaaattgaggacgatatcttccgcaagaagcgcctcaccatcatggacctgcatcccggagctggcaaaacaaagcggtaccttcctgccattgttagagaagccatcaaacgcgggctgcggaccctgattctcgctccgaccagagtggtcgccgctgagatggaagaggccctgcgcggacttcccatccggtatcagacccctgcgattaaggccgagcacacgggcagagaaatcgtggacctgatgtgtcatgctaccttcacaatgcggctcctgagccccgttcgcgtgcctaactacaatctcattatcatggatgaggcccactttaccgaccccgcttccatcgccgccagagggtatatttctacacgggtcgaaatgggcgaggctgcgggaatcttcatgaccgccacgccgcctggcagccgcgatccctttccccaatccaacgctcctattatggacgaggaaagagagatccccgaacggagctggaactctgggcacgagtgggtgacagatttcaagggaaaaaccgtttggtttgtgccttccattaaggccggcaacgacatcgccgcttgcctgcgcaagaatgggaagaaagtcatccagcttagccgcaagaccttcgattctgaatacgtgaagacacgggccaacgactgggattttgtggtcaccacagacattagcgagatgggagcgaatttcaaagctgagagagttatcgatccgcgccggtgtatgaagcccgtgattctgaccgacggcgaagagagagtgatcctggccgggcctatgcccgtcacgcattcctctgccgctcagcgccggggcagaattggacgcaaccctaaaaatgaaaacgaccaatatatctacatgggcgagcccctcgaaaatgatgaggactgcgcccactggaaggaggcgaaaatgctgcttgataacatcaatacaccggaagggattatccctagcatgtttgagcccgaaagagagaaggtggacgccattgatggagaataccggctgcgcggcgaggctagaaaaaccttcgttgacctcatgcggcgcggggatctgcctgtgtggctggcctataaggtcgctgccgagggaatcaactacgctgacagaaagtggtgttttgatggcattaaaaataaccagatcctcgaagagaacgtggaagttgagatttggacaaaggagggggaacggaagaaacttaaacccagatggctggacgcccgcatctattccgatcctctggcgctcaaagagttcaaggagttcgccgctggccggaaatctctgacccttaatctgatcacggagatgggaagactccccacctttatgacacagaaggcccgcaacgctctggacaatctggccgtgctccataccgccgaagctggcgggcgggcgtacaaccacgcccttagcgagctgccggagacactggaaaccctcctgcttctgacactcctggctaccgtcacgggaggcattttcctgtttctcatgtccgggaaaggaatcggcaagatgacacttggcatgtgctgcattatcaccgccagcgtgctgctgtggtatgcccagattcaacctcactggatcgctgcctctatcattctcgagttctttctgatcgtccttctgattcccgaacccgagaaacagagaacccctcaggataatcagctcacatacgtggttatcgcgattctgaccgtggtggccgctacaatggccaacgaaatggggttcctggagaagacgaagaaagacctcggacttggctccatcaccacacaagagagcgaatccaatatcctggacattgatctgcggccggcttctgcctggaccctctatgcggtcgccacaacctttgttacgcccatgctgcgccatagcatcgagaactcctctgtgaatgtgagccttaccgctattgccaaccaggctacagtcctgatggggctcggaaagggctggcctctgtccaaaatggacatcggggtgcccctgctcgccattggatgttacagccaggttaatcctatcacccttacagctgccctgctgctcctggtggcgcactacgccattatcggccccggccttcaggctaaggccaccagagaagctcaaaaacgggccgccgcggggatcatgaagaaccctacggtcgatggaattacagtgatcgacctggagccgattccctatgatcctaagttcgaaaaacagctcggccaggtcatgctgctgatcctctgcgtgacccaggttcttatgatgcgcacaacctgggctctgtgtgaggccctgaccctcgctacagggcccatttctacgctgtgggagggaaatcctggcagattttggaacaccacaatcgccgtgtccatggccaatatcttccgggggagctaccttgctggagccggcctgctcttttctattatgaagaacaccacaaatacccgcagaggcacggggaacatcggagaaacactgggcgagaaatggaagtcccggctgaacgcgctcgggaaaagcgagttccaaatttataagaaatctggaatccaggaggtcgaccgcacccttgccaaggagggcattaagagaggggaaaccgatcatcacgctgtgagccggggatccgccaaactgagatggtttgttgagcgcaatatggtgacacccgaaggcaaggtcgtggacctgggctgcgggcggggaggctggtcttactattgtgggggactcaaaaacgtgagagaggttaagggcctgaccaaagggggaccgggccatgaagaacctatccccatgagcacatacggctggaatcttgtccgcctgcagtccggggtggatgtgttcttcacgccccctgagaagtgcgacaccctcctgtgtgatatcggagaaagctcccccaaccctacaattgaggctggccggaccctgagagtcctcaatcttgttgaaaactggctgaataacaatacacaattttgcatcaaggtgctgaacccgtatatgccctctgtgattgagaaaatggaaaccctccagcgcaagtacgggggagccctggtccggaatcctcttagcagaaactccacgcacgagatgtactgggtgtctaatgcgaccggcaacatcgttagctccgtgaatatgatttctcgcatgctgatcaaccggttcacaatgaaacacaagaaagccacctatgagcccgacgtcgatctcgggagcggaacaagaaacatcggcattgaatccgagatccctaatctggacattatcggcaagcgcattgaaaagatcaaacaggagcatgaaaccagctggcactacgaccaggatcatccctataagacatgggcttaccacgggtcttatgagaccaaacaaacgggatccgccagctctatggtgaacggcgttgtgcggctgctcacaaagccgtgggacgtcgtgcctatggtgacccagatggctatgaccgatacaacgccctttgggcagcagagagtcttcaaagagaaggttgacacccgcacacaagaacctaaggagggaaccaagaaacttatgagaattacagccgaatggctgtggaaagagctgggcaaaaagaaaacaccccggatgtgtacacgcgaggaatttaccagaaaagtgcggtccaatgctgccctcggggcgatcttcacggatgagaacaagtggaaaagcgccagagaagctgtggaggacggacggttttgggaactggtcgatcgcgagagaaatcttcacctggagggcaaatgcgaaacctgtgtgtacaacatgatgggcaagcgggagaaaaagctcggggagttcggaaaagccaagggctctcgcgctatctggtatatgtggctgggggccagatttctggagttcgaagccctcggatttctgaatgaggaccattggttctcccggggcaacagcctttccggggttgagggcgaaggactgcaccgcctcggctacattctgagagatgtggggaagaaagagggaggcgcgatgtacgctgacgatacagccgggtgggacacccggatcacacttgaagacctgaagaatgaggaaatggtcaccaaccatatgaaaggagagcacaagaaactcgccgaggctatttttaagctgacgtatcagaataaggtggttcgcgtgcagagacctacaccccggggcaccgtcatggatatcattagccgcagagaccagcgggggtctggccaagtgggaacatacggcctgaacaccttcacgaatatggaagcccagctcatccgccagatggagggggaaggaatcttcaaaagcattcaacatctgaccgctacagaggagatcgccgttcagaactggcttgcgagagtgggccgggaaagactgtcccgcatggccatttctggggatgactgcgtcgtgaagccgatcgatgaccggtttgctagcgccctcaccgctctgaatgatatgggaaaagtcagaaaggacattcagcagtgggagccttcccgcggctggaacgattggacacaagtgcccttctgctctcaccactttcatgaacttgttatgaaagacgggcgggtgctggtcgtgccctgtagaaaccaggatgagctcatcggccgcgcccggatcagccagggagcgggctggtccctgaaggaaaccgcctgcctggggaagtcttatgctcagatgtggacactcatgtacttccacagacgcgacctgcggcttgccgctaatgccatttgtagcgctgtgccttcccattgggttccgaccagcagaacgacatggtctatccacgccaaacacgagtggatgaccaccgaggatatgctggcggtgtggaaccgcgtctggattcaagaaaatccctggatggaggacaagacacctgtggaatcctgggaggaagttccctatctcggaaaacgggaggaccagtggtgcggcagcctgatcgggcttacctctagagccacatgggctaagaacattcagacggccatcaatcaggtgcggtccctgattggaaacgaggaatacaccgattatatgcctagcatgaaaagatttcgccgggaggaagaggaagccggcgtcctctggtga

SEQ ID NO: 20013 - RNA, 9876 nt, synthetic construct
  misc_feature 1..9876: note = derived and/or modified CDS sequence (opt5) from DENV-2__FJ639733__SS-prME
  source 1..9876: mol_type = other RNA
acagccggcgtgatcattatgctgatccccacagctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttatcgaaaaggacagcccggtgaacattgaggccgaacccccttttggggattcttacatcatcattggcgtcgagcccggacagctcaaactgaattggttcaagaagggctccagcatcgggcaaatgtttgaggctaccatgagaggagccaaacgcatggccattcttggcgacacagcttgggatttcgggtctctgggaggcgcctttaccagcatcgggaaggcgctccaccaggtgttcggcgctatttacggagccgccttttccggcgtttcttggacgatgaaaatcctgatcggggtggtcattacatggatcggaatgaacagccggtccaccagcctgtctgtgtcccttgtgctcgttggcgtcgtgaccctgtatctgggggctatggtgcaggccgacagcggatgtgtcgtgtcttggaagaataaagaactcaagtgcggctccgggattttcatcacagataacgttcacacctggacagagcagtacaagtttcaacctgaaagcccctccaaactggcttctgccattcagaaggcgcatgaggaaggcatctgtggaatcagaagcgtgacgcgccttgagaatctgatgtggaaacagattaccccggagctcaaccacatcctgtccgaaaatgaggtcaagctgacaattatgaccggcgacacaaaagggatcatgcaggccggaaagcggtctcttagacctcaacccaccgaactcaaatatagctggaagacgtggggcaaggctaaaatgctgtccaccgagagccataaccagacattcctgattgatgggcctgaaaccgccgagtgccccaatacaaaccgcgcttggaactctctcgaggtggaagactacggatttggcgttttcaccacaaacatctggctgaaacttcgggagaaacaggacgtgttttgtgattccaagctgatgagcgccgcgatcaaagacaatagagccgtccacgctgatatgggctattggattgaatctgccctcaacgacacctggaagatggagaaggcttccttcatcgaggtgaaaagctgccactggcctaagtctcatacgctgtggagcaatggggttctggaatccgagatgattatccccaaaaacttcgccggaccggtgagccagcacaactaccgccctggctatcatacacaaaccgccgggccctggcaccttggaaagctcgaaatggattttgacttctgtgagggcaccacagtcgtggtgaccgaagattgcgggaatcggggaccctctctgagaacgacaaccgcttccggcaaactgattacagagtggtgctgtcggagctgcaccctccctccgctgcgctacagaggcgaggacgggtgttggtacggaatggaaatccggccccttaaggagaaggaagagaacctggtcaattccctcgttacagcgggccatgggcagattgataacttttctctgggagtgctgggcatggcccttttcctcgaagagatgctgagaacccgcgtggggacgaaacacgctatcctgctcgtcgccgtgagctttgttaccctgatcacaggaaatatgtccttccgggaccttggcagagtgatggtcatggtgggcgccaccatgacagatgacattgggatgggagttacctatctggctctcctggccgcgtttaaggtgcgccctacgttcgctgccggcctgcttctgagaaaactcacatctaaggagctgatgatggccaccatcgggattacactcctgagccagtccaccatccccgaaaccattcttgagctgacagatgctctcgccctgggaatgatggtcctgaaaatcgtgcggaagatggaaaagtaccaacttgcggttacgatcatggctatttcttgcgtgcctaacgccgtcatcctgcgcaatgcctggaaagtgagctgtaccattctcgctgccgtgtccgtcagccccctgctcctgacatcttcccagcagaaggctgactggatccctcttgccctgaccattaaaggcctcaaccccacagcgatctttctgaccacgctgagcagaacatctaagaaacggtcctggccgcttaatgaggccatcatggctgttgggatggtgagcattctggcctcttccctcctgaagaacgacatccctatgaccggacccctcgtggctggcggcctgcttaccgtctgctatgtgctgacagggcgcagcgccgatctggaactcgagagagccgctgacgttaaatgggaggatcaggcggaaatttccggaagctctcctatcctgagcattaccatctccgaggacggctctatgagcattaagaatgaagaggaggaacaaacacttacgatcctgatccggaccgggctcctggtgatttccggagtcttccccgtgtctatcccgattacagccgctgcctggtacctctgggaggttaagaaacagcgcgccggcgtgctgtgggatgtcccttctccccctcccgtggggaaggctgaacttgaggacggagcctatagaatcaaacagcggggcattctgggctactcccagatcggggcgggagtctataaggaaggcacctttcacacaatgtggcatgtgacccgcggggctgttctgatgcacagaggaaaacggatcgagccctcctgggccgatgtgaagaaggacctcattagctacggcgggggatggaaactggagggcgaatggaaggagggcgaagaggtccaagtgcttgccctggaacctgggaaaaacccgagagctgttcagacgaagcccggaatcttcaaaaccaatacaggcaccattggggccgtgtccctcgattttagccctggaacatctggctcccccatcgtcgaccgcaaggggaaggtggtgggactgtacggcaacggcgttgtcacccggagcggggcgtatgtgtctgctattgcccagacagagaaatccatcgaggataatcctgaaatcgaggacgatattttcagaaagaaacgcctcacgatcatggacctgcatcccggagccggcaagaccaaacggtaccttcctgctattgtgagagaagccatcaagcgcgggctgcggacactgattctcgctccgaccagagtcgtggccgcggagatggaagaggccctgcgcggacttcccatccggtatcagacccctgctattaaggccgagcacacaggcagagaaatcgttgacctgatgtgtcatgctacgttcaccatgcggctcctgagccccgtgcgcgtccctaactacaacctcatcattatggatgaggcccactttacagaccccgcctccatcgctgcgagagggtatatttctacccgggtggaaatgggcgaggccgctggaatcttcatgacagccaccccgcctggcagccgcgatccctttccccaatccaatgcccctattatggacgaggaaagagagatccccgaacggagctggaactctgggcacgagtgggttacggatttcaaaggaaagacagtgtggtttgtcccttccatcaaagctggcaatgacattgccgcgtgcctgagaaagaacgggaaaaaggtgatccagcttagccgcaagaccttcgattctgaatacgttaaaacccgggctaatgactgggattttgtggtcacaaccgacattagcgagatgggagccaacttcaaggccgagagagtgatcgatccgcgccggtgtatgaaacccgtgattctgacagacggcgaagagagagtcatcctggctgggcctatgcccgttacccattcctctgccgcgcagcgccggggcagaatcggacgcaatcctaagaacgaaaatgaccaatatatttacatgggcgagcccctcgaaaacgatgaggactgcgcccactggaaagaggctaagatgctgcttgataatatcaacacgccggaagggattatccctagcatgtttgagcccgaaagagagaaagtggacgccattgatggagaataccggctgcgcggcgaggctagaaagacattcgtggacctcatgcggcgcggggatctgcctgtctggctggcctataaggtggctgccgagggaatcaattacgcggacagaaaatggtgttttgatggcattaagaacaatcagatcctcgaagagaacgttgaagtggagatctggaccaaagagggggaacggaagaaacttaagcccagatggctggacgcccgcatttattccgatcctctggctctcaaggagttcaaagagttcgccgctggccggaagtctctgacacttaacctgatcaccgagatgggaagactccccacgtttatgacccagaaagcccgcaatgccctggacaacctggctgtcctccatacagcggaagccggcgggcgggcttacaatcacgcccttagcgagctgccggagaccctggaaacactcctgcttctgaccctcctggccacagtgaccggaggcattttcctgtttctcatgtccgggaagggaatcggcaaaatgacgcttggcatgtgctgcattatcacagctagcgttctgctgtggtatgcccagatccaacctcactggattgcggcctctatcattctcgagttctttctgatcgtgcttctgattcccgaacccgagaagcagagaacccctcaggataaccagctcacctacgtcgtgatcgctatcctgacagtcgtggccgctaccatggccaatgaaatggggttcctggagaagaccaagaaggacctcggacttggctccattacgacccaagagagcgaatccaacatcctggacattgatctgcggccggcgtctgcctggacactctatgctgttgccaccacatttgtgacccccatgctgcgccatagcatcgaaaatagctctgtgaacgtcagccttacggctattgccaatcaggctaccgttctgatggggctcggaaaaggctggcctctgtccaagatggacatcggggtgcccctgctcgccattggatgttacagccaggtgaaccctatcacacttaccgcggccctgctgctcctggtcgctcactacgccatcattggccccggccttcaggctaaagccacaagagaagcccaaaagcgggcggctgccgggatcatgaagaatcctaccgtggatggaattacggttatcgacctggagccgattccctatgatcctaaattcgaaaagcagctcggccaggtgatgctgctgatcctctgcgtcacacaggtgcttatgatgcgcaccacatgggctctgtgtgaggccctgaccctcgccaccgggcccatctctacactgtgggagggaaaccctggcagattttggaatacgaccattgctgtctccatggccaacatcttccgggggagctaccttgcgggagccggcctgctcttttctattatgaaaaatacaaccaacacacgcagaggcaccgggaatatcggagaaacgctgggcgagaagtggaaatcccggctgaacgctctcggaaagagcgagttccaaatttataaaaagtctggaatccaggaggtggaccgcacacttgccaaggagggcatcaaaagaggggaaaccgatcatcacgctgttagccggggatccgccaagctgagatggtttgtggagcgcaacatggtcacccccgaaggcaaagtggttgacctgggctgcgggcggggaggctggtcttactattgtgggggactcaagaatgtgagagaggtcaaaggcctgacaaaagggggaccgggccatgaagaacctattcccatgagcacctacggctggaaccttgtgcgcctgcagtccggggtggatgttttcttcacaccccctgagaagtgcgacacgctcctgtgtgatatcggagaaagctcccccaatcctaccattgaggcgggccggacactgagagtcctcaaccttgtggaaaattggctgaacaataacacccaattttgcatcaaagtgctgaatccgtatatgccctctgtcattgagaagatggaaacactccagcgcaaatacgggggagccctggttcggaaccctcttagcagaaattccacccacgagatgtactgggtgtctaacgctacgggcaatatcgtgagctccgtcaacatgatctctcgcatgctgattaatcggttcaccatgaagcacaaaaaggccacatatgagcccgacgtggatctcgggagcggaaccagaaacatcggcattgaatccgagatccctaacctggacattatcggcaagcgcattgagaagatcaagcaggagcatgaaacaagctggcactacgaccaggatcatccctataaaacctgggcttaccacgggtcttatgagacaaagcaaaccggatccgccagctctatggttaatggcgtggtccggctgctcacgaaaccgtgggacgtggttcctatggtgacacagatggctatgaccgataccacaccctttgggcagcagagagtcttcaaggagaaggtggacacgcgcacccaagaacctaaagagggaacaaagaaacttatgagaatcaccgccgaatggctgtggaaggagctgggcaaaaagaaaacaccccggatgtgtacccgcgaggaatttacaagaaaggtgcggtccaacgcggccctcggggctattttcaccgatgagaataagtggaaaagcgccagagaagctgtcgaggacggacggttttgggaactggttgataaggagcgcaaccttcacctggagggcaaatgcgaaacgtgtgtgtacaatatgatgggcaagagagagaaaaagctcggggagttcggaaaggccaaaggctctcgggccatctggtatatgtggctgggggcgcgctttctggagttcgaagctctcggatttctgaacgaggaccattggttctccagaggcaatagcctttccggggtggagggcgaaggactgcaccggctcggctacattctgcgcgatgtcgggaagaaagagggaggcgccatgtacgccgacgataccgctgggtgggacacaagaatcacccttgaagacctgaagaacgaggaaatggtgacaaatcatatgaaaggagagcacaagaagctcgccgaggctatttttaaactgacctatcagaacaaggttgtgcgggtccagcgccctacgcccagaggcacagtgatggatatcatcagccggcgcgaccagagagggtctggccaagttggaacctacggcctgaatacattcaccaacatggaagcccagctcattcggcagatggagggggaaggaatcttcaaaagcattcaacatctgacggcgaccgaggagatcgccgtgcagaattggcttgctcgcgtcggcagagaacggctgtccagaatggccatttctggggatgactgcgtggttaagccgatcgatgaccgctttgctagcgccctcacagcgctgaacgatatgggaaaagtgcggaaggacatccagcagtgggagccttccagaggctggaatgattggacccaagtccccttctgctctcaccactttcatgaacttgtgatgaaggacgggcgcgtcctggtggttccctgtcggaaccaggatgagctcattggcagagcccgcatcagccagggagctggctggtccctgaaagaaacagcctgcctggggaagtcttatgctcagatgtggaccctcatgtacttccaccggagagacctgcgccttgccgctaacgccatttgtagcgcggtgccttcccattgggtcccgacaagccggaccacgtggtctatccacgccaaacacgagtggatgacaaccgaggatatgctggctgtgtggaatagagtgtggattcaagaaaacccctggatggaggacaagacccctgttgaatcctgggaggaagtgccctatctcggaaaacgcgaggaccagtggtgcggcagcctgatcgggcttacatctcgggccacctgggccaagaatattcagacagctatcaaccaggtcagatccctgatcggaaatgaggaatacacggattatatgcctagcatgaagcggtttagacgcgaggaagaggaagccggcgtgctctggtga

SEQ ID NO: 20014 - RNA, 9876 nt, synthetic construct
  misc_feature 1..9876: note = derived and/or modified CDS sequence (opt5) from DENV-2__FJ639734__SS-prME
  source 1..9876: mol_type = other RNA
acagccggagtgatcgtcatgctgattcccacagctatcgccttccacctcacgaccagaaatggggagcctcatatgattgttggacggcaggaaaagggcaaaagcctgctttttaagacagaggacggggtgaatatgtgcaccctgatggcgatcgatctcggagaactgtgtgaggacacaattacctacaaatgcccgcttctgagacaaaatgaacccgaggatatcgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggattctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacatcgtcctcgagcacgggtcctgtgtgacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaatcaagattacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgatcgtgattagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcatcggcgtggagcccggacagctcaaactgaattggttcaagaagggctccagcattgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtggtgatcacctggattggaatgaacagccggtccacaagcctgtctgtttcccttgtcctcgtgggcgtggtcaccctgtatctgggggccatggtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacacgaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacgaacatttggctgaaacttcgggagaaacaggacgtgttttgtgattccaagctgatgagcgccgctatcaaagacaatagagccgttcacgcggatatgggctattggatcgaatctgccctcaacgacacatggaagatggagaaggcttccttcattgaggtgaaaagctgccactggcctaagtctcataccctgtggagcaatggggtcctggaatccgagatgatcattcccaaaaacttcgccggaccggtgagccagcacaactaccgccctggctatcatacccaaacagctgggccctggcaccttggaaagctcgaaatggattttgacctgtgtgagggcaccacggtggtcgttacagaagattgcgggaatcggggaccctctctgagaaccacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgtgaatagcctggtgacggccggccatgggcagatcgataacttctctctgggagtccttggcatggctctctttctggaagagatgctgagaacccgcgtggggacaaaacacgcgattctcctggttgccgtgagcttcgtcacccttatcacaggaaatatgtcctttcgggacctgggcagagtgatggttatggtgggcgctaccatgacggatgacatcgggatgggagtcacatatctcgccctgctggccgctttcaaggtgcgccctacctttgccgcgggccttctgctcagaaaactgacatctaaggagctcatgatggctaccattgggatcgccctgcttagccagtccaccattcccgaaacaatcctggagctcacggatgccctggctctgggaatgatggttcttaaaattgtgcggaacatggaaaagtaccaactggccgtcaccatcatggcgatctcttgcgtgcctaatgctgtgattctccgcaacgcctggaaggtcagctgtacaatcctggccgctgtttccgtgagccccctcctgcttacctcttcccagcagaaagccgactggattcctctggctctcacaatcaagggcctgaatcccaccgccattttcctgacgacacttagcagaacctctaaaaagcggtcctggccgctgaacgaggcgatcatggccgtggggatggtcagcatcctcgcttcttccctgctcaaaaatgacattcctatgaccggacccctggtggccggcggccttctgacagtttgctatgtgctgaccgggcgcagcgctgatctcgaactggagagagccgccgaggtcaagtgggaagaccaggctgagatctccggaagctctcctattcttagcatcacaatttccgaagatggctctatgagcatcaaaaacgaggaggaggaacaaacgctgaccattctcatccggacagggctgctcgtgatctccggagtttttcccgtgtctattccgatcaccgcggccgcttggtacctgtgggaagtcaagaagcagcgcgccggcgtgctttgggacgtcccttctccccctcccgtggggaaagccgagctggaagatggagcttatagaattaagcagcggggcatcctgggctactcccagattggggccggagtttataaagagggcacattccacaccatgtggcatgtgacgcgcggggcggtcctcatgcacagaggaaagcggatcgagccctcctgggctgacgtgaaaaaggatctgatcagctacggcgggggatggaaacttgaaggcgagtggaaagaaggcgaggaagttcaagtgctggccctcgagcctgggaagaatccgagagccgtccagaccaaacccggaatttttaagacaaacaccggcacaatcggggctgtgtccctggacttcagccctggaacctctggctcccccattgtggatcgcaaagggaaggttgtcggactctacggcaatggcgtggtgacacggagcggggcctatgtctctgcgatcgctcagacggagaagtccattgaagacaaccctgagatcgaagatgacatctttcgcaagaagcgcctgaccattatggatcttcatcccggagccggcaaaacaaagcggtacctgcctgccatcgtgagagaggctattaaacgcgggctgcggaccctcatcctggccccgaccagagttgtggctgccgaaatggaggaggcgcttcgcggactgcccattcggtatcagacccctgccatcaaggctgaacacacgggcagagagattgtcgacctcatgtgtcatgccaccttcacaatgcggctgctcagccccgtgcgcgttcctaactacaatctgatcatcatggacgaagctcacttcaccgatcccgcctccattgccgctagagggtatatctctacacgggtggagatgggcgaggcggccggaatttttatgaccgctacgccgcctggcagccgcgaccccttcccccaatccaacgcccctatcatggatgaagagagagaaattcccgagcggagctggaactctgggcacgaatgggtcacagactttaagggaaaaaccgtgtggttcgttccttccatcaaggccggcaacgatatcgctgcctgccttcgcaagaatgggaagaaagtgattcagctgagccgcaagacctttgactctgagtacgtcaagacacgggcgaacgattgggacttcgtggtgaccacagatatcagcgagatgggagctaattttaaagccgaaagagtcattgacccgcgccggtgtatgaagcccgttatcctgaccgatggcgaggaaagagtgattctcgccgggcctatgcccgtgacgcattcctctgctgcccagcgccggggcagaatcggacgcaaccctaaaaatgagaacgaccaatatatctacatgggcgaacccctggagaatgacgaggattgcgcgcactggaaggaagccaaaatgcttctggacaacattaatacaccggaggggatcattcctagcatgttcgaacccgagagagaaaaggtcgatgctatcgacggagagtaccggctccgcggcgaggccagaaaaacctttgtggatctgatgcggcgcggggacctgcctgtttggctcgcttataaggtggccgctgaaggaattaactacgccgatagaaagtggtgtttcgacggcatcaaaaataaccagattcttgaggaaaacgtcgaggtggagatctggacaaaggaaggggagcggaaaaagctgaaacccagatggctggatgcgcgcatctattccgaccctctcgccctgaaggaatttaaggagttcgctgccggccggaaatctcttaccctgaatctcattacggaaatgggaagactgcccaccttcatgacacagaaggctcgcaacgccctggataatctcgccgttcttcataccgctgaggcgggcgggcgggcctacaaccacgctctgagcgagctgccggaaacactcgagaccctgcttctgctcacactgctggccaccgtgacgggaggcatctttctcttccttatgtccgggaaaggaattggcaagatgacactgggcatgtgctgcatcattaccgccagcgtcctgctctggtatgctcagatccaacctcactggatcgccgcgtctattatcctggaatttttccttattgtgctgctcatccccgagcccgaaaaacagagaacccctcaggacaatcagctgacatacgtcgtgattgccatcctgaccgttgtggctgccacaatggctaacgagatggggtttctcgagaagacgaagaaagatcttggactgggctccatcaccacacaagaaagcgagtccaatattctggacatcgacctccggccggcctctgcgtggaccctgtatgccgtggctacaaccttcgtcacgcccatgcttcgccatagcattgaaaactcctctgttaatgtgagcctgaccgccatcgctaaccaggccacagtgctcatggggctgggaaagggctggcctctgtccaaaatggatattggggtccccctccttgctatcggatgttacagccaggtgaatcctattaccctgacagccgcgctgctcctgcttgttgcccactacgctatcatcggccccggcctgcaggccaaggctaccagagaggcccaaaaacgggccgcggctgggattatgaagaaccctacggtggacggaatcacagtcattgatctcgaaccgatcccctatgaccctaagtttgagaaacagctgggccaggtgatgctgctcattctttgcgtcacccaggtgctgatgatgcgcacaacctgggccctgtgtgaggctctcaccctggccacagggcccatctctacgctttgggaaggaaatcctggcagattctggaacaccacaatcgccgtttccatggctaatatttttcgggggagctacctggccggagcgggcctcctgttctctatcatgaagaacaccacaaatacccgcagaggcacggggaacattggagagacactgggcgaaaaatggaagtcccggctcaacgcccttgggaaaagcgagtttcaaatctataagaaatctggcattcaggaggtggatcgcaccctggctaaggaaggcatcaagagaggggagaccgaccatcacgccgtcagccggggatccgctaaactgagatggttcgtggaacgcaatatggttacacccgagggcaaggtggtcgatctcggctgcgggcggggaggctggtcttactattgtgggggactgaaaaacgtgagagaagtgaagggccttaccaaagggggaccgggccatgaggagcctatccccatgagcacatacggctggaatctggttcgcctccagtccggggtcgacgtgtttttcacgccccctgaaaagtgcgataccctgctgtgtgacattggagagagctcccccaaccctacaatcgaagccggccggaccctcagagtgcttaatctggtcgagaactggctgaataacaatacacaattctgcattaaggttctcaacccgtatatgccctctgtgatcgagaagatggagaccctgcagcgcaagtacgggggagcgcttgtgcggaatcctctgagcagaaactccacgcacgagatgtactgggtctctaatgccaccggcaacattgtgagctccgttaatatgatctctcgcatgctcatcaaccggtttacaatgaaacacaagaaagctacctatgaacccgatgtggacctggggagcggaacaagaaacattggcatcgagtccgaaattcctaatctggatatcattggcaagcgcatcgagaagattaaacaggaacatgagaccagctggcactacgaccaggaccatccctataagacatgggcctaccacgggtcttatgagaccaaacaaacgggatccgctagctctatggtcaacggcgtggttcggctccttacaaagccgtgggatgtggtccctatggtgacccagatggccatgaccgacacaacgcccttcgggcagcagagagtgtttaaagaaaaggtcgatacccgcacacaagagcctaaggaaggaaccaaaaagctgatgaaaatcacagctgagtggctgtggaaggagctcggcaaaaagaaaacccccagaatgtgtacacgggaagagttcacccgcaaggttagatccaatgccgcgctgggggccatctttacggacgaaaacaagtggaaaagcgctcgggaggccgtggaagatggaagattctgggagcttgtggaccgggagcgcaatctgcacctcgaaggcaagtgcgagacctgtgtctacaacatgatgggcaaaagagaaaagaaactgggggagtttggaaaggctaagggctctcgggccatttggtatatgtggctgggggcccgcttcctcgaatttgaggcgctgggattccttaatgaggatcattggttttccagaggcaacagcctgtccggggtggaaggcgagggactccaccggctgggctacatccttcgcgacgttagcaaaaaggaagggggagctatgtacgccgatgacacagccggctgggataccagaattacactggaggacctcaaaaatgaagagatggtgaccaaccatatgaagggggagcacaaaaagctggctgaagccatcttcaagctgacgtatcagaataaagtcgtgcgggttcagcgccctacacccagaggaaccgtgatggacattatctctcggcgcgatcagagaggcagcgggcaagtcggcacatacggactcaacacctttacgaatatggaggctcagctgatccggcagatggaaggcgaggggattttcaagtccatccaacatcttaccgccacagaggaaattgcggtgcagaactggctggcccgcgttggaagagagcggctctctagaatggctatcagcggcgacgattgcgtggtcaaaccgattgacgatcgcttcgcctccgctctgaccgcccttaatgacatggggaaggtgcggaaagatatccagcagtgggaaccttctagaggatggaacgactggacacaagtccccttttgcagccaccacttccatgagctggtgatgaaggatggccgcgcgctcgttgtgccctgtcggaaccaggacgaactgatcgggagagcccgcacctcccagggcgctggatggtctctgaaggagacagcctgcctcggcaaaagctatgctcagatgtggaccctgatgtactttcaccggagagatcttcgcctggccgctaatgccatttgttccgcggtccctagccattgggtgccgacgtctcggacaacctggtccatccacgccaagcacgagtggatgaccacagaagacatgctcgctgtgtggaacagagtttggattcaagagaatccctggatggaagataaaacccctgtggagagctgggaagaggtcccctatctggggaagcgcgaggaccagtggtgcggatctcttatcggcctgacatcccgggccacgtgggccaaaaacattcagaccgctatcaatcaggtgagaagcctcattgggaacgaagagtacacagactatatgccttccatgaagcggttcagacgcgaagaggaagaggccggagttctgtggtga

SEQ ID NO: 20015 - RNA, 9876 nt, synthetic construct
  misc_feature 1..9876: note = derived and/or modified CDS sequence (opt5) from DENV-2__JN819408__SS-prME
  source 1..9876: mol_type = other RNA
acagccggagtgatcgtcatgctgattcccacagctatggccttccacctcacgacacggaatggggaacctcatatgatcgttggacggcaggaaaagggaaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacacgaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggttgaagactacggatttggcgtgttcaccacgaacatttggctgaaacttcgggagaaacaggacatcttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccgtgagctttgttaccctgatcacaggaaatatgtccttccgggaccttggcagagtgatggtcatggtgggcgctaccatgacggatgacattgggatgggagttacatatctggccctcctggccgcttttaaggtgcgccctaccttcgccgcgggcctgcttctgagaaaactcacatctaaggagctgatgatggctaccatcgggattgccctcctgagccagtccaccatccccgaaacaattcttgagctgacggatgccctcgctctgggaatgatggccctgaaaatcgtccggaacatggaaaagtaccaacttgcggtgaccatcatggctatttcttgcgttcctaatgccgtgatcctgcagaacgcctggaaggtcagctgtacaattctcgctgccgtgtccgtgagccccctgctcctgacctcttcccagcagaaagctgactggatccctcttgccctgacaattaagggcctcaatcccaccgcgatctttctgacgacactgagccgcacctctaaaaagagatcctggccgcttaacgaggccatcatggctgtcgggatggttagcattctggcctcttccctcctgaaaaatgacatccctatgaccggacccctcgtggctggcggcctgcttacagtgtgctatgtcctgaccgggcggagcgccgatctggaactcgagcgcgccgctgacgtgaagtgggaggatcaagcggaaatttccggaagctctcctatcctgagcattacaatctccgaggacggctctatgagcattaaaaacgaagaggaggaacagacgcttaccatcctgatcagaacagggctcctggttatttccggagtgttccccgtctctatcccgattaccgccgctgcctggtacctctgggaggtgaagaagcagcgggccggcgttctgtgggatgtgccttctccccctcccgtcgggaaagctgaacttgaggacggagcctatcgcatcaagcagagaggcattctgggctactcccaaatcggggcgggagtgtataaagaaggcacatttcacaccatgtggcatgtcacgagaggggctgtgctgatgcaccgcggaaagagaatcgagccctcctgggccgatgttaaaaaggacctcattagctacggcgggggatggaagctggagggcgaatggaaagagggcgaagaggtgcaggtccttgccctggaacctgggaagaatccgcgggctgtgcagaccaaacccggaatcttcagaacaaacaccggcacaattggggccgtttccctcgattttagccctggaacctctggctcccccatcgtggaccgcaaggggaaagtcgtgggactgtacggcaatggcgtggttacacggagcggggcgtatgtctctgctattgcccagacggagaagtccatcgaggataaccctgaaatcgaggacgatattttcagaaagaaacgcctcaccatcatggacctgcatcccggagccggcaagacaaaacggtaccttcctgctattgtgagagaagccatcaagcgcgggctgcggaccctgattctcgctccgaccagagtggtcgccgcggagatggaagaggccctgcgcggacttcccatccggtatcaaacccctgctattaaagccgagcacacgggcagagaaatcgtggacctgatgtgtcatgctaccttcacaatgcggctcctgagccccgttcgcgtgcctaactacaatctcatcattatggatgaggcccactttaccgaccccgcctccatcgctgcgagagggtatatttctacacgggtcgaaatgggcgaggccgctggaatcttcatgaccgccacgccgcctggcagccgcgatccctttccccagtccaacgcccctattatggacgaggaaagagagatccccgaacggagctggaactctgggcacgagtgggtgacagatttcaagggaaagaccgtttggtttgtgccttccatcaaagctggcaacgacattgccgcgtgcctgagaaagaatgggaaaaaggtcatccagcttagccgcaaaaccttcgattctgaatacgtgaagacacgggctaacgactgggattttgttgtgaccacagacattagcgagatgggagccaatttcaaggccgagagagtcatcgatccgcgccggtgtatgaaacccgtgattctgaccgacggcgaagagagagtgatcctggctgggcctatgcccgtcacgcattcctctgccgcgcaacgccggggcagaatcggacgcaaccctaagaatgaaaacgaccagtatatttacatgggcgagcccctcgaaaatgatgaggactgcgcccactggaaagaggctaagatgctgcttgataacatcaatacaccggaagggattatccctagcatgtttgagcccgaaagagagaaagttgacgccattgatggagaataccggctgcgcggcgaggctagaaagaccttcgtggacctcatgcggcgcggggatctgcctgtgtggctggcctataaagtcgctgccgagggaatcaactacgcggacagaaagtggtgttttgatggcattaagaataaccagatcctcgaagagaacgtggaagttgagatctggacaaaagagggggaacggaagaaacttaagcccagatggctggacgcccgcatttattccgatcctctggctctcaaagagttcaaggagttcgccgctggccggaagtctctgacccttaatctgatcacggagatgggaagactccccacctttatgacacagaaagcccgcaacgccctggacaatctggctgtgctccataccgcggaagccggcgggcgggcttacaaccacgcccttagcgagctgccggagacactggaaaccctcctgcttctgacactcctggccaccgtcacgggaggcattttcctgtttctcatgtccgggaagggaatcggcaaaatgacacttggcatgtgctgcattatcaccgctagcatcctgctgtggtatgcccaaattcagcctcactggatcgcggcctctattatcctcgagttctttctgattgtgcttctgatccccgaacccgagaagcagagaacccctcaggataatcaactcacatacgttgtgatcgctattctgaccgtcgtggccgctacaatggccaacgaaatggggttcctggagaaaacgaagaaggacctcggacttggctccatcattacccaggagagcgaaaataacatcctggacattgatctgcggccggcgtccgcctggacactctatgctgtcgccaccacatttgtgacccccatgctgcgccattctatcgagaatagctccgttaacgtgtctcttacggctattgccaatcaggctaccgtgctgatggggctcggaaaaggctggcctctgagcaagatggacatcggggtccccctgctcgccatcggatgttactcccaggttaaccctattacacttaccgcggccctgctgctcctggtggctcactacgccatcattggccccggccttcaagctaaagccacaagagaagcccagaagcgggcggctgccgggatcatgaaaaatcctaccgtggatggaattacggtcatcgacctggagccgatcccctatgatcctaagttcgaaaagcagctcggccaggtgatgctgctgattctctgcgttacacaagtgcttatgatgcgcaccacatgggctctgtgtgaggccctgaccctcgccaccgggcccatcagcacactgtgggagggaaaccctggcagattttggaatacgaccattgctgtctctatggccaacatcttccgggggtcctaccttgcgggagccggcctgctctttagcattatgaaaaatacaaccaacacacgcagaggcaccgggaacatcggagaaacgctgggcgagaagtggaaatctcggctgaatgctctcgggaagtccgagttccagatctataaaaagagcggcattcaggaggtggaccgcacacttgccaaagagggcatcaagagaggggaaaccgatcatcacgctgtctctcggggaagcgccaagctgagatggtttgtggagcgcaacatggttacccccgaaggcaaagtggtcgacctgggctgcgggcggggaggctggtcctactattgtgggggactcaagaatgtgagagaggttaaaggcctgacaaaagggggaccgggccatgaagaacctattcccatgtctacctacggctggaaccttgtgcgcctgcaaagcggggtcgatgtgttcttcacaccccctgagaaatgcgacacgctcctgtgtgatatcggagaatccagccccaatcctaccattgaggcgggccggacactgagagtgctcaaccttgttgaaaattggctgaacaataacacccagttttgcatcaaggtcctgaatccgtatatgccctccgtgatcgagaagatggaaacactccagcgcaaatacgggggagccctggtgcggaaccctctttctagaaatagcacccacgagatgtactgggtctccaacgctacgggcaatattgtttctagcgtgaacatgatctcccgcatgctgattaaccggttcaccatgaagcacaaaaaggccacatatgagcccgacgtggatctcgggtctggaaccagaaatatcggcattgaaggcgagatccctaacctggacattatcgggaaacgcatcgaaaagattaagcaggagcatgaaacaagctggcactacgaccaagatcatccctataaaacctgggcttaccacggatcctatgagacaaagcagaccggcagcgcctcttccatggtcaatggggtggttcggctgctcacgaaaccgtgggacgtggtccctatggtgacacagatggctatgaccgataccacaccctttggacagcaaagagttttcaaggagaaagtggacacgcgcacccaggaacctaaggagggcacaaagaaacttatgaagatcaccgccgaatggctgtggaaagagctggggaagaaaaagacacccagaatgtgtacccgggaggaatttaccaagaaggtccgcagcaacgcggccctcggagctattttcaccgatgagaataagtggaaatctgccagagaagctgtggaggacggccggttttgggaactggtggatagagagcggaaccttcacctggagggcaagtgcgaaacgtgtgtctacaatatgatggggaaacgcgagaagaaactcggagagttcggcaaggccaaggggtccagagccatctggtatatgtggctgggagcgcggtttctggagttcgaagctctcggctttctgaacgaggaccattggttcagccgcggaaattctctttccggcgttgagggagaaggcctgcacagactcgggtacattctgcgggatgtgggcaagaaggagggcggggccatgtacgccgacgataccgctggatgggacacacgcatcacccttgaagacctgaaaaacgaggaaatggtgacaaatcatatgaagggcgagcacaaaaagctcgccgaggctatctttaagctgacctatcagaacaaagtcgtgagagttcagcggcctacgccccgcgggacagtgatggatattatcagcagacgggaccaacgcggctccggacaggtcggcacctacgggctgaatacattcaccaacatggaagcccagctcattagacaaatggagggagaaggcatcttcaagagcattcagcatctgacggcgaccgaggagatcgccgtgcagaattggcttgctcgggttgggcgcgaaagactgtctcggatggccatcagcggagatgactgcgtggtcaaaccgattgatgacagatttgcttccgccctcacagcgctgaacgatatgggcaaggtgcgcaaagacatccagcaatgggagccttctcgggggtggaacgattggacccaggttcccttctgcagccaccactttcatgaacttgtgatgaaggacggcagagtcctggtggtcccctgtcgcaatcaggatgagctcattggacgggccagaatctcccagggcgctgggtggtctctgaaggaaacagcctgcctgggaaaaagctatgctcaaatgtggaccctcatgtacttccaccgccgggacctgagacttgccgctaacgccatttgttccgcggtgccttctcattgggttccgacaagccgcaccacgtggtccatccacgccaagcacgagtggatgacaaccgaggatatgctggctgtgtggaatcgggtctggattcaggaaaacccctggatggaggacaaaacccctgtggaaagctgggaggaagtgccctatctcggcaagagagaggaccagtggtgcgggtctctgatcggacttacatcccgcgccacctgggccaaaaatatccagacagctattaaccaagttcggagcctgatcggcaatgaggaatacacggattatatgccttctatgaagagatttcggagagaggaagaggaagccggggtgctctggtga

SEQ ID NO: 20016 - RNA, 9876 nt, synthetic construct
  misc_feature 1..9876: note = derived and/or modified CDS sequence (opt5) from DENV-2__FJ639783__SS-prME
  source 1..9876: mol_type = other RNA
acagccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcgtgtccaaccgcgattttgttgaaggggtgtctggaggcagctgggtcgacattgtgctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtcgatagaggctggggcaacgggtgtggactgttcggcaaagggggaatcgttacatgcgccatgtttacgtgcaaaaagaatatggaaggcaaagtggtgcagcctgagaacctcgaatacaccattgtcatcacaccccacagcggggaggagcatgcggtgggaaatgacaccggcaagcacggcaaagaaattaagatcacacctcagtcttccatcaccgaggccgaactgacggggtatggaaccgttacaatggagtgtagcccccggaccggccttgatttcaacgaaatggtgctgctccaaatggaggacaaggcttggctggtccaccgccagtggtttcttgatctgccgctcccttggctgcccggggccgacacacagggatctaattggattcagaaggagaccctggtgacgttcaagaaccctcatgctaaaaagcaagacgttgtggtcctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgattgtcatcagagtgcagtatgagggggacggatccccctgcaagatccccttcgaaattaccgatctcgagaaacgccatgttctgggccggctgatcacagtgaaccctattgtcaccgaaaaggacagcccggtgaacatcgaggccgaacccccttttggggattcttacattatcattggcgttgagcccggacagctcaaactgaattggttcaagaagggctccagcatcgggcaaatgtttgagacaaccatgagaggagctaaacgcatggccatccttggcgacacggcctgggatttcgggtctctgggaggcgtgtttacaagcattgggaaggctctccaccaggtcttcggcgccatctacggagcggctttttccggcgtgtcttggaccatgaaaattctgatcggggtgattatcacctggatcggaatgaacagccggtccacaagcctgtctgtttcccttgtcctcgtgggcgtggtcaccctgtatctgggggccatggtgcaggccgacagcggatgtgttgtgtcttggaagaataaagaactcaagtgcggctccgggattttcatcacagataacgtccacacgtggaccgagcagtacaagtttcaacctgaaagcccctccaaactggcttctgccattcagaaggctcatgaggaaggcatctgtggaattagaagcgtgacacgccttgagaatctgatgtggaaacagatcaccccggagctcaaccacatcctgtccgaaaatgaggttaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctatcaaagacaatagagccgttcacgcggatatgggctattggatcgaatctgccctcaacgacacgtggaagatggagaaggcttccttcattgaggtgaaaagctgccactggcctaagtctcatacactgtggagcaatggggtcctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtgaccgccggccatgggcagatcgataacttttctctgggagtcctgggcatggctcttttcctcgaagagatgctgagaacgcgcgtggggaccaaacacgcgattctgctcgttgccgtgagctttgtcacactgatcaccggaaatatgtccttccgggaccttggcagagtgatggttatggtgggcgctacaatgaccgatgacatcgggatgggagtcacgtatctggccctcctggccgcttttaaggtgcgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggttctgaaaattgtgcggaacatggaaaagtaccaacttgccgtcacggtgatggcgatctcttgcgtgcctaatgctgtcatcctgcagaacgcctggaaggttagctgtaccattctcgccgctgtgtccgtgagccccctgctcctgacatcttcccagcagaaagccgactggatccctcttgctctgaccattaagggcctcaatcccacagccatctttctgaccacgctgagccgcacatctaaaaagagatcctggccgcttaacgaggcgattatggccgtcgggatggtgagcatcctggcttcttccctcctgaaaaatgacatccctatgaccggacccctcgttgccggcggcctgcttaccgtgtgctatgtcctgacagggcggagcgctgatctggaactcgagcgcgccgccgacgtgaagtgggaggatcaagctgaaatttccggaagctctcctatcctgagcattaccatctccgaggacggctctatgagcattaaaaacgaagaggaggaacagacacttacgatcctgattagaaccgggctcctggttatctccggagtgttccccgtctctatcccgattacagcggccgcttggtacctctgggaggtgaagaagcagcgggccggcgtcctgtgggatgtgccttctccccctcccgttgggaaagccgaacttgaggacggagcttatcgcatcaagcagagaggcattctgggctactcccaaatcggggccggagtgtataaagaaggcacctttcacacaatgtggcatgtcaccagaggggcggtgctgatgcaccgcggaaagagaattgagccctcctgggctgatgttaaaaaggacctcatcagctacggcgggggatggaagctggagggcgaatggaaagagggcgaagaggtgcaggtccttgccctggaacctgggaagaatccgcgggccgtgcagacgaaacccggaatcttcaagaccaacacaggcaccattggggctgtgtccctcgattttagccctggaacatctggctcccccatcgttgacagaaaagggaaggtcgtgggactgtacggcaatggcgtggtcacccgcagcggggcctatgtgtctgcgattgctcagacagagaagtccatcgaggataaccctgaaattgaggacgatatcttccggaaaaagagactcacgatcatggacctgcatcccggagccggcaaaaccaagcgctaccttcctgccattgttcgggaagctatcaaaagagggctgcgcacactgattctcgccccgacccgggtggtcgctgccgagatggaagaggcgctgagaggacttcccatccgctatcaaacccctgccattaaggctgagcacacaggccgggaaatcgtggacctgatgtgtcatgccacgttcaccatgagactcctgagccccgttcgggtgcctaactacaatctcattatcatggatgaggctcactttacagaccccgcctccatcgccgctcgcgggtatatttctaccagagtcgaaatgggcgaggcggccggaatcttcatgacagctaccccgcctggcagccgggatccctttccccagtccaacgcccctattatggacgaggaacgcgagatccccgaaagaagctggaactctgggcacgagtgggtgacggatttcaagggaaaaacagtttggtttgtgccttccattaaggccggcaacgacatcgctgcctgcctgcggaaaaatgggaagaaagtcatccagcttagcagaaagaccttcgattctgaatacgtgaagacccgcgcgaacgactgggattttgtggtcacaaccgacattagcgagatgggagctaatttcaaagccgagcgggttatcgatccgagacgctgtatgaagcccgtgattctgacagacggcgaagaacgggtgatcctggccgggcctatgcccgtcacccattcctctgctgcccaaagacgcggccggattggaagaaaccctaaaaatgaaaacgaccagtatatctacatgggcgagcccctcgaaaatgatgaggactgcgcgcactggaaggaggccaaaatgctgcttgataacatcaatacgccggaagggattatccctagcatgtttgagcccgaacgcgagaaggtggacgctattgatggagaatacagactgcggggcgaggcccgcaaaacattcgttgacctcatgagaagaggggatctgcctgtgtggctggcttataaggtcgccgctgagggaatcaactacgccgaccgcaagtggtgttttgatggcattaaaaataaccagatcctcgaagagaacgtggaagttgagatttggaccaaggagggggaacgcaagaaacttaaaccccggtggctggacgcgagaatctattccgatcctctggccctcaaggagttcaaggagttcgctgccggccgcaaatctctgacacttaatctgatcaccgagatgggacggctccccacgtttatgacccagaaggctagaaacgccctggacaatctggccgtgctccatacagctgaagcgggcgggcgcgcctacaaccacgctcttagcgagctgccggagaccctggaaacactcctgcttctgaccctcctggccacagtcaccggaggcattttcctgtttctcatgtccgggaaaggaatcggcaagatgacgcttggcatgtgctgcattatcacagccagcgtgctgctgtggtatgctcaaattcagcctcactggatcgccgcgtctatcattctcgagttctttctgatcgtccttctgattcccgaacccgagaaacagcggacccctcaggataatcaactcacctacgtggttatcgccattctgacagtggtggctgccaccatggctaacgaaatggggttcctggagaagacaaagaaagacctcggacttggctccatcacgacccaggagagcgaatccaatatcctggacattgatctgagaccggcctctgcgtggacactctatgccgtcgctaccacatttgttacccccatgctgcggcatagcatcgagaactcctctgtgaatgtgagccttacggccattgctaaccaggccaccgtcctgatggggctcggaaagggctggcctctgtccaaaatggacatcggggtgcccctgctcgctattggatgttacagccaggttaatcctatcacacttaccgccgcgctgctgctcctggtggcccactacgctattatcggccccggccttcaagccaaggctacacgcgaagcccagaaaagagccgcggctgggatcatgaagaaccctaccgtcgatggaattacggtgatcgacctggagccgattccctatgatcctaagttcgaaaaacagctcggccaggtcatgctgctgatcctctgcgtgacacaagttcttatgatgcggaccacatgggccctgtgtgaggctctgaccctcgccaccgggcccatttctacactgtgggagggaaatcctggccgcttttggaacacgaccatcgccgtgtccatggctaatatcttcagagggagctaccttgccggagcgggcctgctcttttctattatgaagaacacaaccaatacacggcgcggcaccgggaacatcggagaaacgctgggcgagaaatggaagtccagactgaacgccctcgggaaaagcgagttccagatttataagaaatctggaatccaggaggtcgaccggacacttgctaaggagggcattaagcgcggggaaaccgatcatcacgccgtgagcagaggatccgctaaactgcggtggtttgttgagagaaatatggtgacccccgaaggcaaggtcgtggacctgggctgcgggcgcggaggctggtcttactattgtgggggactcaaaaacgtgcgggaggttaagggcctgacaaaagggggaccgggccatgaagaacctatccccatgagcacctacggctggaatcttgtcagactgcaatccggggtggatgtgttcttcacaccccctgagaagtgcgacacgctcctgtgtgatatcggagaaagctcccccaaccctaccattgaggccggccgcacactgcgggtcctcaatcttgttgaaaactggctgaataacaatacccagttttgcatcaaggtgctgaacccgtatatgccctctgtgattgagaaaatggaaacactccagagaaagtacgggggagcgctggtccgcaatcctcttagccggaactccacccacgagatgtactgggtgtctaatgccacgggcaacatcgttagctccgtgaatatgatttctagaatgctgatcaaccgcttcaccatgaaacacaagaaagctacatatgagcccgacgtcgatctcgggagcggaacccggaacatcggcattgaatccgagatccctaatctggacattatcggcaagagaattgaaaagatcaaacaggagcatgaaacaagctggcactacgaccaagatcatccctataagacctgggcctaccacgggtcttatgagacaaaacagaccggatccgctagctctatggtgaacggcgttgtgcgcctgctcacgaagccgtgggacgtcgtgcctatggtgacacagatggccatgaccgataccacaccctttgggcagcaacgggtcttcaaagagaaggttgacacgagaacccaggaacctaaggagggaaccaagaaacttatgaaaattaccgctgaatggctgtggaaggagctgggcaaaaagaaaacaccccgcatgtgtaccagagaggaatttacacggaaggtgcgctccaatgccgcgctcggggccatcttcaccgatgagaacaagtggaaaagcgctagagaagccgtggaggacggacggttttgggaactggtcgatagagagcggaatcttcacctggagggcaagtgcgaaacgtgtgtgtacaacatgatgggcaaacgcgagaagaaactcggggagttcggaaaggctaagggctctagagccatctggtatatgtggctgggggcccggtttctggagttcgaagcgctcggatttctgaatgaggaccattggttctcccgcggcaacagcctttccggggttgagggcgaaggactgcacagactcggctacattctgcgggatgtggggaaaaaggagggaggcgctatgtacgccgacgataccgccgggtgggacacacgcatcacccttgaagacctgaaaaatgaggaaatggtcacaaaccatatgaagggagagcacaaaaagctcgctgaggccatttttaagctgacctatcagaataaagtggttagagtgcagcggcctacgccccgcggcacagtcatggatatcattagcagacgggaccaacgcgggtctggccaggtgggaacctacggcctgaacacattcaccaatatggaagctcagctcatcagacaaatggagggggaaggaatcttcaagagcattcagcatctgacggccaccgaggagatcgcggttcagaactggcttgcccgggtgggccgcgaaagactgtcccggatggctatttctggggatgactgcgtcgtgaaaccgatcgatgacagatttgccagcgctctcacagccctgaatgatatgggaaaggtccgcaaagacattcagcaatgggagccttcccggggctggaacgattggacccaggtgcccttctgctctcaccactttcatgaacttgttatgaaggacgggagagtgctggtcgtgccctgtcgcaaccaggatgagctcatcggccgggcgagaatcagccagggagccggctggtccctgaaggaaacagcttgcctggggaaatcttatgcccaaatgtggaccctcatgtacttccaccgccgggacctgagacttgctgccaatgctatttgtagcgccgtgccttcccattgggttccgacaagccgcaccacgtggtctatccacgcgaagcacgagtggatgacaaccgaggatatgctggccgtgtggaaccgggtctggattcaggaaaatccctggatggaggacaaaacccctgtggaatcctgggaggaagttccctatctcggaaagagagaggaccagtggtgcggcagcctgatcgggcttacatctcgcgctacctgggccaaaaacattcagacagccatcaatcaagtgcggtccctgattggaaacgaggaatacacggattatatgcctagcatgaagagatttcggagagaggaagaggaagctggcgtcctctggtga

SEQ ID NO: 20017 - RNA, 9876 nt, synthetic construct
  misc_feature 1..9876: note = derived and/or modified CDS sequence (opt5) from DENV-2__FJ639788__SS-prME
  source 1..9876: mol_type = other RNA
accgccggcgtgatcgtcatgctgattcccaccgctatggccttccacctcacgacccggaatggggagcctcatatgatcgttggacggcaggaaaagggcaagagcctgctttttaagaccgaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccgctggggagcaccggcgggaaaagcgcagcgtcgccctcgtgcctcatgttggaatgggcctggagacacggaccgaaacgtggatgtcctctgagggcgcctggaagcacgtgcagcggatcgagacatggatcctgcgccatcccgggttcaccattatggctgccatcctcgcttacacaattggaaccacccactttcagagagccctgatcttcattcttctgacagcggtcgcccctagcatgacgatgcggtgcatcggcgtgtccaaccgcgattttgttgaaggggtgtctggaggcagctgggtcgacattgtgctcgagcacgggtcctgtgtgaccacaatggctaagaataagcccaccctggatttcgaacttatcaagacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtcgatagaggctggggcaacgggtgtggactgttcggcaaagggggaatcgttacctgcgcgatgtttacatgcaaaaagaatatggaaggcaaagtggtgcagcctgagaacctcgaatacacgattgtcatcacaccccacagcggggaggagcatgccgtgggaaatgacacaggcaagcacggcaaagaaattaagatcacccctcagtcttccatcacagaggctgaactgaccgggtatggaacggttaccatggagtgtagcccccggacaggccttgatttcaacgaaatggtgctgctccaaatggaggacaaagcctggctggtccaccgccagtggtttcttgatctgccgctcccttggctgcccggggctgacacccagggatctaattggattcagaaggagacactggtgaccttcaagaaccctcatgccaaaaagcaagacgttgtggtcctcggctcccaggaaggggccatgcacacggctctgacaggcgcgaccgagatccagatgagctccggaaatcttctgtttacaggccatctcaaatgcagactgcggatggataaacttcaactgaaagggatgtcttacagcatgtgtaccggaaagttcaagattgtgaaagaaatcgccgagacccagcacggcacaattgtcatcagagtgcagtatgagggggacggatccccctgcaagatccccttcgaaattacggatctcgagaaacgccatgttctgggccggctgatcaccgtgaaccctattgtcacagaaaaggacagcccggtgaacatcgaggctgaacccccttttggggattcttacattatcattggcgttgagcccggacagctcaaactgaattggttcaagaagggctccagcatcgggcaaatgtttgagaccacaatgagaggagccaaacgcatggccatccttggcgacaccgcttgggatttcgggtctctgggaggcgtgtttacgagcattgggaaggccctccaccaggtcttcggcgcgatctacggagctgccttttccggcgtgtcttggacaatgaaaattctgatcggggtgattatcacctggatcggaatgaacagccggtccaccagcctgtctgtttcccttgtcctcgtgggcgtggtcacactgtatctgggggccatggtgcaggctgacagcggatgtgttgtgtcttggaagaataaagaactcaagtgcggctccgggattttcatcaccgataacgtccacacatggacggagcagtacaagtttcaacctgaaagcccctccaaactggcctctgctattcagaaggcccatgaggaaggcatctgtggaattagaagcgtgacccgccttgagaatctgatgtggaaacagatcacaccggagctcaaccacatcctgtccgaaaatgaggttaagctgaccattatgacaggcgacatcaaagggattatgcaggcgggaaagcggtctcttagacctcaacccaccgaactcaaatatagctggaagacgtggggcaaggccaaaatgctgtccaccgagagccataaccagacattcctgatcgatgggcctgaaaccgctgagtgccccaatacaaaccgcgcctggaactctctcgaggtggaagactacggatttggcgtcttcaccacaaacatttggctgaaacttcgggagaaacaggacgtgttttgtgattccaagctgatgagcgctgccatcaaagacaatagagcggttcacgccgatatgggctattggatcgaatctgctctcaacgacacctggaagatggagaaggcctccttcattgaggtgaaaagctgccactggcctaagtctcatacgctgtggagcaatggggtcctggaatccgagatgatcattcccaaaaacttcgctggaccggtgagccagcacaactaccgccctggctatcatacacaaaccgccgggccctggcaccttggaaagctcgaaatggattttgacttctgtgagggcaccacagtggtcgttaccgaagattgcgggaatcggggaccctctctgagaacgacaaccgcctccggcaaactgatcacagagtggtgctgtcggagctgcaccctccctccgctgcgctacagaggcgaggacgggtgttggtacggaatggaaattcggccccttaaggagaaggaagagaacctggtgaatagcctcgtgacagctggccatgggcagatcgataacttttctctgggagtcctgggcatggcgcttttcctcgaagagatgctgagaacccgcgtggggacgaaacacgccattctgctcgttgctgtgagctttgtcaccctgatcacaggaaatatgtccttccgggaccttggcagagtgatggttatggtgggcgccaccatgacagatgacatcgggatgggagtcacctatctggccctcctggctgcctttaaggtgcgccctacgttcgcggctggcctgcttctgagaaaactcacatctaaggagctgatgatggccaccattgggatcgccctcctgagccagtccacaattcccgaaaccatccttgagctgaccgatgctctcgccctgggaatgatggttctgaaaattgtgcggaacatggaaaagtaccaacttgcggtcacagtgatggctatctcttgcgtgcctaatgccgtcatcctgcagaacgcctggaaggttagctgtacgattctcgctgccgtgtccgtgagccccctgctcctgacctcttcccagcagaaagctgactggatccctcttgccctgacaattaagggcctcaatcccaccgcgatctttctgacaaccctgagccgcacgtctaaaaagagatcctggccgcttaacgaggccattatggctgtcgggatggtgagcatcctggcctcttccctcctgaaaaatgacatccctatgacaggacccctcgttgctggcggcctgcttaccgtgtgctatgtcctgaccgggcggagcgccgatctggaactcgagcgcgccgctgacgtgaagtgggaggatcaagcggaaatttccggaagctctcctatcctgagcattacaatctccgaggacggctctatgagcattaaaaacgaagaggaggaacagacccttacaatcctgattagaacggggctcctggttatctccggagtgttccccgtctctatcccgattaccgccgctgcctggtacctctgggaggtgaagaagcagcgggccggcgtcctgtgggatgtgccttctccccctcccgttgggaaagctgaacttgaggacggagcctatcgcatcaagcagagaggcattctgggctactcccaaatcggggcgggagtgtataaagaaggcacatttcacaccatgtggcatgtcacaagaggggctgtgctgatgcaccgcggaaagagaattgagccctcctgggccgatgttaaaaaggacctcatcagctacggcgggggatggaagctggagggcgaatggaaagagggcgaagaggtgcaggtccttgccctggaacctgggaagaatccgcgggctgtgcagaccaaacccggaatcttcaagacgaacaccggcacaattggggccgtgtccctcgattttagccctggaacctctggctcccccatcgttgacagaaaagggaaggtcgtgggactgtacggcaatggcgtggtcacacgcagcggggcgtatgtgtctgctattgcccagaccgagaagtccatcgaggataaccctgaaattgaggacgatatcttccggaaaaagagactcacaatcatggacctgcatcccggagccggcaaaacgaagcgctaccttcctgctattgttcgggaagccatcaaaagagggctgcgcaccctgattctcgctccgacacgggtggtcgccgcggagatggaagaggccctgagaggacttcccatccgctatcaaacccctgctattaaggccgagcacaccggccgggaaatcgtggacctgatgtgtcatgctacattcacgatgagactcctgagccccgttcgggtgcctaactacaatctcattatcatggatgaggcccactttaccgaccccgcctccatcgctgcgcgcgggtatatttctacaagagtcgaaatgggcgaggccgctggaatcttcatgaccgccacaccgcctggcagccgggatccctttccccagtccaacgcccctattatggacgaggaacgcgagatccccgaaagaagctggaactctgggcacgagtgggtgaccgatttcaagggaaaaacggtttggtttgtgccttccattaaggctggcaacgacatcgccgcgtgcctgcggaaaaatgggaagaaagtcatccagcttagcagaaagacattcgattctgaatacgtgaagacccgcgctaacgactgggattttgtggtcaccacagacattagcgagatgggagccaatttcaaagccgagcgggttatcgatccgagacgctgtatgaagcccgtgattctgaccgacggcgaagaacgggtgatcctggctgggcctatgcccgtcacacattcctctgccgcgcaaagacgcggccggattggaagaaaccctaaaaatgaaaacgaccagtatatctacatgggcgagcccctcgaaaatgatgaggactgcgcccactggaaggaggctaaaatgctgcttgataacatcaataccccggaagggattatccctagcatgtttgagcccgaacgcgagaaggtggacgccattgatggagaatacagactgcggggcgaggctcgcaaaacgttcgttgacctcatgagaagaggggatctgcctgtgtggctggcctataaggtcgctgccgagggaatcaactacgcggaccgcaagtggtgttttgatggcattaaaaataaccagatcctcgaagagaacgtggaagttgagatttggacaaaggagggggaacgcaagaaacttaaaccccggtggctggacgccagaatctattccgatcctctggctctcaaggagttcaaggagttcgccgctggccgcaaatctctgacccttaatctgatcacagagatgggacggctccccacctttatgacgcagaaggccagaaacgccctggacaatctggctgtgctccataccgcggaagccggcgggcgcgcttacaaccacgcccttagcgagctgccggagacactggaaaccctcctgcttctgacactcctggccaccgtcacaggaggcattttcctgtttctcatgtccgggaaaggaatcggcaagatgacccttggcatgtgctgcattatcacggctagcgtgctgctgtggtatgcccaaattcagcctcactggatcgcggcctctatcattctcgagttctttctgatcgtccttctgattcccgaacccgagaaacagcggacacctcaggataatcaactcacctacgtggttatcgctattctgaccgtggtggccgctacaatggccaacgaaatggggttcctggagaagaccaagaaagacctcggacttggctccatcacaacgcaggagagcgaatccaatatcctggacattgatctgagaccggcgtctgcctggaccctctatgctgtcgccacaacctttgttacacccatgctgcggcatagcatcgagaactcctctgtgaatgtgagccttaccgctattgccaaccaggctacggtcctgatggggctcggaaagggctggcctctgtccaaaatggacatcggggtgcccctgctcgccattggatgttacagccaggttaatcctatcacccttacagcggccctgctgctcctggtggctcactacgccattatcggccccggccttcaagctaaggccacccgcgaagcccagaaaagagcggctgccgggatcatgaagaaccctacagtcgatggaattaccgtgatcgacctggagccgattccctatgatcctaagttcgaaaaacagctcggccaggtcatgctgctgatcctctgcgtgacgcaagttcttatgatgcggacaacctgggctctgtgtgaggccctgacactcgccaccgggcccatttctaccctgtgggagggaaatcctggccgcttttggaacacaacgatcgctgtgtccatggccaatatcttcagagggagctaccttgcgggagccggcctgctcttttctattatgaagaacaccacaaatacccggcgcggcacagggaacatcggagaaaccctgggcgagaaatggaagtccagactgaacgctctcgggaaaagcgagttccagatttataagaaatctggaatccaggaggtcgaccggacgcttgccaaggagggcattaagcgcggggaaacagatcatcacgctgtgagcagaggatccgccaaactgcggtggtttgttgagagaaatatggtgacccccgaaggcaaggtcgtggacctgggctgcgggcgcggaggctggtcttactattgtgggggactcaaaaacgtgcgggaggttaagggcctgaccaaagggggaccgggccatgaagaacctatccccatgagcacatacggctggaatcttgtcagactgcaatccggggtggatgtgttcttcacaccccctgagaagtgcgacaccctcctgtgtgatatcggagaaagctcccccaaccctacgattgaggcgggccgcaccctgcgggtcctcaatcttgttgaaaactggctgaattataacacacagttttgcatcaaggtgctgaatccgtacatgccctctgtgattgagaaaatggaaaccctccagagaaagtacgggggagccctggtccgcaaccctcttagcagaaattccacacacgagatgtattgggtgtctaacgctaccggcaatatcgttagctccgtgaacatgatttctagaatgctgatcaatcgcttcacgatgaaacacaagaaagccacctacgagcccgacgtcgatctcgggagcggaacacggaacatcggcattgaatccgagatccctaacctggacattatcggcaagagaattgaaaagatcaaacaggagcatgaaaccagctggcactatgaccaagatcatccctacaagacatgggcttatcacgggtcttacgagaccaaacagacaggatccgccagctctatggtgaatggcgttgtgcgcctgctcaccaagccgtgggacgtcgtgcctatggtgacgcagatggctatgacagataccaccccctttgggcagcaacgggtcttcaaagagaaggttgacacaagaacgcaggaacctaaggagggaaccaagaaacttatgaaaattacagccgaatggctgtggaaagagctgggcaaaaagaaaacccccagaatgtgtacaagagaggaatttacccggaaggtgcgctccaacgcggccctcggggctatcttcacagatgagaataagtggaaaagcgccagagaagctgtggaggacggacggttttgggaactggtcgatagagagcggaaccttcacctggagggcaagtgcgaaacctgtgtgtataatatgatgggcaaacgcgagaagaaactcggggagttcggaaaggccaagggctctagagccatctggtacatgtggctgggggcgcggtttctggagttcgaagctctcggatttctgaacgaggaccattggttctcccgcggcaatagcctttccggggttgagggcgaaggactgcacagactcggctacattctgcgggatgtggggaaaaaggagggaggcgccatgtatgccgacgatacggctgggtgggacacccgcatcacacttgaagacctgaaaaacgaggaaatggtcaccaatcatatgaagggagagcacaaaaagctcgccgaggctatttttaagctgacataccagaacaaagtggttagagtgcagcggcctacaccccgcggcacggtcatggatatcattagcagacgggaccaacgcgggtctggccaggtgggaacatatggcctgaataccttcacaaacatggaagcccagctcatcagacaaatggagggggaaggaatcttcaagagcattcagcatctgaccgcgacggaggagatcgccgttcagaattggcttgctcgggtgggccgcgaaagactgtcccggatggccatttctggggatgactgcgtcgtgaaaccgatcgatgacagatttgctagcgccctcaccgcgctgaacgatatgggaaaggtccgcaaagacattcagcaatgggagccttcccggggctggaatgattggacacaggtgcccttctgctctcaccactttcatgaacttgttatgaaggacgggagagtgctggtcgtgccctgtcgcaaccaggatgagctcatcggccgggccagaatcagccagggagctggctggtccctgaaggaaaccgcctgcctggggaaatcttacgctcaaatgtggacactcatgtatttccaccgccgggacctgagacttgccgctaacgccatttgtagcgcggtgccttcccattgggttccgaccagccgcacaacctggtctatccacgccaagcacgagtggatgacgacagaggatatgctggctgtgtggaatcgggtctggattcaggaaaacccctggatggaggacaaaacccctgtggaatcctgggaggaagttccctacctcggaaagagagaggaccagtggtgcggcagcctgatcgggcttacctctcgcgccacatgggccaaaaatattcagaccgctatcaaccaagtgcggtccctgattggaaatgaggaatatacagattacatgcctagcatgaagagatttcggagagaggaagaggaagccggcgtcctctggtga

SEQ ID NO: 20018 - RNA, 9876 nt, synthetic construct
  misc_feature 1..9876: note = derived and/or modified CDS sequence (opt5) from DENV-2__FJ639822__SS-prME
  source 1..9876: mol_type = other RNA
accgccggagtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaagacacaatcacctacaaatgcccgcttctgagacaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcgtgtccaaccgcgattttgttgaaggggtgtctggaggcagctgggtcgacattgtgctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtcgatagaggctggggcaacgggtgtggactgttcggcaaagggggaatcgttacatgcgccatgtttacgtgcaaaaagaatatggaaggcaaagtggtgcagcctgagaacctcgaatacaccattgtcatcacaccccacagcggggaggagcatgcggtgggaaatgacaccggcaagcacggcaaagaaattaagatcacacctcagtcttccatcattgaggccgaactgaccgggtatggaacggttaccatggagtgtagcccccggacaggccttgatttcaacgaaatggtgctgctccaaatggaggacaaggcttggctggtccaccgccagtggtttcttgatctgccgctcccttggctgcccggggccgacacccagggatctaattggatccagaaggagacactggtgaccttcaagaaccctcatgctaaaaagcaagacgttgtggtcctcggctcccaggaaggggccatgcacacggccctgacaggcgctaccgagattcagatgagctccggaaatcttctgtttacaggccatctcaaatgcagactgcggatggataaacttcaactgaaagggatgtcttacagcatgtgtaccggaaagttcaagatcgtgaaagaaattgcggagacccagcacggcacaatcgtcatcagagtgcagtatgagggggacggatccccctgcaagattcccttcgaaatcacggatctcgagaaacgccatgttctgggccggctgattaccgtgaaccctatcgtcacagggaaggacagcccggtgaacattgaagccgagcccccttttggcgattcttacatcattatcggagttgaacccggccagctcaaactgaattggttcaagaaggggtccagcatcggacaaatgtttgagaccacaatgagaggcgctaaacgcatggccattcttggggacaccgcctgggatttcggatctctgggcggggtgtttacgagcatcggcaaggctctccaccaggtcttcggagccatttacggcgcggctttttccggggtgtcttggacaatgaaaatcctgattggagtgatcatcacctggattggcatgaacagccggtccaccagcctgtctgtttcccttgtcctcgtgggggtggtcacactgtatctgggagccatggtgcaggccgacagcggctgtgttgtgtcttggaagaataaagagctcaagtgcgggtccggcatcttcattaccgataacgtccacacatggacggaacagtacaagtttcaacctgagagcccctccaaactggcttctgccatccagaaggctcatgaagagggaatttgtggcatcagaagcgtgacccgccttgaaaatctgatgtggaaacagatcacaccggagctcaaccacattctgtccgagaatgaagttaagctgaccatcatgacaggggacattaaaggaatcatgcaggccggcaagcggtctcttagacctcaacccaccgagctcaaatatagctggaagacgtgggggaaggcgaaaatgctgtccaccgaaagccataaccagacattcctgattgatggacctgagaccgccgaatgccccaatacaaaccgcgcttggaactctctcgaggtggaggactacggctttggcgtcttcaccacaaacatctggctgaaacttcgggaaaaacaggacgtgttttgtgattccaagctgatgagcgccgctatcaaagacaatagagccgttcacgcggatatggggtattggattgagtctgccctcaacgacacctggaagatggaaaaggcttccttcatcgaggtgaaaagctgccactggcctaagtctcatacgctgtggagcaatggagtcctggagtccgaaatgattatccccaaaaacttcgccggcccggtgagccagcacaactaccgccctgggtatcatacacaaaccgctggaccctggcaccttggcaagctcgagatggattttgacttctgtgaagggaccacagtggtcgttaccgaggattgcggaaatcggggcccctctctgagaacgacaaccgcctccggcaaactgattacagaatggtgctgtcggagctgcaccctccctccgctgcgctacagaggggaggacggatgttggtacggcatggagatccggccccttaaggaaaaggaggaaaacctggtgaatagcctcgtgacagccgggcatggacagattgataacttttctctgggcgtcctggggatggctcttttcctcgaggaaatgctgagaacccgcgtgggaacgaaacacgcgatcctgctcgttgccgtgagctttgtcaccctgatcacaggcaatatgtccttccgggaccttggcagagtgatggttatggtgggggctaccatgacagatgacattggaatgggcgtcacctatctggccctcctggccgcttttaaggtgcgccctacgttcgccgcggggctgcttctgagaaaactcacatctaaggagctgatgatggctaccatcggaattgccctcctgagccagtccacaatccccgagaccattcttgaactgaccgatgccctcgctctgggcatgatggttctgaaaatcgtgcggaacatggagaagtaccaacttgccgtcacagtgatggcgatctcttgcgtgcctaatgctgtcattctgcagaacgcctggaaggttagctgtacgatcctcgccgctgtgtccgtgagccccctgctcctgacctcttcccagcagaaagccgactggattcctcttgctctgacaatcaaggggctcaatcccaccgccatttttctgacaaccctgagccgcacgtctaaaaagagatcctggccgcttaacgaagcgatcatggccgtcggaatggtgagcatcctggcttcttccctcctgaaaaatgacattcctatgacaggccccctcgttgccggcgggctgcttaccgtgtgctatgtcctgaccggacggagcgctgatctggagctcgaacgcgccgccgacgtgaagtgggaggatcaagctgagatctccggcagctctcctattctgagcatcacaatttccgaagacgggtctatgagcatcaaaaacgaggaagaggagcagacccttacaattctgatcagaacgggactcctggttatctccggcgtgttccccgtctctattccgatcaccgcggccgcttggtacctctgggaagtgaagaagcagcgggccggggtcctgtgggatgtgccttctccccctcccgttggaaaagccgagcttgaagacggcgcttatcgcattaagcagagaggcatcctggggtactcccaaattggagccggcgtgtataaagaggggacatttcacaccatgtggcatgtcacacggggagcggtgctgatgcaccgcggcaagagaatcgaaccctcctgggctgatgttaaaaaggacctcatcagctacgggggaggctggaagctggagggcgagtggaaagaaggggaggaagtgcaggtccttgccctggagcctggaaagaatccgcgggccgtgcagaccaaacccggcattttcaagacgaacaccgggacaatcggagctgtgtccctcgattttagccctggcacctctgggtcccccattgttgacagaaaaggaaaggtcgtgggcctgtacggcaatggggtggtcacacgcagcggagcctatgtgtctgcgatcgctcagaccgaaaagtccattgaggataaccctgagatcgaagacgatatcttccggaaaaagagactcacaattatggacctgcatcccggcgccgggaaaacgaagcgctaccttcctgccatcgttcgggaggctattaaaagaggactgcgcaccctgatcctcgccccgacacgggtggtcgctgccgaaatggaggaagcgctgagaggccttcccattcgctatcaaacccctgccatcaaggctgagcacaccgggcgggagattgtggacctgatgtgtcatgccacattcacgatgagactcctgagccccgttcgggtgcctaactacaatctcatcatcatggatgaagctcactttaccgaccccgcctccattgccgctcgcggctatatctctacaagagtcgagatgggagaagcggccggcattttcatgaccgctacaccgcctgggagccgggatccctttccccagtccaacgcccctatcatggacgaggagcgcgaaattcccgagagaagctggaactctggacacgaatgggtgaccgatttcaagggcaaaacggtttggtttgtgccttccatcaaggccgggaacgacatcgctgcctgcctgcggaaaaatggaaagaaagtcattcagcttagcagaaagacattcgattctgagtacgtgaagacccgcgcgaacgactgggattttgtggtcaccacagacatcagcgaaatgggcgctaatttcaaagccgagcgggttattgatccgagacgctgtatgaagcccgtgatcctgaccgacggggaggaacgggtgattctggccggccctatgcccgtcacacattcctctgctgcccaaagacgcggacggatcggcagaaaccctaaaaatgagaacgaccagtatatctacatgggggaacccctcgagaatgatgaagactgcgcgcactggaaggaggccaaaatgctgcttgataacattaataccccggagggaatcattcctagcatgtttgaacccgagcgcgaaaaggtggacgctatcgatggcgagtacagactgagaggggaagcccgcaaaacgttcgttgacctcatgagacggggagatctgcctgtgtggctggcttataaggtcgccgctgagggcattaactacgccgaccgcaagtggtgttttgatgggatcaaaaataaccagattctcgaggaaaacgtggaggttgaaatctggacaaaggagggcgagcgcaagaaacttaaaccccggtggctggacgcgagaatctattccgatcctctggccctcaaggagttcaaggagttcgctgccggacgcaaatctctggctcttaatctgattaccgaaatgggccggctccccacatttatgacccagaaggccagaaacgccctggacaatctggctgtgctccatacggcggaggccgggggacgcgcttacaaccacgcccttagcgaactgccggagaccctggagacactcctgcttctgaccctcctggccacagtcaccggcgggatcttcctgtttctcatgtccggaaaaggcattggcaagatgacacttgggatgtgctgcatcattaccgctagcgtgctgctgtggtatgcccaaatccagcctcactggatcgcggcctctattatcctcgagttctttctgattgtccttctgatccccgagcccgaaaaacagcggacgcctcaggataatcaactcacatacgtggttattgctatcctgaccgtggtggccgctaccatggccaacgagatgggattcctggaaaagacaaagaaagacctcggccttgggtccatcaccacacaggagagcgagtccaatattctggacatcgatctgagaccggcgtctgcctggacgctctatgctgtcgccaccacatttgttacccccatgctgcggcatagcattgaaaactcctctgtgaatgtgagccttacagctatcgccaaccaggctaccgtcctgatgggactcggcaaggggtggcctctgtccaaaatggacattggagtgcccctgctcgccatcggctgttacagccaggttaatcctattacgcttaccgcggccctgctgctcctggtggctcactacgccatcatcggccccgggcttcaagctaaggccacacgcgaggcccagaaaagagcggctgccggaattatgaagaaccctaccgtcgatggcatcacagtgattgacctggaaccgatcccctatgatcctaagttcgagaaacagctcgggcaggtcatgctgctgattctctgcgtgacccaagttcttatgatgcggacgacatgggctctgtgtgaagccctgaccctcgccacaggacccatctctaccctgtgggagggcaatcctgggcgcttttggaacaccacaatcgctgtgtccatggccaatattttcagaggaagctaccttgcgggcgccggcctgctcttttctatcatgaagaacacgaccaatacacggcgcgggaccggaaacattggcgagacactgggggaaaaatggaagtccagactgaacgctctcggaaaaagcgagttccagatctataagaaatctggcattcaggaagtcgaccggacccttgccaaggaggggatcaagcgcggagagacggatcatcacgctgtgagcagaggctccgccaaactgcggtggtttgttgaaagaaatatggtgacacccgagggcaaggtcgtggacctggggtgcggacgcggcgggtggtcttactattgtggaggcctcaaaaacgtgcgggaagttaaggggctgaccaaaggaggcccgggccatgaggaacctatccccatgagcacctacgggtggaatcttgtcagactgcaatccggagtggatgtgttcttcacaccccctgagaagtgcgacaccctcctgtgtgatattggcgagagctcccccaaccctacaatcgaagcggggcgcacgctgcgggtcctcaatcttgttgagaactggctgaataacaatacccagttttgcattaaggtgctgaacccgtatatgccctctgtgatcgagaagatggagacactccagagaaagtacggaggcgccctggtccgcaatcctcttagccggaactccacccacgaaatgtactgggtgtctaatgctacagggaacattgttagctccgtgaatatgatctctagaatgctgatcaaccgcttcaccatgaaacacaagaaagccacgtatgagcccgacgtcgatctcggaagcggcacccggaacattggcatcgagtccgaaattcctaatctggacatcattgggaagagaatcgagaagattaaacaggaacatgagacaagctggcactacgaccaagatcatccctataagacctgggcttaccacggatcttatgaaacaaaacagaccggctccgccagctctatggtgaacggggttgtgcgcctgctcacaaagccgtgggacgtcgtgcctatggtgacccagatggctatgacggatacaaccccctttggacagcaacgggtcttcaaagagaaggttgacaccagaacacaggagcctaaggaaggcacgaagaaacttatgaaaatcaccgccgagtggctgtggaaagaactggggaaaaagaaaacaccccgcatgtgtaccagagaggagtttacacggaaggtgcgctccaatgcggccctcggagctatcttcaccgatgaaaacaagtggaaaagcgccagagaggctgtggaagacggccggttttgggagctggtcgatagagaacggaatcttcacctggagggcaagtgcgagacatgtgtgtacaacatgatggggaaacgcgaaaagaaactcggagagttcggcaaggccaaggggtctagagccatttggtatatgtggctgggagcgcggtttctggagttcgaggctctcggctttctgaatgaagaccattggttctcccgcgggaacagcctttccggcgttgagggagagggcctgcacagactcgggtacatcctgcgggatgtgggcaagaaggaaggcggggccatgtacgccgacgataccgctggatgggacacgcgcattacccttgaggacctgaaaaatgaagagatggtcacaaaccatatgaagggcgaacacaaaaagctcgccgaggctatctttaagctgacctatcagaataaagtggttagagtgcagcggcctacaccccgcgggaccgtcatggatattatcagcagaaaggaccaacggggctctggacaggtgggcacgtacgggctgaacacattcaccaatatggaggcccagctcatccgccaaatggaaggagagggcattttcaaaagcatccagcatctgacagcgaccgaagagattgccgttcagaactggcttacgagagtggggcgggagcgcctgtccagaatggctatctctggagatgactgcgtcgtgaagccgattgatgaccggtttgccagcgctctcaccgccctgaatgatatgggcaaagtcagaaaggacatccagcaatgggaaccttcccgcgggtggaacgattggacacaggtgcccttctgctctcaccactttcatgagcttgttatgaaggacggccgggtgctggtcgtgccctgtagaaaccaggatgaactcatcggacgcgcgcggattagccagggcgccgggtggtccctgaaagagaccgcttgcctgggaaagtcttatgcccaaatgtggacactcatgtacttccacagacgcgacctgcggcttgctgccaatgctatctgtagcgccgtgccttcccattgggttccgaccagcagaacaacctggtctattcacgcgaaacacgaatggatgacgacagaggatatgctggccgtgtggaaccgcgtctggatccaggagaatccctggatggaagacaagacccctgtggagtcctgggaagaggttccctatctcggcaaacgggaagaccagtggtgcgggagcctgattggacttacctctagagctacatgggccaagaacatccagaccgccattaatcaagtgcgctccctgatcggcaacgaggagtacacagattatatgcctagcatgaagcggtttagacgggaagaggaagaggctggggtcctctggtga

SEQ ID NO: 20019 - RNA, 9876 nt, synthetic construct
  misc_feature 1..9876: note = derived and/or modified CDS sequence (opt5) from DENV-2__FJ850112__SS-prME
  source 1..9876: mol_type = other RNA
accgccggcgtgatcattatgctgatccccacagctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttatcgaaaaggacagcccggtgaacattgaggccgaacccccttttggggattcttacatcatcattggcgtcgagcccggacagctcaaactgaattggttcaagaagggctccagcatcgggcaaatgtttgagaccacaatgagaggagctaaacgcatggccattcttggcgacaccgcctgggatttcgggtctctgggaggcgcttttacgagcatcgggaaggccctccaccaggtgttcggcgcgatttacggagctgccttttccggcgtttcttggacaatgaaaatcctgatcggggtggtcattacctggatcggaatgaacagccggtccaccagcctgtctgtgtcccttgtgctcgttggcgtcgtgacactgtatctgggggccatggtgcaggctgacagcggatgtgtcgtgtcttggaagaataaagaactcaagtgcggctccgggattttcatcaccgataacgttcacacatggacggagcagtacaagtttcaacctgaaagcccctccaaactggcctctgctattcagaaggcccatgaggaaggcatctgtggaatcagaagcgtgacccgccttgagaatctgatgtggaaacagattacaccggagctcaaccacatcctgtccgaaaatgaggtcaagctgaccattatgacaggcgacaccaaagggatcatgcaggcgggaaagcggtctcttagacctcaacccacggaactcaaatatagctggaagacctggggcaaggccaaaatgctgtccacagagagccataaccagaccttcctgattgatgggcctgaaacagctgagtgccccaataccaaccgcgcctggaactctctcgaggtggaagactacggatttggcgttttcacaaccaacatctggctgaaacttcgggagaaacaggacgtgttttgtgattccaagctgatgagcgctgccatcaaagacaatagagcggtccacgccgatatgggctattggattgaatctgctctcaacgacacgtggaagatggagaaggcctccttcatcgaggtgaaaagctgccactggcctaagtctcatacactgtggagcaatggggttctggaatccgagatgattatccccaaaaacttcgctggaccggtgagccagcacaactaccgccctggctatcatacccaaaccgccgggccctggcaccttggaaagctcgaaatggattttgacttctgtgagggcacaaccgtcgtggtgacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtcaattccctcgttaccgctggccatgggcagattgataacttttctctgggagtgctgggcatggcgcttttcctcgaagagatgctgagaacgcgcgtggggaccaaacacgccatcctgctcgtcgctgtgagctttgttacactgatcaccggaaatatgtccttccgggaccttggcagagtgatggtcatggtgggcgccacaatgaccgatgacattgggatgggagttacgtatctggccctcctggctgcctttaaggtgcgccctacattcgcggctggcctgcttctgagaaaactcacctctaaggagctgatgatggccacaatcgggattaccctcctgagccagtccaccatccccgaaacaattcttgagctgacggatgccctcgctctgggaatgatggtcctgaaaatcgtgcggaagatggaaaagtaccaacttgccgttaccatcatggcgatttcttgcgtgcctaacgctgtcatcctgcgcaatgcctggaaagtgagctgtacaattctcgccgctgtgtccgtcagccccctgctcctgacctcttcccagcagaaggccgactggatccctcttgctctgacaattaaaggcctcaaccccaccgccatctttctgacgacactgagcagaacctctaagaaacggtcctggccgcttaatgaggcgatcatggccgttgggatggtgagcattctggcttcttccctcctgaagaacgacatccctatgaccggacccctcgtggccggcggcctgcttacagtctgctatgtgctgaccgggcgcagcgctgatctggaactcgagagagccgccgacgttaaatgggaggatcaggctgaaatttccggaagctctcctatcctgagcattacaatctccgaggacggctctatgagcattaagaatgaagaggaggaacaaacgcttaccatcctgatccggacagggctcctggtgatttccggagtcttccccgtgtctatcccgattaccgcggccgcttggtacctctgggaggttaagaaacagcgcgccggcgtgctgtgggatgtcccttctccccctcccgtggggaaggccgaacttgaggacggagcttatagaatcaaacagcggggcattctgggctactcccagatcggggccggagtctataaggaaggcacatttcacaccatgtggcatgtgacgcgcggggcggttctgatgcacagaggaaaacggatcgagccctcctgggctgatgtgaagaaggacctcattagctacggcgggggatggaaactggagggcgaatggaaggagggcgaagaggtccaagtgcttgccctggaacctgggaaaaacccgagagccgttcagaccaagcccggaatcttcaaaacaaataccggcacaattggggctgtgtccctcgattttagccctggaacctctggctcccccatcgtcgaccgcaaggggaaggtggtgggactgtacggcaacggcgttgtcacacggagcggggcctatgtgtctgcgattgctcagacggagaaatccatcgaggataatcctgaaatcgaggacgatattttcagaaagaaacgcctcaccatcatggacctgcatcccggagccggcaagacaaaacggtaccttcctgccattgtgagagaagctatcaagcgcgggctgcggaccctgattctcgccccgaccagagtcgtggctgccgagatggaagaggcgctgcgcggacttcccatccggtatcagacccctgccattaaggctgagcacacgggcagagaaatcgttgacctgatgtgtcatgccaccttcacaatgcggctcctgagccccgtgcgcgtccctaactacaacctcatcattatggatgaggctcactttaccgaccccgcctccatcgccgctagagggtatatttctacacgggtggaaatgggcgaggcggccggaatcttcatgaccgctacgccgcctggcagccgcgatccctttccccaatccaatgcccctattatggacgaggaaagagagatccccgaacggagctggaactctgggcacgagtgggttacagatttcaaaggaaagaccgtgtggtttgtcccttccatcaaagccggcaatgacattgctgcctgcctgagaaagaacgggaaaaaggtgatccagcttagccgcaagaccttcgattctgaatacgttaaaacacgggcgaatgactgggattttgtggtcaccacagacattagcgagatgggagctaacttcaaggccgagagagtgatcgatccgcgccggtgtatgaaacccgtgattctgaccgacggcgaagagagagtcatcctggccgggcctatgcccgttacgcattcctctgctgcccagcgccggggcagaatcggacgcaatcctaagaacgaaaatgaccaatatatttacatgggcgagcccctcgaaaacgatgaggactgcgcgcactggaaagaggccaagatgctgcttgataatatcaacacaccggaagggattatccctagcatgtttgagcccgaaagagagaaagtggacgctattgatggagaataccggctgcgcggcgaggccagaaagaccttcgtggacctcatgcggcgcggggatctgcctgtctggctggcttataaggtggccgctgagggaatcaattacgccgacagaaaatggtgttttgatggcattaagaacaatcagatcctcgaagagaacgttgaagtggagatctggacaaaagagggggaacggaagaaacttaagcccagatggctggacgcgcgcatttattccgatcctctggccctcaaggagttcaaagagttcgctgccggccggaagtctctgacccttaacctgatcacggagatgggaagactccccacctttatgacacagaaagctcgcaatgccctggacaacctggccgtcctccataccgctgaagcgggcgggcgggcctacaatcacgctcttagcgagctgccggagacactggaaaccctcctgcttctgacactcctggccaccgtgacgggaggcattttcctgtttctcatgtccgggaagggaatcggcaaaatgacacttggcatgtgctgcattatcaccgccagcgttctgctgtggtatgctcagatccaacctcactggattgccgcgtctatcattctcgagttctttctgatcgtgcttctgattcccgaacccgagaagcagagaacccctcaggataaccagctcacatacgtcgtgatcgccatcctgaccgtcgtggctgccacaatggctaatgaaatggggttcctggagaagacgaaaaaggacctcggacttggctccattaccacacaagagagcgaatccaacatcctggacattgatctgcggccggcctctgcgtggaccctctatgccgttgctacaacctttgtgacgcccatgctgcgccatagcatcgaaaatagctctgtgaacgtcagccttaccgccattgctaatcaggccacagttctgatggggctcggaaaaggctggcctctgtccaagatggacatcggggtgcccctgctcgctattggatgttacagccaggtgaaccctatcacccttacagccgcgctgctgctcctggtcgcccactacgctatcattggccccggccttcaggccaaagctaccagagaagcccaaaagcgggccgcggctgggatcatgaagaatcctacggtggatggaattacagttatcgacctggagccgattccctatgatcctaaattcgaaaagcagctcggccaggtgatgctgctgatcctctgcgtcacccaggtgcttatgatgcgcacaacctgggccctgtgtgaggctctgaccctcgccacagggcccatctctacgctgtgggagggaaaccctggcagattttggaataccacaattgccgtctccatggctaacatcttccgggggagctaccttgccggagcgggcctgctcttttctattatgaaaaataccacaaacacccgcagaggcacggggaatatcggagaaacactgggcgagaagtggaaatcccggctgaacgccctcggaaagagcgagttccaaatttataaaaagtctggaatccaggaggtggaccgcacccttgctaaggagggcatcaaaagaggggaaaccgatcatcacgccgttagccggggatccgctaagctgagatggtttgtggagcgcaacatggtcacacccgaaggcaaagtggttgacctgggctgcgggcggggaggctggtcttactattgtgggggactcaagaatgtgagagaggtcaaaggcctgaccaaagggggaccgggccatgaagaacctattcccatgagcacatacggctggaaccttgtgcgcctgcagtccggggtggatgttttcttcacgccccctgagaagtgcgacaccctcctgtgtgatatcggagaaagctcccccaatcctacaattgaggccggccggaccctgagagtcctcaaccttgtggaaaattggctgaacaataacacacaattttgcatcaaagtgctgaatccgtatatgccctctgtcattgagaagatggaaaccctccagcgcaaatacgggggagcgctggttcggaaccctcttagcagaaattccacgcacgagatgtactgggtgtctaacgccaccggcaatatcgtgagctccgtcaacatgatctctcgcatgctgattaatcggttcacaatgaagcacaaaaaggctacctatgagcccgacgtggatctcgggagcggaacaagaaacatcggcattgaatccgagatccctaacctggacattatcggcaagcgcattgagaagatcaagcaggagcatgaaaccagctggcactacgaccaggatcatccctataaaacatgggcctaccacgggtcttatgagaccaagcaaacgggatccgctagctctatggttaatggcgtggtccggctgctcacaaaaccgtgggacgtggttcctatggtgacccagatggccatgaccgatacaacgccctttgggcagcagagagtcttcaaggagaaggtggacacccgcacacaagaacctaaagagggaaccaagaaacttatgagaatcacagctgaatggctgtggaaggagctgggcaaaaagaaaacaccccggatgtgtacacgcgaggaatttaccagaaaggtgcggtccaacgccgcgctcggggccattttcacggatgagaataagtggaaaagcgctagagaagccgtcgaggacggacggttttgggaactggttgataaggagcgcaaccttcacctggagggcaaatgcgaaacctgtgtgtacaatatgatgggcaagagagagaaaaagctcggggagttcggaaaggctaaaggctctcgggccatctggtatatgtggctgggggcccgctttctggagttcgaagcgctcggatttctgaacgaggaccattggttctccagaggcaatagcctttccggggtggagggcgaaggactgcaccggctcggctacattctgcgcgatgtcgggaagaaagagggaggcgctatgtacgccgacgatacagccgggtgggacaccagaatcacacttgaagacctgaagaacgaggaaatggtgaccaatcatatgaaaggagagcacaagaagctcgctgaggccatttttaaactgacgtatcagaacaaggttgtgcgggtccagcgccctacacccagaggcaccgtgatggatatcatcagccggcgcgaccagagagggtctggccaagttggaacatacggcctgaataccttcacgaacatggaagctcagctcattcggcagatggagggggaaggaatcttcaaaagcattcaacatctgaccgccacagaggagatcgcggtgcagaattggcttgcccgcgtcggcagagaacggctgtccagaatggctatttctggggatgactgcgtggttaagccgatcgatgaccgctttgccagcgctctcaccgccctgaacgatatgggaaaagtgcggaaggacatccagcagtgggagccttccagaggctggaatgattggacacaagtccccttctgctctcaccactttcatgaacttgtgatgaaggacgggcgcgtcctggtggttccctgtcggaaccaggatgagctcattggcagagcgcgcatcagccagggagccggctggtccctgaaagaaaccgcttgcctggggaagtcttatgcccagatgtggacactcatgtacttccaccggagagacctgcgccttgctgccaacgctatttgtagcgccgtgccttcccattgggtcccgaccagccggacgacatggtctatccacgcgaaacacgagtggatgaccaccgaggatatgctggccgtgtggaatagagtgtggattcaagaaaacccctggatggaggacaagacacctgttgaatcctgggaggaagtgccctatctcggaaaacgcgaggaccagtggtgcggcagcctgatcgggcttacctctcgggctacatgggccaagaatattcagacggccatcaaccaggtcagatccctgatcggaaatgaggaatacaccgattatatgcctagcatgaagcggtttagacgcgaggaagaggaagctggcgtgctctggtga

SEQ ID NO: 20020 - RNA, 9876 nt, synthetic construct
  misc_feature 1..9876: note = derived and/or modified CDS sequence (opt5) from DENV-2__FJ850105__SS-prME
  source 1..9876: mol_type = other RNA
accgccggcgtgatcattatgctgatccccacagctatggccttccacctcacgaccagaaatggggaacctcatatgattgttggacggcaggaaaagggcaagagcctgctttttaagacagaggacggggttaatatgtgcaccctgatggcgatcgatctcggagaactgtgtgaggacacaattacctacaagtgcccgcttctgagacaaaatgaacccgaggatatcgactgttggtgcaattccacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaagcacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgctgagcccggacagctcaaactgaattggttcaagaagggctccagcattgggcaaatgtttgagaccacaatgagaggagccaaacgcatggccatccttggcgacaccgcttgggatttcgggtctctgggaggcgtgtttacgagcattgggaaggccctccaccaggtcttcggcgcgatctacggagctgccttttccggcgtgtcttggacaatgaaaatcctgattggggttgtgatcacctggattggaatgaacagccggtccaccagcctgtctgtctcccttgtgctcgtgggcgttgtcacactgtatctgggggccatggtgcaggctgacagcggatgtgtggtctcttggaagaataaagaactcaagtgcggctccgggatcttcattaccgataacgtgcacacatggacggagcagtacaagtttcaacctgaaagcccctccaaactggcctctgctatccagaaggcccatgaggaaggcatctgtggaattagaagcgttacccgccttgagaatctgatgtggaaacagatcacaccggagctcaaccacattctgtccgaaaatgaggtgaagctgaccatcatgacaggcgacaccaaagggattatgcaggcgggaaagcggtctcttagacctcaacccacggaactcaaatatagctggaagacctggggcaaggccaaaatgctgtccacagagagccataaccagaccttcctgatcgatgggcctgaaacagctgagtgccccaataccaaccgcgcctggaactctctcgaggtcgaagactacggatttggcgtgttcacaaccaacatctggctgaaacttcgggagaaacaggacgtcttttgtgattccaagctgatgagcgctgccattaaagacaatagagcggtgcacgccgatatgggctattggatcgaatctgctctcaacgacacgtggaagatggagaaggcctccttcattgaggtcaaaagctgccactggcctaagtctcatacactgtggagcaatggggtgctggaatccgagatgatcattcccaaaaacttcgctggaccggttagccagcacaactaccgccctggctatcatacccaaaccgccgggccctggcaccttggaaagctcgaaatggattttgacttctgtgagggcacaaccgtggtcgtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtcaccgctggccatgggcagatcgataacttttctctgggagttctgggcatggcgcttttcctcgaagagatgctgagaacgcgcgtggggaccaaacacgccatcctgctcgtggctgtcagctttgtgacactgattaccggaaatatgtccttccgggaccttggcagagttatggtgatggtcggcgccacaatgaccgatgacatcgggatgggagtgacgtatctggccctcctggctgcctttaaggttcgccctacattcgcggctggcctgcttctgagaaaactcacctctaaggagctgatgatggccacaattgggatcaccctcctgagccagtccaccattcccgaaacaatccttgagctgacggatgccctcgctctgggaatgatggtgctgaaaatcgtccggaacatggaaaagtaccaacttgccgtgaccattatggcgatctcttgcgttcctaatgctgtgattctgcgcaacgcctggaaggtcagctgtacaatcctcgccgctgtgtccgtgagccccctgctcctgacctcttcccagcagaaagccgactggattcctcttgctctgacaatcaagggcctcaatcccaccgccatctttctgacgacactgagcagaacctctaaaaagcggtcctggccgcttaacgaggcgattatggccgtcgggatggttagcatcctggcttcttccctcctgaaaaatgacattcctatgaccggacccctcgtggccggcggcctgcttacagtgtgctatgtcctgaccgggcgcagcgctgatctggaactcgagagagccgccgacgtgaagtgggaggatcaggctgaaatctccggaagctctcctattctgagcatcacaatttccgaggacggctctatgagcatcaaaaacgaagaggaggaacaaacgcttaccatcctgattcggacagggctcctggttatctccggagtgttccccgtctctattccgatcaccgcggccgcttggtacctctgggaggtgaagaagcagcgcgccggcgttctgtgggatgtgccttctccccctcccgtcgggaaagccgaacttgaggacggagcttatagaattaagcagcggggcatcctgggctactcccagatcggggccggagtgtataaagaaggcacatttcacaccatgtggcatgtcacgcgcggggcggtgctgatgcacagaggaaagcggattgagccctcctgggctgatgttaaaaaggacctcatcagctacggcgggggatggaagctggagggcgaatggaaagagggcgaagaggtgcaagtccttgccctggaacctgggaagaatccgagagccgtgcagaccaaacccggaattttcaagacaaacaccggcacaatcggggctgtttccctcgattttagccctggaacctctggctcccccattgtggaccgcaaagggaaggtcgtgggactgtacggcaatggcgtggttacacggagcggggcctatgtctctgcgatcgctcagacggagaagtccatcgaggataaccctgaaattgaggacgatatcttccgcaagaagcgcctcaccattatggacctgcatcccggagccggcaaaacaaagcggtaccttcctgccatcgtgagagaagctattaaacgcgggctgcggaccctgatcctcgccccgaccagagtggtcgctgccgagatggaagaggcgctgcgcggacttcccattcggtatcagacccctgccatcaaggctgagcacacgggcagagaaatcgtggacctgatgtgtcatgccaccttcacaatgcggctcctgagccccgttcgcgtgcctaactacaatctcattatcatggatgaggctcactttaccgaccccgcctccattgccgctagagggtatatctctacacgggtcgaaatgggcgaggcggccggaattttcatgaccgctacgccgcctggcagccgcgatccctttccccaatccaacgcccctatcatggacgaggaaagagagatccccgaacggagctggaactctgggcacgagtgggtgacagatttcaagggaaaaaccgtttggtttgtgccttccattaaggccggcaacgacatcgctgcctgcctgcgcaagaatgggaagaaagtcattcagcttagccgcaagaccttcgattctgaatacgtgaagacacgggcgaacgactgggattttgttgtgaccacagacatcagcgagatgggagctaatttcaaagccgagagagtcattgatccgcgccggtgtatgaagcccgtgatcctgaccgacggcgaagagagagtgatcctggccgggcctatgcccgtcacgcattcctctgctgcccagcgccggggcagaattggacgcaaccctaaaaatgaaaacgaccaatatatctacatgggcgagcccctcgaaaatgatgaggactgcgcgcactggaaggaggccaaaatgctgcttgataacattaatacaccggaagggatcattcctagcatgtttgagcccgaaagagagaaggttgacgctatcgatggagaataccggctgcgcggcgaggccagaaaaaccttcgtggacctcatgcggcgcggggatctgcctgtgtggctggcttataaggtcgccgctgagggaattaactacgccgacagaaagtggtgttttgatggcatcaaaaataaccagatcctcgaagagaacgtggaagttgagatttggacaaaggagggggaacggaagaaacttaaacccagatggctggacgcgcgcatctattccgatcctctggccctcaaagagttcaaggagttcgctgccggccggaaatctctgacccttaatctgattacggagatgggaagactccccacctttatgacacagaaggctcgcaacgccctggacaatctggccgtgctccataccgctgaagcgggcgggcgggcctacaaccacgctcttagcgagctgccggagacactggaaaccctcctgcttctgacactcctggccaccgtcacgggaggcatcttcctgtttctcatgtccgggaaaggaattggcaagatgacacttggcatgtgctgcatcatcaccgccagcgtgctgctgtggtatgctcagattcaacctcactggatcgccgcgtctattatcctcgagttctttctgattgttcttctgatccccgaacccgagaaacagagaacccctcaggataatcagctcacatacgtggtcatcgccattctgaccgtggtcgctgccacaatggctaacgaaatggggttcctggagaagacgaagaaagacctcggacttggctccatcaccacacaagagagcgaatccaatattctggacatcgatctgcggccggcctctgcgtggaccctctatgccgtggctacaacctttgttacgcccatgctgcgccatagcattgagaactcctctgtgaatgtgagccttaccgccatcgctaaccaggccacagtcctgatggggctcggaaagggctggcctctgtccaaaatggacattggggttcccctgctcgctatcggatgttacagccaggtgaatcctatcacccttacagccgcgctgctgctcctggtggcccactacgctattatcggccccggccttcaggccaaggctaccagagaagcccaaaaacgggccgcggctgggattatgaagaaccctacggtcgatggaatcacagtgattgacctggagccgatcccctatgatcctaagttcgaaaaacagctcggccaggttatgctgctgatcctctgcgtgacccaggtccttatgatgcgcacaacctgggccctgtgtgaggctctgaccctcgccacagggcccatttctacgctgtgggagggaaatcctggcagattttggaacaccacaatcgccgtgtccatggctaatattttccgggggagctaccttgccggagcgggcctgctcttttctatcatgaagaacaccacaaatacccgcagaggcacggggaacattggagaaacactgggcgagaaatggaagtcccggctgaacgccctcgggaaaagcgagttccaaatctataagaaatctggaatccaggaggtcgaccgcacccttgctaaggagggcattaagagaggggaaaccgatcatcacgccgtgagccggggatccgctaaactgagatggtttgttgagcgcaatatggtgacacccgaaggcaaggtcgtggacctgggctgcgggcggggaggctggtcttactattgtgggggactcaaaaacgttagagaggtgaagggcctgaccaaagggggaccgggccatgaagaacctatccccatgagcacatacggctggaatcttgtccgcctgcagtccggggtggatgtgttcttcacgccccctgagaagtgcgacaccctcctgtgtgatattggagaaagctcccccaaccctacaatcgaggccggccggaccctgagagttctcaatcttgtcgaaaactggctgaataacaatacacaattttgcattaaggtgctgaacccgtatatgccctctgtgatcgagaaaatggaaaccctccagcgcaagtacgggggagcgctggtccggaatcctcttagcagaaactccacgcacgagatgtactgggtttctaatgccaccggcaacatcgtgagctccgtgaatatgatttctcgcatgctgatcaaccggttcacaatgaaacacaagaaagctacctatgagcccgacgtcgatctcgggagcggaacaagaaacattggcatcgaatccgagattcctaatctggacatcattggcaagcgcatcgaaaagatcaaacaggagcatgaaaccagctggcactacgaccaggatcatccctataagacatgggcctaccacgggtcttatgagaccaaacaaacgggatccgctagctctatggtgaacggcgttgtgcggctgctcacaaagccgtgggacgtcgtgcctatggttacccagatggccatgaccgatacaacgccctttgggcagcagagagtgttcaaagagaaggtcgacacccgcacacaagaacctaaggagggaaccaagaaacttatgagaattacagctgaatggctgtggaaagagctgggcaaaaagaaaacaccccggatgtgtacacgcgaggaatttaccagaaaagtgcggtccaatgccgcgctcggggccatcttcacggatgagaacaagtggaaaagcgctagagaagccgtggaggacggacggttttgggaactggtcgataaagagcgcaatcttcacctggagggcaagtgcgaaacctgtgtttacaacatgatgggcaaaagagagaagaaactcggggagttcggaaaggctaagggctctcgggccatttggtatatgtggctgggggcccgctttctggagttcgaagcgctcggatttctgaatgaggaccattggttctccagaggcaacagcctttccggggtggagggcgaaggactgcaccggctcggctacatcctgcgcgatgtggggaaaaaggagggaggcgctatgtacgccgacgatacagccgggtgggacaccagaattacacttgaagacctgaaaaatgaggaaatggtcaccaaccatatgaagggagagcacaaaaagctcgctgaggccatctttaagctgacgtatcagaataaagtggttcgggtgcagcgccctacacccagaggcaccgtcatggatatcattagccggcgcgaccagagagggtctggccaagtgggaacatacggcctgaacaccttcacgaatatggaagctcagctcatccggcagatggagggggaaggaattttcaagagcatccaacatctgaccgccacagaggagattgcggttcagaactggcttgcccgcgtgggcagagaacggctgtccagaatggctatctctggggatgactgcgtcgtgaaaccgatcgatgaccgctttgccagcgctctcaccgccctgaatgatatgggaaaggttcggaaagacattcagcagtgggagccttccagaggctggaacgattggacacaagtgcccttctgctctcaccactttcatgaacttgtcatgaaggacgggcgcgtgctggtcgtgccctgtcggaaccaggatgagctcatcggcagagcgcgcattagccagggagccggctggtccctgaaggaaaccgcttgcctggggaaatcttatgcccagatgtggacactcatgtacttccaccggagagacctgcgccttgctgccaatgctatctgtagcgccgttccttcccattgggtgccgaccagccggacgacatggtctattcacgcgaagcacgagtggatgaccaccgaggatatgctggccgtctggaacagagtgtggatccaagaaaatccctggatggaggacaaaacacctgtggaatcctgggaggaagttccctatctcggaaagcgcgaggaccagtggtgcggcagcctgattgggcttacctctcgggctacatgggccaaaaacatccagacggccatcaatcaggtgagatccctgattggaaacgaggaatacaccgattatatgcctagcatgaagcggtttagacgcgaggaagaggaagctggcgtcctctggtga

SEQ ID NO: 20021 - RNA, 9876 nt, synthetic construct
  misc_feature 1..9876: note = derived and/or modified CDS sequence (opt5) from DENV-2__FJ850106__SS-prME
  source 1..9876: mol_type = other RNA
acagccggcgtgatcattatgctgatccccacagctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgagacaaaatgaacccgaggatatcgactgttggtgcaatagcacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatctgtggaattagaagcgtgacccgccttgagaatctgatgtggaaacagatcacaccggagctcaaccacattctgtccgaaaatgaggtcaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgacactgctcgtcgccgctagctttgtgaccctgatcacaggaaatatgtccttccgggaccttggcagagttatggtgatggtcggcgccaccatgacggatgacattgggatgggagtgacatatctggccctcctggctgcctttaaggttcgccctaccttcgcggctggcctgcttctgagaaaactcacatctaaggagctgatgatggccaccatcgggattaccctcctgagccagtccacaatccccgaaacgattcttgagctgaccgatgccctcgctctgggaatgatggtgctgaaaatcgtccggaacatggaaaagtaccaacttgccgtgacaatcatggcgatttcttgcgttcctaatgctgtgatcctgcgcaacgcctggaaggtcagctgtaccattctcgccgctgtgtccgtgagccccctgctcctgacatcttcccagcagaaagccgactggatccctcttgctctgaccattaagggcctcaatcccacggccatctttctgacaaccctgagcagaacctctaaaaagcggtcctggccgcttaacgaggcgatcatggccgtcgggatggttagcattctggcttcttccctcctgaaaaatgacatccctatgacaggacccctcgtggccggcggcctgcttaccgtgtgctatgtcctgacagggcgcagcgctgatctggaactcgagagagccgccgacgtgaagtgggaggatcaggctgaaatttccggaagctctcctatcctgagcattacgatctccgaggacggctctatgagcattaaaaacgaagaggaggaacaaacccttacaatcctgatccggaccgggctcctggttatttccggagtgttccccgtctctatcccgattacagcggccgcttggtacctctgggaggtgaagaagcagcgcgccggcgttctgtgggatgtgccttctccccctcccgtcgggaaagccgaacttgaggacggagcttatagaatcaagcagcggggcattctgggctactcccagatcggggccggagtgtataaagaaggcacctttcacacgatgtggcatgtcacccgcggggcggtgctgatgcacagaggaaagcggatcgagccctcctgggctgatgttaaaaaggacctcattagctacggcgggggatggaagctggagggcgaatggaaagagggcgaagaggtgcaagtccttgccctggaacctgggaagaatccgagagccgtgcagacaaaacccggaatcttcaagaccaacacaggcaccattggggctgtttccctcgattttagccctggaacatctggctcccccatcgtggaccgcaaagggaaggtcgtgggactgtacggcaatggcgtggttacgcggagcggggcctatgtctctgcgattgctcagaccgagaagtccatcgaggataaccctgaaatcgaggacgatattttccgcaagaagcgcctcacaatcatggacctgcatcccggagccggcaaaaccaagcggtaccttcctgccattgtgagagaagctatcaaacgcgggctgcggaccctgattctcgccccgacaagagtggtcgctgccgagatggaagaggcgctgcgcggacttcccatccggtatcagacgcctgccattaaggctgagcacaccggcagagaaatcgtggacctgatgtgtcatgccacattcaccatgcggctcctgagccccgttcgcgtgcctaactacaatctcatcattatggatgaggctcactttacagaccccgcctccatcgccgctagagggtatatttctacccgggtcgaaatgggcgaggcggccggaatcttcatgacggctacaccgcctggcagccgcgatccctttccccaatccaacgcccctattatggacgaggaaagagagatccccgaacggagctggaactctgggcacgagtgggtgaccgatttcaagggaaaaaccgtttggtttgtgccttccatcaaggccggcaacgacattgctgcctgcctgcgcaagaatgggaagaaagtcatccagcttagccgcaagacattcgattctgaatacgtgaagacccgggcgaacgactgggattttgttgtgacaaccgacattagcgagatgggagctaatttcaaagccgagagagtcatcgatccgcgccggtgtatgaagcccgtgattctgacggacggcgaagagagagtgatcctggccgggcctatgcccgtcacacattcctctgctgcccagcgccggggcagaatcggacgcaaccctaaaaatgaaaacgaccaatatatttacatgggcgagcccctcgaaaatgatgaggactgcgcgcactggaaggaggccaaaatgctgcttgataacatcaataccccggaagggattatccctagcatgtttgagcccgaaagagagaaggttgacgctattgatggagaataccggctgcgcggcgaggccagaaaaacattcgtggacctcatgcggcgcggggatctgcctgtgtggctggcttataaggtcgccgctgagggaatcaactacgccgacagaaagtggtgttttgatggcattaaaaataaccagatcctcgaagagaacgtggaagttgagatctggaccaaggagggggaacggaagaaacttaaacccagatggctggacgcgcgcatttattccgatcctctggccctcaaagagttcaaggagttcgctgccggccggaaatctctgacgcttaatctgatcaccgagatgggaagactccccacatttatgacccagaaggctcgcaacgccctggacaatctggccgtgctccatacagctgaagcgggcgggcgggcctacaaccacgctcttagcgagctgccggagaccctggaaacactcctgcttctgaccctcctggccacggtcacaggaggcattttcctgtttctcatgtccgggaaaggaatcggcaagatgacccttggcatgtgctgcattatcaccgccagcgtgctgctgtggtatgctcagatccaacctcactggattgccgcgtctatcattctcgagttctttctgatcgttcttctgattcccgaacccgagaaacagagaacacctcaggataatcagctcacctacgtggtcatcgccatcctgacagtggtcgctgccacgatggctaacgaaatggggttcctggagaagaccaagaaagacctcggacttggctccattacaacccaagagagcgaatccaatatcctggacattgatctgcggccggcctctgcgtggacactctatgccgtggctaccacgtttgttacccccatgctgcgccatagcatcgagaactcctctgtgaatgtgagccttacagccattgctaaccaggccaccgtcctgatggggctcggaaagggctggcctctgtccaaaatggacatcggggttcccctgctcgctattggatgttacagccaggtgaatcctatcacacttaccgccgcgctgctgctcctggtggcccactacgctatcattggccccggccttcaggccaaggctacgagagaagcccaaaaacgggccgcggctgggatcatgaagaaccctacagtcgatggaattaccgtgatcgacctggagccgattccctatgatcctaagttcgaaaaacagctcggccaggttatgctgctgatcctctgcgtgacacaggtccttatgatgcgcaccacctgggccctgtgtgaggctctgacactcgccacggggcccatctctaccctgtgggagggaaatcctggcagattttggaacacaaccattgccgtgtccatggctaatatcttccgggggagctaccttgccggagcgggcctgctcttttctattatgaagaacacaaccaatacgcgcagaggcacagggaacatcggagaaaccctgggcgagaaatggaagtcccggctgaacgccctcgggaaaagcgagttccaaatttataagaaatctggaatccaggaggtcgaccgcacccttgctaaggagggcatcaagagaggggaaacagatcatcacgccgtgagccggggatccgctaaactgagatggtttgttgagcgcaatatggtgacccccgaaggcaaggtcgtggacctgggctgcgggcggggaggctggtcttactattgtgggggactcaaaaacgttagagaggtgaagggcctgacaaaagggggaccgggccatgaagaacctattcccatgagcacgtacggctggaatcttgtccgcctgcagtccggggtggatgtgttcttcacaccccctgagaagtgcgacaccctcctgtgtgatatcggagaaagctcccccaaccctaccattgaggccggccggacactgagagttctcaatcttgtcgaaaactggctgaataacaatacccaattttgcatcaaggtgctgaacccgtatatgccctctgtgattgagaaaatggaaacgctccagcgcaagtacgggggagcgctggtccggaatcctcttagcagaaactccacccacgagatgtactgggtttctaatgccacaggcaacatcgtgagctccgtgaatatgatctctcgcatgctgattaaccggttcaccatgaaacacaagaaagctacatatgagcccgacgtcgatctcgggagcggaaccagaaacatcggcattgaatccgagatccctaatctggacattatcggcaagcgcattgaaaagatcaaacaggagcatgaaacaagctggcactacgaccaggatcatccctataagacctgggcctaccacgggtcttatgagacgaaacaaacaggatccgctagctctatggtgaacggcgttgtgcggctgctcaccaagccgtgggacgtcgtgcctatggttacccagatggccatgacagatacgaccccctttgggcagcagagagtgttcaaagagaaggtcgacacacgcacccaagaacctaaggagggaaccaagaaacttatgagaatcaccgctgaatggctgtggaaagagctgggcaagaaaaagacaccccggatgtgtacccgcgaggaatttacgagaaaagtgcggtccaatgccgcgctcggggccattttcaccgatgagaacaagtggaaaagcgctagagaagccgtggaggacggacggttttgggaactggtcgataaagagcgcaatcttcacctggagggcaagtgcgaaacatgtgtttacaacatgatgggcaaaagagagaagaaactcggggagttcggaaaggctaagggctctcgggccatctggtatatgtggctgggggcccgctttctggagttcgaagcgctcggatttctgaatgaggaccattggttctccagaggcaacagcctttccggggtggagggcgaaggactgcaccggctcggctacattctgcgcgatgtggggaaaaaggagggaggcgctatgtacgccgacgataccgccgggtgggacacaagaatcacccttgaagacctgaaaaatgaggaaatggtcacgaaccatatgaagggagagcacaaaaagctcgctgaggccatttttaagctgacatatcagaataaagtggttcgggtgcagcgccctacccccagaggcacagtcatggatatcatcagccggcgcgaccagagagggtctggccaagtgggaacctacggcctgaacacgttcaccaatatggaagctcagctcattcggcagatggagggggaaggaatcttcaagagcattcaacatctgacagccaccgaggagatcgcggttcagaactggcttgcccgcgtgggcagagaacggctgtccagaatggctatttctggggatgactgcgtcgtgaaaccgatcgatgaccgctttgccagcgctctcacagccctgaatgatatgggaaaggttcggaaagacatccagcagtgggagccttccagaggctggaacgattggacccaagtgcccttctgctctcaccactttcatgaacttgtcatgaaggacgggcgcgtgctggtcgtgccctgtcggaaccaggatgagctcattggcagagcgcgcatcagccagggagccggctggtccctgaaggaaacagcttgcctggggaaatcttatgcccagatgtggaccctcatgtacttccaccggagagacctgcgccttgctgccaatgctatttgtagcgccgttccttcccattgggtgccgacgagccggacaacctggtctatccacgcgaagcacgagtggatgaccacagaggatatgctggccgtctggaacagagtgtggattcaagaaaatccctggatggaggacaaaacccctgtggaatcctgggaggaagttccctatctcggaaagcgcgaggaccagtggtgcggcagcctgatcgggcttacatctcgggctacgtgggccaaaaacattcagaccgccatcaatcaggtgagatccctgatcggaaacgaggaatacacagattatatgcctagcatgaagcggtttagacgcgaggaagaggaagctggcgtcctctggtga

SEQ ID NO: 20022 - RNA, 9876 nt, synthetic construct
  misc_feature 1..9876: note = derived and/or modified CDS sequence (opt5) from DENV-2__FJ850107__SS-prME
  source 1..9876: mol_type = other RNA
accgccggcgtgatcattatgctgatccccacagctatggccttccacctcacgaccagaaatggggagcctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgagacaaaacgaacccgaggatatcgactgttggtgcaattccacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatctgtggaattagaagcgtgacccgccttgagaatctgatgtggaaacagatcacaccggagctcaaccacattctgtccgaaaatgaggtcaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccgtgagctttgttacactgattaccggaaatatgtccttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatggtcctgaaaatcgtgcggaacatggaaaagtaccaacttgctgttaccattatggccatctcttgcgtgcctaatgcggtcattctgcgcaacgcttggaaggtgagctgtacaatcctcgccgccgtgtccgtctttcccctgctcctgaccagctctcagcagaaagctgactggattcctcttgccctgacaatcaagggcctcaatcccaccgctatcttcctgacgacactgtccagaaccagcaaaaagcggtcttggccgcttaacgaggccattatggcggttgggatggtgtccatcctggccagctctctcctgaaaaatgacattcctatgaccggacccctcgtggctggcggcctgcttacagtctgctatgtgctgaccgggcgctccgccgatctggaactcgagagagctgccgacgttaagtgggaggatcaggccgaaatcagcggatccagccctattctgtctatcacaattagcgaggacggctccatgtctatcaaaaacgaagaggaggaacaaacgcttaccatcctgattcggacagggctcctggtgatcagcggagtctttcccgtgtccattccgatcaccgctgcggcctggtacctctgggaggttaagaagcagcgcgctggcgtgctgtgggatgtcccttctccccctcccgtggggaaagccgaacttgaggacggagcctatagaattaagcagcggggcatcctgggctacagccagatcggggctggagtctataaagaaggcacattccacaccatgtggcatgtgacgcgcggggccgttctgatgcacagaggaaagcggattgagccctcctgggcggatgtgaaaaaggacctcatctcttacggcgggggatggaagctggagggcgaatggaaagagggcgaagaggtccaagtgcttgctctggaacctgggaagaatccgagagccgttcagaccaaacccggaatttttaagacaaacaccggcacaatcggggccgtgagcctcgatttctcccctggaaccagcggctctcccattgtcgaccgcaaagggaaggtggtgggactgtacggcaatggcgttgtcacacggtccggggcttatgtgagcgccatcgcgcagacggagaagtctatcgaggataaccctgaaattgaggacgatatcttccgcaagaagcgcctcaccattatggacctgcatcccggagctggcaaaacaaagcggtaccttcctgccatcgtgagagaagccattaaacgcgggctgcggaccctgatcctcgctccgaccagagtcgtggccgctgagatggaagaggccctgcgcggacttcccattcggtatcagacccctgcgatcaaggccgagcacacgggcagagaaatcgttgacctgatgtgtcatgctacctttacaatgcggctcctgtcccccgtgcgcgtccctaactacaatctcattatcatggatgaggcccacttcaccgaccccgctagcattgccgccagagggtatatctccacacgggtggaaatgggcgaggctgcgggaatttttatgaccgccacgccgcctggctctcgcgatcccttcccccaaagcaacgctcctatcatggacgaggaaagagagatccccgaacggtcctggaatagcgggcacgagtgggttacagattttaagggaaaaaccgtgtggttcgtcccttctattaaggccggcaacgacatcgccgcttgcctgcgcaagaatgggaagaaagtgattcagctttcccgcaagacctttgatagcgaatacgttaagacacgggccaacgactgggatttcgtggtcaccacagacatctctgagatgggagcgaattttaaagctgagagagtgattgatccgcgccggtgtatgaagcccgtgatcctgaccgacggcgaagagagagtcatcctggccgggcctatgcccgttacgcatagctccgccgctcagcgccggggcagaattggacgcaaccctaaaaatgaaaacgaccaatatatctacatgggcgagcccctcgaaaatgatgaggactgcgcccactggaaggaggcgaaaatgctgcttgataacattaatacaccggaagggatcattccttctatgttcgagcccgaaagagagaaggtggacgccatcgatggagaataccggctgcgcggcgaggctagaaaaacctttgtggacctcatgcggcgcggggatctgcctgtctggctggcctataaggtggctgccgagggaattaactacgctgacagaaagtggtgtttcgatggcatcaaaaataaccagatcctcgaagagaacgttgaagtggagatttggacaaaggagggggaacggaagaaacttaaacccagatggctggacgcccgcatctatagcgatcctctggcgctcaaagagttcaaggaatttgccgctggccggaaatccctgacccttaatctgattacggagatgggaaagctccccaccttcatgacacagaaagccagaaacgctctggacaatctggccgtcctccataccgccgaagctggcgggcgcgcgtacaaccacgccctttctgagctgccggagacactggaaaccctcctgcttctgacactcctggctaccgtgacgggaggcatctttctgttcctcatgagcgggaagggaattggcaaaatgacacttggcatgtgctgcatcatcaccgcctccgttctgctgtggtatgcccagattcaacctcactggatcgctgccagcattatcctcgagtttttcctgattgtgcttctgatccccgaacccgagaagcagcggacccctcaggataatcagctcacatacgtcgtgatcgcgattctgaccgtcgtggccgctacaatggccaacgaaatggggtttctggagaagacgaaaaaggacctcggacttggctctatcaccacacaagagtccgaaagcaatattctggacatcgatctgagaccggcttccgcctggaccctctatgcggttgccacaaccttcgtgacgcccatgctgcggcattctattgagaacagctccgtgaatgtctctcttaccgctatcgccaaccaggctacagttctgatggggctcggaaaaggctggcctctgagcaagatggacattggggtgcccctgctcgccatcggatgttactcccaggtgaatcctatcacccttacagctgccctgctgctcctggtcgcgcactacgccattatcggccccggccttcaggctaaagccacccgcgaagctcaaaagagagccgccgcggggattatgaagaaccctacggtggatggaatcacagttattgacctggagccgatcccctatgatcctaaatttgaaaagcagctcggccaggtgatgctgctgatcctctgcgtcacccaggtgcttatgatgcggacaacctgggctctgtgtgaggccctgaccctcgctacagggcccattagcacgctgtgggagggaaatcctggccgcttctggaacaccacaatcgccgtctctatggccaatatttttagagggtcctaccttgctggagccggcctcctgttcagcatcatgaaaaacaccacaaatacccggcgcggcacggggaacattggagaaacactgggcgagaagtggaaatctagactgaacgcgctcgggaagtccgaatttcaaatctataaaaagagcggaatccaggaggtggaccggacccttgccaaggagggcattaaacgcggggaaaccgatcatcacgctgtttctagaggaagcgccaagctgcggtggttcgtggagagaaatatggtcacacccgaaggcaaagtggttgacctgggctgcgggcgcggaggctggtcctactattgtgggggactcaagaacgtgcgggaggtcaaaggcctgaccaaagggggaccgggccatgaagaacctatccccatgtctacatacggctggaatcttgtgagactgcagagcggggtggatgttttctttacgccccctgagaagtgcgacaccctcctgtgtgatattggagaatccagccccaaccctacaatcgaggctggccgcaccctgcgggtcctcaatcttgtggaaaactggctgaataacaatacacaattctgcattaaagtgctgaacccgtatatgccctccgtcatcgagaagatggaaaccctccagagaaaatacgggggagccctggttcgcaatcctctttctcggaacagcacgcacgagatgtactgggtgtccaatgcgaccggcaacatcgtgtctagcgtcaatatgatttccagaatgctgatcaaccgctttacaatgaagcacaaaaaggccacctatgagcccgacgtggatctcgggtctggaacacggaacattggcatcgaaagcgagattcctaatctggacatcattggcaagagaatcgagaagatccgccaggagcatgaaacctcctggcactacgaccaggatcatccctataagacatgggcttaccacgggagctatgagaccaaacaaacgggatctgcctccagcatggttaacggcgtggtccggctgctcacaaagccgtgggacgtggttcctatggtgacccagatggctatgaccgatacaacgcccttcgggcagcagagagtctttaaagagaaggtggacacccgcacacaagaacctaaggagggaaccaagaaacttatgagaattacagccgaatggctgtggaaagagctgggcaaaaagaaaacaccccggatgtgtacacgcgaggagttcaccagaaaagtgcggtctaatgctgccctcggggcgatctttacggatgagaacaagtggaagtccgccagagaagctgtcgaggacggacggttctgggaactggttgataaagagcgcaatcttcacctggagggcaagtgcgaaacctgtgtgtacaacatgatgggcaaaagagagaagaaactcggggaatttggaaaggccaagggcagccgggctatttggtatatgtggctgggggcccgcttcctggagtttgaagccctcggattcctgaatgaggaccattggttttctagaggcaactcccttagcggggtggagggcgaaggactgcaccggctcggctacatcctgcgcgatgtcgggaaaaaggagggaggcgcgatgtacgctgacgatacagccgggtgggacaccagaattacacttgaagacctgaaaaatgaggaaatggtgaccaaccatatgaagggagagcacaaaaagctcgccgaggctatcttcaagctgacgtatcagaataaagttgtgcgggtccagcgccctacacccagaggcaccgtgatggatatcatttcccggcgcgaccagagagggagcggccaagttggaacatacggcctgaacaccttcacgaatatggaagcccagctcatccggcagatggagggggaaggaatttttaagtctatccaacatctgaccgctacagaggagattgccgtgcagaactggcttgcgcgcgtcggcagagaacggctgagcagaatggccatctccggggatgactgcgtggttaaaccgatcgatgaccgcttcgcttctgccctcaccgctctgaatgatatgggaaaggtgcggaaagacattcagcagtgggagcctagcagaggctggaacgattggacacaagtccccttttgctcccaccacttccatgaacttgtgatgaaggacgggcgcgtcctggtggttccctgtcggaaccaggatgagctcatcggcagagcccgcatttctcagggagcgggctggagcctgaaggaaaccgcctgcctggggaaatcctatgctcagatgtggacactcatgtactttcaccggagagacctgcgccttgccgctaatgccatctgttctgctgtgcctagccattgggtcccgacctcccggacgacatggagcattcacgccaagcacgagtggatgaccaccgaggatatgctggcggtgtggaacagagtgtggatccaagaaaatccctggatggaggacaaaacacctgttgaatcttgggaggaagtgccctatctcggaaagcgcgaggaccagtggtgcggctccctgattgggcttaccagccgggccacatgggctaaaaacatccagacggccatcaatcaggtcagatctctgattggaaacgaggaatacaccgattatatgccttccatgaagcggttcagacgcgaggaagaggaagccggcgtgctctggtga

SEQ ID NO: 20023 - RNA, 9876 nt, synthetic construct
  misc_feature 1..9876: note = derived and/or modified CDS sequence (opt5) from DENV-2__FJ850108__SS-prME
  source 1..9876: mol_type = other RNA
acagccggcgtgatcgtcatgctgattcccacagctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtggtgatcacctggattggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggttaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctatcaaagacaatagagccgttcacgcggatatgggctattggatcgaatctgccctcaacgacacgtggaagatggagaaggcttccttcattgaggtgaaaagctgccactggcctaagtctcatacactgtggagcaatggggtcctggaatccgagatgatcattcccaaaaacttcgccggaccggtgagccagcacaactaccgccctggctatcatacccaaatcgctgggccctggcaccttggaaagctcgaaatggattttgacttctgtgagggcaccacagtggtcgttaccgaagattgcgggaatcggggaccctctctgagaacgacaaccgcctccggcaaactgattacagagtggtgctgtcggagctgcaccctccctccgctgcgctacagaggcgaggacgggtgttggtacggaatggaaatccggccccttaaggagaaggaagagaacctggtgaatagcctcgtgacagccggccatgggcagattgataacttttctctgggagtcctgggcatggctcttttcctcgaagagatgctgagaacccgcgtggggacgaaacacgcgatcctgctcgttgccgtgagctttgtcaccctgatcacaggaaatatgtccttccgggaccttggcagaatgatggtgatggttggcgctaccatgacagatgacattgggatgggagtgacctatctggccctcctggccgcttttaaggtccgccctacgttcgtggccggcctgcttctgagaaaactcacatctaaggagctgatgatggcgaccatcgggattacactcctgagccagtccaccatccccgaaaccattcttgagctgacagatgctctcgccctgggaatgatggttctgaaaatcgtgcggaacatggaaaagtaccaacttgccgtcacgatcatggctatttcttgcgtgcctaatgccgtgatcctgcgcaacgcgtggaaggtcagctgtaccattctcgctgccgtttccgtgagccccctgctcctgacatcttcccagcagaaagccgactggatccctcttgctctgaccattaagggcctcaatcccacagccatctttctgaccacgctgagcagaacatctaaaaagcggtcctggccgcttaacgaggctatcatggccgtggggatggtcagcattctggcgtcttccctcctgaaaaatgacatccctatgaccggacccctcgtggccggcggcctgcttaccgtttgctatgtgctgacagggcgcagcgctgatctggaactcgagagagccgctgacgtcaagtgggaggatcaggccgaaatttccggaagctctcctatcctgagcattaccatctccgaggacggctctatgagcattaaaaacgaagaggaggaacaaacacttacgatcctgatccggaccgggctcctggtgatttccggagttttccccgtgtctatcccgattacagccgctgcgtggtacctctgggaggtcaagaagcagcgcgccggcgtgctgtgggatgtcccttctccccctcccgtggggaaagctgaacttgaggacggagcctatagaatcaagcagcggggcattctgggctactcccagatcggggccggagtttataaagaaggcacctttcacacaatgtggcatgtgacccgcggggctgtcctgatgcacagaggaaagcggatcgagccctcctgggccgatgtgaaaaaggacctcattagctacggcgggggatggaagctggagggcgaatggaaagagggcgaagaggttcaagtgcttgcgctggaacctgggaagaatccgagagctgtccagacgaaacccggaatcttcaagaccaacacaggcaccattggggccgtgtccctcgattttagccctggaacatctggctcccccatcgtggaccgcaaagggaaggttgtcggactgtacggcaatggcgtggtgacccggagcggggcctatgtctctgctattgcccagacagagaagtccatcgaggataaccctgaaatcgaggacgatattttccgcaagaagcgcctcacgatcatggacctgcatcccggagcgggcaaaaccaagcggtaccttcctgctattgtgagagaagccatcaaacgcgggctgcggacactgattctcgccccgaccagagttgtggctgccgagatggaagaggctctgcgcggacttcccatccggtatcagacccctgccattaaggcggagcacacaggcagagaaatcgtcgacctgatgtgtcatgccacgttcaccatgcggctcctgagccccgtgcgcgttcctaactacaatctcatcattatggatgaggctcactttacagaccccgcctccatcgctgccagagggtatatttctacccgggtggaaatgggcgaggccgctggaatcttcatgacagcgaccccgcctggcagccgcgatccctttccccaatccaacgcccctattatggacgaggaaagagagatccccgaacggagctggaactctgggcacgagtgggtcacggatttcaagggaaaaacagtgtggtttgttccttccatcaaggctggcaacgacattgccgcctgcctgcgcaagaatgggaagaaagtgatccagcttagccgcaagaccttcgattctgaatacgtcaagacccgggctaacgactgggattttgtggtgacaaccgacattagcgagatgggagccaatttcaaagcggagagagtcatcgatccgcgccggtgtatgaagcccgttattctgacagacggcgaagagagagtgatcctggctgggcctatgcccgtgacccattcctctgccgcccagcgccggggcagaatcggacgcaaccctaaaaatgaaaacgaccaatatatttacatgggcgagcccctcgaaaatgatgaggactgcgctcactggaaggaggccaaaatgctgcttgataacatcaatacgccggaagggattatccctagcatgtttgagcccgaaagagagaaggtcgacgcgattgatggagaataccggctgcgcggcgaggccagaaaaacattcgtggacctcatgcggcgcggggatctgcctgtttggctggcttataaggtggccgctgagggaatcaactacgccgacagaaagtggtgttttgatggcattaaaaataaccagatcctcgaagagaacgtcgaagtggagatctggaccaaggagggggaacggaagaaacttaaacccagatggctggacgctcgcatttattccgatcctctggccctcaaagagttcaaggagttcgcggccggccggaaatctctgacacttaatctgatcaccgagatgggaagactccccacgtttatgacccagaaggctcgcaacgccctggacaatctggctgttctccatacagccgaagccggcgggcgggcttacaaccacgcgcttagcgagctgccggagaccctggaaacactcctgcttctgaccctcctggccacagtgaccggaggcattttcctgtttctcatgtccgggaaaggaatcggcaagatgacgcttggcatgtgctgcattatcacagctagcgtcctgctgtggtatgcccagatccaacctcactggattgccgcttctatcattctcgagttctttctgatcgtgcttctgattcccgaacccgagaaacagagaacccctcaggataatcagctcacctacgtcgtgatcgccatcctgacagttgtggcggccaccatggctaacgaaatggggttcctggagaagacaaagaaagacctcggacttggctccattacgacccaagagccggaaagcaatatcctggacattgatctgcggcccgcctccgcttggacactctatgccgtggcgaccacatttgtcacccctatgctgcgccattctatcgagaacagctccgttaatgtgtctcttacggccattgctaaccaggccaccgtgctgatggggctcggaaagggctggcccctgagcaaaatggacatcggggtccctctgctcgctattggatgttactcccaggtgaatcccatcacacttaccgccgctctgctgctcctggttgcccactacgcgatcattggccctggccttcaggccaaggctacaagagaagcccaaaaacgggctgccgccgggatcatgaagaacccgaccgtggatggaattacggtcatcgacctggagcccattccttatgatcccaagttcgaaaaacagctcggccaggtgatgctgctgatcctctgcgtcacacaggtgcttatgatgcgcaccacatgggcgctgtgtgaggctctgaccctcgccaccgggcctatcagcacactgtgggagggaaatcccggcagattttggaacacgaccattgctgtttctatggccaatatcttccgggggtcctaccttgccggagctggcctgctctttagcattatgaagaacacaaccaatacacgcagaggcaccgggaacatcggagaaacgctgggcgagaaatggaagtctcggctgaacgccctcgggaaatccgagttccaaatttataagaaaagcggaatccaggaggtggaccgcacacttgcgaaggagggcatcaagagaggggaaaccgatcatcacgccgtctctcggggaagcgctaaactgagatggtttgtggagcgcaatatggttaccccggaaggcaaggtggtcgacctgggctgcgggcggggaggctggtcctactattgtgggggactcaaaaacgtgagagaggtgaagggcctgacaaaagggggacctggccatgaagaacccattcccatgtctacctacggctggaatcttgttcgcctgcagagcggggtcgatgtgttcttcacacctcccgagaagtgcgacacgctcctgtgtgatatcggagaatccagccctaacccgaccattgaggccggccggacactgagagtgctcaatcttgtcgaaaactggctgaataacaatacccaattttgcatcaaggttctgaacccctatatgccttccgtgattgagaaaatggaaacactccagcgcaagtacgggggagctctggtgcggaatcccctttctagaaacagcacccacgagatgtactgggtctccaatgccacgggcaacatcgtgtctagcgttaatatgatctcccgcatgctgattaaccggttcaccatgaaacacaagaaagcgacatatgagcctgacgtggatctcgggtctggaaccagaaacatcggcattgaaagcgagatccccaatctggacattatcggcaagcgcattgaaaagatcaaacaggagcatgaaacatcctggcactacgaccaggatcatccgtataagacctgggcctaccacgggagctatgagacaaaacaaaccggatctgcttccagcatggtcaacggcgtggttcggctgctcacgaagccttgggacgtggtccccatggtgacacagatggccatgaccgataccacaccttttgggcagcagagagtgttcaaagagaaggtcgacacgcgcacccaagaacccaaggagggaaccaagaaacttatgagaatcaccgctgaatggctgtggaaagagctgggcaagaaaaagacacctcggatgtgtacccgcgaggaatttacaagaaaagttcggtctaatgccgctctcggggccattttcaccgatgagaacaagtggaagtccgcgagagaagccgtggaggacggacggttttgggaactggtggatcgcgagagaaatcttcacctggagggcaaatgcgaaacgtgtgtctacaacatgatgggcaagcgggagaaaaagctcggggagttcggaaaagctaagggcagccgcgccatctggtatatgtggctgggggctagatttctggagttcgaagccctcggatttctgaatgaggaccattggttctctcggggcaactcccttagcggggtggagggcgaaggactgcaccgcctcggctacattctgagagatgttgggaagaaagagggaggcgccatgtacgcggacgataccgctgggtgggacacacggatcacccttgaagacctgaagaatgaggaaatggtgacaaaccatatgaaaggagagcacaagaaactcgccgaggccatttttaagctgacctatcagaataaggtcgtgcgcgttcagagacccacgccgcggggcacagtgatggatatcatctcccgcagagaccagcgggggagcggccaagtcggaacctacggcctgaacacattcaccaatatggaagctcagctcattcgccagatggagggggaaggaatcttcaaatctattcaacatctgacggtgaccgaggagatcgccgttcagaactggcttgctagagtgggccgggaaagactgagccgcatggccatttccggggatgactgcgtcgtgaagcctatcgatgaccggtttgcgtctgccctcacagctctgaatgatatgggaaaagtcagaaaggacatccagcagtgggagcccagccgcggctggaacgattggacccaagtgcccttctgctcccaccactttcatgaacttgttatgaaagacgggcgggtgctggtcgtgccttgtagaaaccaggatgagctcattggccgcgcccggatctctcagggagctggctggagcctgaaggaaacagcctgcctggggaagtcctatgcgcagatgtggaccctcatgtacttccacagacgcgacctgcggcttgccgctaatgccatttgttctgctgtgccgagccattgggttcccacatccagaaccacgtggagcatccacgccaaacacgagtggatgacaaccgaggatatgctggctgtgtggaaccgcgtctggattcaagaaaatccttggatggaggacaagacccccgtggaatcttgggaggaagttccttatctcggaaaacgggaggaccagtggtgcggctccctgatcgggcttacaagcagagccacctgggcgaagaacattcagacagccatcaatcaggtgcggtctctgatcggaaacgaggaatacacggattatatgccctccatgaaaagatttcgccgggaggaagaggaagctggcgtcctctggtga

SEQ ID NO: 20024 - RNA, 9876 nt, synthetic construct
  misc_feature 1..9876: note = derived and/or modified CDS sequence (opt5) from DENV-2__JN819407__SS-prME
  source 1..9876: mol_type = other RNA
acagccggcgtgatcgtcatgctgattcccacagctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgagacaaaacgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagccttggaaatctgctctttaccggccatctgaaatgcagacttcggatggataagctgcaactcaaagggatgtcctactctatgtgtaccggaaagttcaagatcgtcaaagaaattgcggagacacagcacggcacgatcgtgatcagagtccagtatgagggggacggaagcccctgcaagattcccttcgaaatcaccgatctggagaaacgccatgtgctgggccggctcattacagttaaccctatcgtgattgaaaaggactccccggtcaacatcgaggccgaacccccttttggggatagctacattatcatcggcgtggagcccggacagctgaaacttaattggttcaagaagggatcttccattgggcaaatgtttgagaccacaatgagaggagctaaacgcatggccatcctgggcgacaccgcctgggatttcgggagcctcggaggcgtttttacgtctattgggaaggctctgcaccaggtgttcggcgccatctacggagcggcttttagcggcgtctcctggacaatgaaaattctgatcggggtggtgatcacctggattggaatgaactctcggagcacctcccttagcgtttctctcgtcctggtgggcgtggtcacactgtatctcggggccatggtgcaggccgactccggatgtgttgtgagctggaagaataaagaactgaagtgcggctctgggatcttcattaccgataacgtccacacatggacggagcagtacaagtttcaacctgaatcccccagcaaacttgcttccgccatccagaaggctcatgaggaaggcatttgtggaatcagatctgtgacccgcctggagaatctcatgtggaaacagatcacaccggagctgaaccacattctgagcgaaaatgaggttaaacttaccatcatgacaggcgacaccaaagggattatgcaggccggaaagcggtccctcagacctcaacccacggaactgaaatattcttggaagacctggggcaaggcgaaaatgctgttcacagagagccataaccagacctttctcatcgatgggcctgaaacagccgagtgccccaataccaaccgcgcttggaactccctggaggtggaagactacggattcggcgtctttagcacaaacatttggcttaagctgcgggagaaacaggacgtgttctgtgattctaagctcatgtccgccgctatcaaagacaatagagccgttcacgcggatatgggctattggatcgaaagcgccctgaacgacacctggaagatggagaaggcttctttcattgaggtgaaatcctgccactggcctaagagccatacgctgtggtctaatggggtccttgaaagcgagatgatcattcccaaaaactttgccggaccggtgtcccagcacaactaccgccctggctatcatacacaaaccgctgggccctggcacctcggaaagctggaaatggatttcgacttttgtgagggcaccacagtggtcgttaccgaagattgcgggaatcggggacccagcctgagaacgacaaccgcctctggcaaactcatcacagagtggtgctgtcggtcctgcaccctgcctccgcttcgctacagaggcgaggacgggtgttggtacggaatggaaattcggcccctgaaggagaaggaagagaacctcgtgaatagcctggtgacagccggccatgggcagatcgataacttctccctgggagtccttggcatggctctctttctggaagagatgctgagaacccgcgtggggacgaaacacgcgattctcctggttgccgtgtctttcgtcacccttatcacaggaaatatgagctttcgggacctgggcagagtgatggttatggtgggcgctaccatgacagatgacatcgggatgggagtcacctatctcgccctgctggccgctttcaaggtgcgccctacgtttgccgcgggccttctgctcagaaaactgacatccaaggagctcatgatggctaccattgggatcacactgctttctcagagcaccattcccgaaaccatcctggagctcacagatgccctggccctgggaatgatggttcttaaaattgtgcggaacatggaaaagtaccaactggctgtcacgatcatggccatctcctgcgtgcctaatgcggtgattctccgcaacgcttggaaggtctcttgtaccatcctggccgccgttagcgtgagccccctcctgcttacaagctctcagcagaaagctgactggattcctctggccctcaccatcaagggcctgaatcccacagctattttcctgaccacgctttccagaacaagcaaaaagcggtcttggccgctgaacgaggccatcatggcggtggggatggtctccatcctcgccagctctctgctcaaaaatgacattcctatgaccggacccctggtggctggcggccttctgaccgtttgctatgtgctgacagggcgctccgccgatctcgaactggagagagctgccgacgtcaagtgggaggatcaggccgaaatcagcggatccagccctattctttctatcaccattagcgaggacggctccatgtctatcaaaaacgaagaggaggaacaaacactgacgattctcatccggaccgggctgctcgtgatcagcggagtttttcccgtgtccattccgatcacagctgcggcctggtacctgtgggaggtcaagaagcagcgcgctggcgtgctttgggatgtcccttctccccctcccgtggggaaagccgaactggaggacggagcctatagaattaagcagcggggcatcctgggctacagccagattggggctggagtttataaagaaggcaccttccacacaatgtggcatgtgacccgcggggccgtcctcatgcacagaggaaagcggatcgagccctcctgggcggatgtgaaaaaggacctgatctcttacggcgggggatggaaacttgagggcgaatggaaagagggcgaagaggttcaagtgctggctctcgaacctgggaagaatccgagagccgtccagacgaaacccggaatttttaagaccaacacaggcaccatcggggccgtgagcctggatttctcccctggaacaagcggctctcccattgtggaccgcaaagggaaggttgtcggactctacggcaatggcgtggtgacccggtccggggcttatgtcagcgccatcgcgcagacagagaagtctattgaggataaccctgaaatcgaggacgatatcttccgcaagaagcgcctgacgattatggaccttcatcccggagctggcaaaaccaagcggtacctgcctgccatcgtgagagaagccattaaacgcgggctgcggacactcatcctggctccgaccagagttgtggccgctgagatggaagaggcccttcgcggactgcccattcggtatcagacccctgcgatcaaggccgagcacacaggcagagaaattgtcgacctcatgtgtcatgctacgtttaccatgcggctgctctcccccgtgcgcgttcctaactacaatctgatcatcatggatgaggcccacttcacagaccccgctagcattgccgccagagggtatatctccacccgggtggaaatgggcgaggctgcgggaatttttatgacagccaccccgcctggctctcgcgatcccttcccccaaagcaacgctcctatcatggacgaggaaagagagattcccgaacggtcctggaatagcgggcacgagtgggtcacggattttaagggaaaaacagtgtggttcgttccttctatcaaggccggcaacgacatcgccgcttgccttcgcaagaatgggaagaaagtgattcagctgtcccgcaagacctttgatagcgaatacgtcaagacccgggccaacgactgggatttcgtggtgacaaccgacatctctgagatgggagcgaattttaaagctgagagagtcattgatccgcgccggtgtatgaagcccgttatcctgacagacggcgaagagagagtgattctcgccgggcctatgcccgtgacccatagctccgccgctcagcgccggggcagaatcggacgcaaccctaaaaatgaaaacgaccaatatatctacatgggcgagcccctggaaaatgatgaggactgcgcccactggaaggaggcgaaaatgcttctggataacattaatacgccggaagggatcattccttctatgttcgagcccgaaagagagaaggtcgacgccatcgatggagaataccggctccgcggcgaggctagaaaaacatttgtggacctgatgcggcgcggggatctgcctgtttggctcgcctataaggtggctgccgagggaattaactacgctgacagaaagtggtgtttcgatggcatcaaaaataaccagattcttgaagagaacgtcgaagtggagatctggaccaaggagggggaacggaaaaagctgaaacccagatggctggacgcccgcatctatagcgatcctctcgcgctgaaggagttcaaggaatttgccgctggccggaaatcccttacactgaatctcattaccgagatgggaagactgcccacgttcatgacccagaaggcccgcaacgctctggacaatctcgccgttcttcatacagccgaagctggcgggcgggcgtacaaccacgccctgtctgagctgccggagaccctcgaaacactgcttctgctcaccctgctggctacagtgaccggaggcatctttctcttccttatgagcgggaaaggaattggcaagatgacgctgggcatgtgctgcatcattacagcctccgtcctgctctggtatgcccagatccaacctcactggatcgctgccagcattatcctggagtttttccttattgtgctgctcatccccgaacccgagaaacagagaacccctcaggataatcagctgacctacgtcgtgattgcgatcctgacagttgtggccgctaccatggccaacgaaatggggtttctcgagaagacaaagaaagaccttggactgggctctatcacgacccaagagccggaatccaatattctggacatcgatctccggcccgctagcgcctggacactgtatgcggtggccaccacattcgtcacccctatgcttcgccattccattgagaactctagcgttaatgtgtccctgacggctatcgccaaccaggctaccgtgctcatggggctgggaaagggctggcccctgtctaaaatggacattggggtccctctccttgccatcggatgttacagccaggtgaatcccattacactgaccgctgccctgctcctgcttgttgcgcactacgccatcatcggccctggcctgcaggctaaggccacaagagaagctcaaaaacgggccgccgcggggattatgaagaacccgaccgtggatggaatcacggtcattgacctcgagcccatcccttatgatcccaagtttgaaaaacagctgggccaggtgatgctgctcattctttgcgtcacacaggtgctgatgatgcgcaccacatgggctctgtgtgaggccctcaccctggctaccgggcctatctccacactttgggagggaaatcccggcagattctggaacacgaccatcgccgttagcatggccaatatttttcgggggtcttacctggctggagccggcctcctgttctccatcatgaagaacacaaccaatacacgcagaggcaccgggaacattggagaaacgctgggcgagaaatggaagtcccggctcaacgcgcttgggaaatctgaatttcaaatctataagaaatccggcattcaggaggtggaccgcacactggccaaggagggcatcaagagaggggaaaccgatcatcacgctgtcagccggggatctgccaaactgagatggttcgtggagcgcaatatggttaccccggaaggcaaggtggtcgacctcggctgcgggcggggaggctggagctactattgtgggggactgaaaaacgtgagagaggtgaagggccttacaaaagggggacctggccatgaggaacccatccccatgtccacctacggctggaatctggttcgcctccagtctggggtcgatgtgttctttacacctcccgagaagtgcgacacgctgctgtgtgatattggagaaagctcccctaacccgaccatcgaggctggccggacactcagagtgcttaatctggtcgaaaactggctgaataacaatacccaattctgcattaaggttctcaacccctatatgcctagcgtgatcgagaaaatggaaacactgcagcgcaagtacgggggagcccttgtgcggaatcccctgtccagaaactctacccacgagatgtactgggtcagcaatgcgacgggcaacattgtgtcctctgttaatatgatcagccgcatgctcatcaaccggtttaccatgaaacacaagaaagccacatatgagcctgacgtggatctggggtccggaaccagaaacattggcatcgaatctgagattcccaatctggacatcattggcaagcgcatcgaaaagattaaacaggagcatgaaacaagctggcactacgaccaggatcatccgtataagacctgggcttaccacgggtcctatgagacaaaacaaaccggaagcgcctcttccatggtcaacggcgtggttcggctccttacgaagccttgggacgtggtccccatggtgacacagatggctatgaccgataccacacctttcgggcagcagagagtgtttaaagagaaggtcgacacgcgcacccaagaacccaaggagggaaccaaaaagctgatgagaatcaccgccgaatggctgtggaaagagctcggcaagaaaaagacacctcggatgtgtacccgcgaggagttcacaagaaaagttcggagcaatgctgccctgggggcgatctttaccgatgagaacaagtggaagtctgccagagaagctgtggaggacggacggttctgggaacttgtggatcgcgagagaaatctgcacctcgagggcaaatgcgaaacgtgtgtctacaacatgatgggcaagcgggagaaaaagctgggggaatttggaaaagccaagggctcccgcgctatttggtatatgtggctgggggccagattcctcgagtttgaagccctgggattccttaatgaggaccattggtttagccggggcaactctctgtccggggtggagggcgaaggactccaccgcctgggctacatccttagagatgttgggaagaaagagggaggcgcgatgtacgctgacgataccgccgggtgggacacacggattaccctggaagacctcaagaatgaggaaatggtgacaaaccatatgaaaggagagcacaagaaactggccgaggctatcttcaagctgacctatcagaataaggtcgtgcgcgttcagagacccacgccgcggggcacagtgatggatattatcagccgcagagaccagcgggggtccggccaagtcggaacctacggcctcaacacattcaccaatatggaagcccagctgatccgccagatggagggggaaggaatttttaaaagcatccaacatcttacggtgaccgaggagattgctgttcagaactggctggccagagtgggccgggaaagactctctcgcatggcgatcagcggggatgactgcgtcgtgaagcctattgatgaccggttcgcctccgctctgacagcccttaatgatatgggaaaagtcagaaaggacatccagcagtgggagccctctcgcggctggaacgattggacccaagtgcccttttgcagccaccacttccatgaactggttatgaaagacgggcgggtgctcgtcgtgccttgtagaaaccaggatgagctgatcggccgcgctcggatttcccagggagccggctggtctctgaaggaaacagcgtgcctcggaaagagctatgcccagatgtggaccctgatgtactttcacagacgcgaccttcggctggctgccaatgctatctgttccgccgtgccgtctcattgggttcccacaagcagaaccacgtggtccattcacgctaaacacgagtggatgacaaccgaggatatgctcgccgtgtggaaccgcgtctggatccaagaaaatccttggatggaggacaagacccccgtggaaagctgggaggaagttccttatctgggaaaacgggaggaccagtggtgcggctctcttattgggctgacatccagagcgacctgggccaagaacatccagacagctattaatcaggtgcggagcctcatcggaaacgaggaatacacggattatatgccctctatgaaaagattccgccgggaggaagaggaagccggcgtcctgtggtga

SEQ ID NO: 20025 - RNA, 9876 nt, synthetic construct
  misc_feature 1..9876: note = derived and/or modified CDS sequence (opt5) from DENV-2__FJ898465__SS-prME
  source 1..9876: mol_type = other RNA
accgcgggagtgatcattatgctgatccccaccgctatggccttccacctcacgaccagaaatggggagcctcatatgattgtcggacggcaggaaaagggcaagagcctgctttttaagacggaggacggggttaatatgtgcaccctgatggcgatcgatctcggagaactgtgtgaggacaccattacctacaagtgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagaaggccctgattttcatccttctgacagcggtggcccctagcatgacgatgagatgcattggcatctccaaccgggattttgtcgaaggggtgtctggaggcagctgggttgacatcgtgctcgagcacgggtcctgtgtcaccacaatggctaagaataaacccaccctggatttcgaacttattaagacagaggccaaacagcctgctaccctgcgcaagtattgcatcgaagccaaactcacgaacacaaccaccgagagcagatgtccgacacaaggagagccctctctgaatgaagaacaggacaagcggtttatttgcaagcattccatggtggatcgcggctggggcaacgggtgtggactgttcggcaaagggggaatcgtgacctgcgcgatgtttacatgcaagaaaaatatggaaggcaaggtcgttctccctgagaacctggaatacacgattgtgatcacaccccacagcggggaggagcatgccgtgggaaatgacacaggcaaacacggcaaggaaatcaaaattacccctcagtcttccatcacagaggctgaacttaccgggtatggaacggtcaccatggagtgtagccccagaacaggcctggatttcaacgaaatggtgctcctgcagatggaggagaaggcctggcttgttcaccggcaatggtttctggacctcccgctgccttggctgcccggggctgatacccagggatctaattggattcagaaggaaacactcgtgaccttcaaaaaccctcatgccaagaaacaggacgtcgtggttctgggctcccaagagggggccatgcacacggctcttacaggcgcgaccgaaatccagatgagctccggaaatctgctctttacaggccatctgaagtgccgccttagaatggacaaactgcagctcaaggggatgtcttacagcatgtgtaccggaaagttcaaaattgtgaaggagatcgccgagacccaacacggcacaatcgtcattcgggtgcagtatgaaggggatggatccccctgcaaaatccccttcgagattatggacctggaaaagagacatgtcctgggccgcctcatcacggtgaaccctattgttaccgagaaagatagcccggtgaacatcgaagctgagcccccttttggggactcttacattatcatcggcgtcgagcccggacagctgaaacttaattggttcaagaaaggctccagcattgggcagatgtttgaaacaaccatgcggggagccaagagaatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccgctccaccagcctttctgtgtccctcgtgctggttggcgtcgtgaccctgtatctcggggccatggtgcaggctgatagcggatgtgtcgtgtcttggaaaaataaggagctgaagtgcggctccgggattttcatcacagacaacgttcacacctggacagaacagtacaaatttcagcctgagagcccctccaaacttgcctctgctattcaaaaagcccatgaagagggcatctgtggaatccggagcgtgacgagactggagaatctcatgtggaagcagattaccccggaactgaaccacatcctgtccgagaatgaagtcaaacttacaattatgaccggcgatatcaaggggattatgcaggcgggaaaacgctctctccggcctcagcccacagagctgaagtatagctggaagacctggggcaaagccaagatgctgtccacggaaagccataaccaaaccttcctcatcgacgggcctgagacagctgagtgccccaataccaacagagcctggaactctctggaagtggaggattacggatttggcgttttctccacaaacatctggcttaaactgcgcgaaaagcaggacgtgttttgtgacagcaaactcatgtctgctgccattaaggataatcgggcggtccacgccgacatgggctattggatcgagtccgctctgaacgatacctggaagatggagaaagccagcttcattgaagtgaagtcttgccactggcctaaaagccatacactgtggtccaatggggttcttgagagcgaaatgatcattcccaagaacttcgctggaccggtgtctcagcacaactacagacctggctatcatacccagacggccgggccctggcacctcggaaaactggagatggactttgatttctgtgaaggcacaaccgtcgtggtgaccgaggactgcgggaatcgcggaccctccctgcggacaaccacggccagcggcaagctcatcacagagtggtgctgtagatcctgcaccctgcctccgcttcggtaccgcggcgaagatgggtgttggtacggaatggagattagacccctgaaggaaaaagaggaaaacctcgtcaattctctggttacagctggccatgggcaaatcgacaactttagcctgggagtgcttggcatggccctcttcctggaggagatgctgcggaccagagtggggacaaagcacgccatgctcctggtcgctgtgtcctttgttacccttatcacgggaaatatgtctttccgcgatctgggccgggtgatggtcatggtgggcgccaccatgacagacgatattgggatgggagttacctatctcgccctgctggctgcctttaaagtgagacctacattcgcggctggccttctgctccgcaagctgaccagcaaagaactcatgatggccacgatcgggattgccctgctttcccagtctacaatccccgagaccattctggaactcacagacgctctggccctgggaatgatggtccttaagatcgtgagaaacatggagaattaccagctggcggttaccatcatggctattagctgcgtgcctaacgccgtcatcctcctgaatgcctggaaggtgtcctgtaccattctcgctgccgtgagcgtctctcccctgcttctgacatccagccaacagaaagctgattggatccctctcgccctgacgattaagggcctgaaccccaccgcgatctttcttacaaccctgtctcggacatccaaaaagcgcagctggccgctcaatgaagccgttatggctgtggggatggtgtctatcctggcctccagcctcctgaaaaacgacattcctatgaccggaccccttgtcgctggcggcctgctgacggtgtgctatgttctcacagggagatccgccgacctggagcttgagcgggccgctgatgtgaagtgggaagaccacgcggagatcagcggatctagccctattctgtccatcaccatttctgaagatggcagcatgtccatcaaaaatgaggaggaagaacagaccctcacaattctgatccgcaccgggctcctggtcatctctggagtgttccccgttagcattccgatcacagccgctgcctggtacctttgggaagtgaagaagcagagagccggcgtcctgtgggacgtgccttctccccctcccgtcgggaaagctgagctggaagatggagcctatcggattaagcaacgcggcatcctcggctacagccagattggggcgggagtgtataaagagggcacgtttcataccatgtggcacgttacaagaggggctgtgctgatgcatcggggaaagcgcatcgagcccagctgggccgacgtcaaaaaggatcttatctcctacggcgggggatggaagctggaaggcgagtggaaagaaggcgaggaagtgcaggttctcgccctggagcctgggaagaacccgagagctgtgcagaccaaacccggactcttcaagacaaataccggcacgattggggccgtcagcctggacttttctcctggaacctccggcagccccatcgtggatcggaaagggaaggtggttggactttacggcaacggcgtcgtgacaagatctggggcgtatgtgtccgctattgcccaaaccgaaaagagcatcgaagacaaccctgagattgaagatgacatcttccgcaaaaagcggctgacaatcatggatctgcaccccggagccggcaaaaccaagagatacctccctgctattgtccgcgaggccatcaaacgggggctgagaacacttattctggctccgacgcgcgtggttgccgcggaaatggaggaggccctccggggactgcccatcagatatcagacccctgctattcgcgccgaacatacaggccgggagatcgtggacctcatgtgtcacgctaccttcaccatgagactgctttcccccgtccgggtgcctaattacaacctgattatcatggacgaagcccactttacagatcccgcctctatcgctgcgcgcgggtatattagcacgagagttgagatgggcgaggccgctggaatcttcatgaccgccacaccgcctggctcccgggacccctttccccagagcaatgcccctattatggatgaggaacgcgaaatccccgagagatcttggaactccgggcatgaatgggtgaccgacttcaagggaaagacagtctggtttgtgcctagcattaaagctggcaatgatatcgccgcgtgcctgcggaagaacgggaaaaaggttatccagctctctagaaaaaccttcgacagcgagtacgtgaagacgcgcgctaatgattgggactttgtcgtgacaaccgatatttccgagatgggagccaacttccgggccgaaagagtgatcgacccgcgccggtgtatgaagcccgtcattctgaccgatggcgaggaaagagttatccttgctgggcctatgcccgtgacacactctagcgccgcgcaacgccggggcagaattggacgcaatcctaaaaacgagaatgaccagtatatctacatgggcgaacccctggagaacgacgaggattgcgcccattggaaggaagctaaaatgctcctggacaatatcaacaccccggaggggattatcccttccatgtttgaacccgagagagaaaaggtggatgccattgacggagagtaccggctgcgcggcgaggctagaaaaacattcgtcgatctcatgcggcgcggggaccttcctgtgtggctggcctatagagttgctgccgaaggaatcaattacgcggatcggagatggtgttttgacggcattaagaacaaccagatcctggaggaaaatgtggaggtcgagatttggaccaaagaaggggagcgcaagaagctcaaaccccggtggctggatgccagaatctattctgaccctcttgctctgaaggagttcaaagagttcgccgctggccgcaagagcctcacgctgaacctgatcacagaaatgggacggctccccacctttatgacacaaaaagccagagatgcccttgacaatctggctgtgctgcacaccgcggaggccggcgggcgggcttacaaccacgccctctccgagctgccggaaacgcttgagaccctgctcctgctgacactccttgccaccgttacaggaggcattttcctgtttctgatgagcgggaagggaatcggcaagatgaccctcggcatgtgctgcattatcacagcttctattctgctttggtatgcccagatccagcctcattggatcgcggcctccattatcctggagttctttctcattgtgctgctgatccccgagcccgaaaaacagcgcacccctcaagataatcagctcacgtacgtcgtgattgctatccttacagtcgtggccgctaccatggccaacgagatggggttcctggagaagaccaaaaaggacctgggactcggcagcatcacaacccaggaatccgagtctaatattctggacatcgatcttagaccggcgagcgcctggacactgtatgctgttgccacgacctttgtgacacccatgctccggcactccattgaaaactctagcgtgaatgtctccctgaccgctatcgccaaccaggctacagttctgatggggctcggaaaaggctggcctcttagcaagatggacattggggtgcccctgctggccatcggatgttactctcaagtgaatcctattaccctcacggcggccctgcttctgctcgtcgctcattacgccatcatcggccccggcctgcaggctaaggccacccgcgaggcccagaaaagagcggctgccgggattatgaagaaccctacagtggatggaatcaccgttattgacctggaaccgatcccctatgatcctaaattcgagaagcagctcggccaagtgatgcttctgattctgtgcgtcacacaggtgctcatgatgcggaccacgtgggctctgtgtgaggcccttacactggccaccgggcccatctccacactctgggaaggaaatcctggccgcttttggaacaccaccatcgctgtcagcatggccaatattttcagagggtcttacctggcgggagccggcctgctcttttccatcatgaaaaacacaacgaatacccggcgcggcacagggaacattggagagacccttggcgaaaagtggaagtccagactgaacgctctggggaaatctgagttccagatctataagaaaagcggcattcaggaggtggaccggacactcgccaaggaaggcatcaaaagaggggagaccgatcaccatgctgtttcccgcggatctgccaagctgcggtggtttgtggaaagaaatatggtcacgcccgagggcaaagtggttgaccttggctgcgggcgcggaggctggagctactattgtgggggactgaagaacgtgcgggaagtcaagggcctcacaaaagggggaccgggccacgaggagcctatccccatgtccacctacggctggaatctggtgagactgcaaagcggggtggatgttttcttcacaccccctgaaaagtgcgacacactcctttgtgatattggagagtcctctcccaaccctaccatcgaagcgggccgcacactgcgggtcctgaatctcgtggagaactggctgaataacaatacgcagttttgcattaaagtgcttaacccgtatatgcccagcgtcatcgaaaagatggagaccctgcagagaaaatacgggggagccctcgttcgcaatcctctgtcccggaactctacacacgagatgtactgggtgagcaatgctaccggcaacattgtgtcctctgtcaatatgatcagcagaatgctgatcaaccgcttcacaatgaagcataagaaagccacctatgaacccgacgtggatctcgggtccggaacgcggaacattggcatcgagagcgaaattcctaatcttgacatcattggcaagagaatcgagaaaattaagcaagaacacgagacctcttggcattacgaccaggatcacccctataaaacatgggcttaccacgggtcctatgagaccaagcagacaggaagcgcctcttccatggttaacggcgtggtccgcctgctgaccaagccgtgggacgtggttcctatggtgacacagatggctatgaccgatacgacaccctttgggcaacagagagtcttcaaagaaaaggtggacacccggacccaggagcctaaagaaggaacaaagaaactcatgcgcatcacggccgagtggctgtggaaggagcttggcaagaaaaagacccccagaatgtgtacacgggaagagtttaccagaaaagtgcggagcaatgcggccctgggggctatcttcacagatgaaaacaagtggaaatctgcccgcgaggctgtcgaagactccagattttgggagctcgttgatcgggagcgcaatctgcatctggaaggaaagtgcgagacctgtgtgtacaacatgatgggcaaaagagaaaagaagctcggcgagttcgggaaagccaagggaagccgggccatttggtatatgtggctgggcgcgcgctttcttgagttcgaggctctggggtttctcaatgaggaccactggttctccagaggaaacagcctgtctggcgtggaaggggagggccttcatcggctgggatacatcctccgcgatgtcagcaaaaaggaaggcggggccatgtacgccgacgatacagctggatgggacaccagaattacgctggaggacctgaaaaatgaagagatggtgaccaaccacatgaagggcgagcataagaaactcgccgaagctatctttaagctgacatatcagaataaagttgtgcgggtccaacgccctacccccagagggacagtgatggatattatctcccggcgcgaccagagaggatctggccaggttgggacctacggccttaacacgttcacaaatatggaggcccagctgatccggcaaatggaaggagagggcattttcaagagcatccagcacctcaccgtgacagaggaaattgcggtccagaactggctggccagagtggggcgcgagcggctttccagaatggctatctctggagatgactgcgttgtgaaaccgctggatgaccgctttgccagcgctctcaccgccctgaatgatatgggcaaggtccggaaggacattcaacagtgggaaccttccagagggtggaacgattggacacaggtgcccttctgctctcaccattttcacgagctggtcatgaaagacggacgcgtgctcgttgtgccctgtcggaaccaggatgaactgatcggcagagcgcgcatcagccaaggggccggctggtcccttaaggagaccgcttgcctgggaaaaagctatgcccagatgtggacactcatgtacttccatcggagagacctgcgccttgctgccaatgctatttgttctgccgtcccttcccactgggtgccgaccagccggacaacctggtctatccacgcgaagcatgagtggatgacaaccgaagatatgctggccgtgtggaacagagtttggattcaggagaatccctggatggaagacaaaacgcctgtggagtcctgggaagaggtcccctatctcggcaagcgggaggaccagtggtgcgggagcctgatcggactgacatccagagctacctgggccaagaacattcaaaccgccatcaatcaggtgcgctctctcattggcaacgaagagtacacagattatatgcctagcatgaaacggtttagacgcgaagaggaagaggctggggttctgtggtga

SEQ ID NO: 20026 - RNA, 9876 nt, synthetic construct
  misc_feature 1..9876: note = derived and/or modified CDS sequence (opt5) from DENV-2__FJ898466__SS-prME
  source 1..9876: mol_type = other RNA
accgccggagtgatcgtgatgctgattcccacagctatggccttccacctcacgacccggaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagagagctcatgaggaaggcatttgtggaatccgcagcgtcacacggcttgagaatctgatgtggaagcagatcaccccggagctcaaccacattctgtccgaaaatgaggtgaaactgacaatcatgaccggcgacacgaaggggattatgcaggccggaaaaagatctcttcgccctcaacccaccgaactcaagtatagctggaaaacatggggcaaggcgaagatgctgtccaccgagagccataaccagacattcctgatcgatgggcctgaaaccgccgagtgccccaatacaaaccgggcttggaactctctcgaggttgaagactacggatttggcgtgttcaccacgaacatttggctgaaacttagagagaagcaggacatcttttgtgattccaaactgatgagcgccgctatcaaggacaatcgcgccgtccacgcggatatgggctattggattgaatctgccctcaacgacacatggaaaatggagaaggcttccttcatcgaggtcaagagctgccactggcctaaatctcataccctgtggagcaatggggttctggaatccgagatgattatccccaagaacttcgccggaccggtgagccagcacaactaccggcctggctatcatacccaaacagctgggccctggcaccttggaaaactcgaaatggattttgacttctgtgagggcaccacggtcgtggtgacagaagattgcgggaatagaggaccctctctgcggaccacaaccgcctccggcaagctgattacagagtggtgctgtcgcagctgcaccctccctccgctgagataccggggcgaggacgggtgttggtacggaatggaaatcagaccccttaaagagaaggaagagaacctggtcaattccctcgttacggccggccatgggcagattgataacttttctctgggagtgctgggcatggctcttttcctcgaagagatgctgcgcacccgggtggggacaaagcacgcgatcctgctcgtcgccgtgagctttgttaccctgatcacaggaaatatgtccttcagagaccttggccgcgtgatggtcatggtgggcgctaccatgacggatgacattgggatgggagttacatatctggccctcctggccgcttttaaagtgagacctaccttcgccgcgggcctgcttctgcggaagctcacatctaaagagctgatgatggctaccatcgggattgccctcctgagccagtccaccatccccgaaacaattcttgagctgacggatgccctcgctctgggaatgatggccctgaagatcgtccgcaacatggaaaaataccaacttgcggtgaccatcatggctatttcttgcgttcctaatgccgtgatcctgcagaacgcctggaaggtcagctgtacaattctcgctgccgtgtccgtgagccccctgctcctgacctcttcccagcagaaggctgactggatccctcttgccctgacaattaaaggcctcaatcccaccgcgatctttctgacgacactgagcagaacctctaagaaacggtcctggccgcttaacgaggccatcatggctgtcgggatggttagcattctggcctcttccctcctgaagaatgacatccctatgaccggacccctcgtggctggcggcctgcttacagtgtgctatgtcctgaccgggcgcagcgccgatctggaactcgagagagccgctgacgtgaaatgggaggatcaagcggaaatttccggaagctctcctatcctgagcattacaatctccgaggacggctctatgagcattaagaacgaagaggaggaacagacgcttaccatcctgatccggacagggctcctggttatttccggagtgttccccgtctctatcccgattaccgccgctgcctggtacctctgggaggtgaaaaagcagcgcgccggcgttctgtgggatgtgccttctccccctcccgtcgggaaggctgaacttgaggacggagcctatagaatcaaacagcggggcattctgggctactcccaaatcggggcgggagtgtataaggaaggcacatttcacaccatgtggcatgtcacgcgcggggctgtgctgatgcacagaggaaaacggatcgagccctcctgggccgatgttaagaaagacctcattagctacggcgggggatggaagctggagggcgaatggaaggagggcgaagaggtgcaggtccttgccctggaacctgggaaaaatccgagagctgtgcagaccaagcccggaatcttccgcacaaacaccggcacaattggggccgtttccctcgattttagccctggaacctctggctcccccatcgtggaccggaaagggaaggtcgtgggactgtacggcaatggcgtggttacaagaagcggggcgtatgtctctgctattgcccagacggagaaatccatcgaggataaccctgaaatcgaggacgatattttccgcaagaagcggctcaccatcatggacctgcatcccggagccggcaaaacaaagagataccttcctgctattgtgcgcgaagccatcaaacgggggctgagaaccctgattctcgctccgacccgcgtggtcgccgcggagatggaagaggccctgcggggacttcccatcagatatcaaacccctgctattaaggccgagcacacgggccgggaaatcgtggacctgatgtgtcatgctaccttcacaatgcgcctcctgagccccgttagagtgcctaactacaatctcatcattatggatgaggcccactttaccgaccccgcctccatcgctgcgcgggggtatatttctacacgcgtcgaaatgggcgaggccgctggaatcttcatgaccgccacgccgcctggcagcagagatccctttccccagtccaacgcccctattatggacgaggaacgggagatccccgaaagaagctggaactctgggcacgagtgggtgacagatttcaaaggaaagaccgtttggtttgtgccttccatcaaggctggcaacgacattgccgcgtgcctgcgcaaaaatgggaagaaagtcatccagcttagccggaagaccttcgattctgaatacgtgaaaacaagagctaacgactgggattttgttgtgaccacagacattagcgagatgggagccaatttcaaggccgagcgcgtcatcgatccgcggagatgtatgaagcccgtgattctgaccgacggcgaagaaagagtgatcctggctgggcctatgcccgtcacgcattcctctgccgcgcaacggagaggccgcatcggaagaaaccctaaaaatgaaaacgaccagtatatttacatgggcgagcccctcgaaaatgatgaggactgcgcccactggaaggaggctaaaatgctgcttgataacatcaatacaccggaagggattatccctagcatgtttgagcccgaacgggagaaggttgacgccattgatggagaataccgcctgagaggcgaggctcggaaaaccttcgtggacctcatgcgcagaggggatctgcctgtgtggctggcctataaggtcgctgccgagggaatcaactacgcggaccggaaatggtgttttgatggcattaagaataaccagatcctcgaagagaacgtggaagttgagatctggacaaaggagggggaacgcaagaaacttaaaccccgctggctggacgcccggatttattccgatcctctggctctcaaggagttcaaagagttcgccgctggcagaaagtctctgacccttaatctgatcacggagatgggacgcctccccacctttatgacacagaaggcccggaacgccctggacaatctggctgtgctccataccgcggaagccggcgggagagcttacaaccacgcccttagcgagctgccggagacactggaaaccctcctgcttctgacactcctggccaccgtcacgggaggcattttcctgtttctcatgtccgggaaaggaatcggcaagatgacacttggcatgtgctgcattatcaccgctagcatcctgctgtggtatgcccaaattcagcctcactggatcgcggcctctattatcctcgagttctttctgattgtgcttctgatccccgaacccgagaaacagcggacccctcaggataatcaactcacatacgttgtgatcgctattctgaccgtcgtggccgctacaatggccaacgaaatggggttcctggagaagacgaaaaaggacctcggacttggctccatcaccacacaggagagcgaatccaatattctggacatcgatctgcgcccggcgtctgcctggaccctctatgctgtcgccacaacctttattacgcccatgctgagacatagcatcgagaactcctctgtgaatgttagccttaccgctattgccaaccaggctacagtgctgatggggctcggaaagggctggcctctgtccaaaatggacatcggggtgcccctgctcgccatcggatgttacagccaggtcaatcctattacccttacagcggccctgctgctcctggttgctcactacgccatcattggccccggccttcaagctaaggccacccgggaagcccagaaacgcgcggctgccgggatcatgaagaaccctacggtggatggaattacagtgatcgacctggagccgatcccctatgatcctaaattcgaaaagcagctcggccaggtcatgctgctgattctctgcgtgacccaagttcttatgatgagaacaacctgggctctgtgtgaggccctgaccctcgccacagggcccatctctacgctgtgggagggaaatcctggccggttttggaacaccacaattgctgtgtccatggccaatatcttccgcgggagctaccttgcgggagccggcctgctcttttctattatgaagaacaccacaaataccagacggggcacggggaacatcggagaaacactgggcgagaaatggaagtcccgcctgaacgctctcgggaaaagcgagttccagatctataagaaatctggcattcaggaggtcgacagaacccttgccaaggagggcatcaaaagaggggaaaccgatcatcacgctgtgagcagaggatccgccaagctgcgctggtttgtcgagcggaatatggtgacacccgaaggcaaggttgtggacctgggctgcgggagaggaggctggtcttactattgtgggggactcaaaaacgtccgcgaggtgaagggcctgaccaaagggggaccgggccatgaagaacctattcccatgagcacatacggctggaatcttgttcggctgcaatccggggtggatgtcttcttcacgccccctgagaagtgcgacaccctcctgtgtgatatcggagaaagctcccccaaccctacaattgaggcgggcagaaccctgcgcgtgctcaatcttgtggaaaactggctgaataacaatacacagttttgcatcaaagttctgaacccgtatatgccctctgtcatcgagaagatggaaaccctccagcggaagtacgggggagccctggtgagaaatcctcttagccgcaactccacgcacgagatgtactgggtgtctaatgctaccggcaacattgtcagctccgttaatatgatctctcggatgctgattaacagattcacaatgaaacacaagaaagccacctatgagcccgacgtggatctcgggagcggaacacgcaacatcggcattgaatccgagatccctaatctggacattatcggcaagcggatcgagaagattaagcaggagcatgaaaccagctggcactacgaccaagatcatccctataagacatgggcttaccacgggtcttatgagaccaaacagacgggatccgccagctctatggtgaacggcgtcgtgagactgctcacaaagccgtgggacgttgtgcctatggtcacccagatggctatgaccgatacaacgccctttgggcagcaacgcgtgttcaaagagaaggttgacaccagaacacaggaacctaaagagggaaccaagaaacttatgaaaatcacagccgaatggctgtggaaggagctgggcaaacggaagacaccccgcatgtgtacaagagaggaatttaccaaaaaggtgcggtccaatgcggccctcggggctattttcacggatgagaacaaatggaaaagcgccagagaagctgtcgaggacggacggttttgggaactggtggatcgcgagagaaatcttcacctggagggcaagtgcgaaacctgtgtgtacaacatgatgggcaaacgggagaagaaactcggggagttcggaaaggccaaaggctctcgcgccatctggtatatgtggctgggggcgagatttctggagttcgaagctctcggatttctgaatgaggaccattggttctcccggggcaacagcctttccggggtcgagggcgaaggactgcaccgcctcggctacattctgagagatgttgggaagaaggagggaggcgccatgtacgccgacgatacagctgggtgggacacccggatcacacttgaagacctgaaaaatgaggaaatggtgaccaaccatatgaagggagagcacaaaaagctcgccgaggctatctttaaactgacgtatcagaataaggtggtccgcgtgcagagacctacaccccggggcaccgttatggatattatcagccgcagagaccaacgggggtctggccaggtgggaacatacggcctgaacaccttcacgaatatggaagcccagctcattcgccaaatggagggggaaggaatcttcaagagcattcagcatctgaccgcgacagaggagatcgccgtccagaactggcttgctagagtgggccgggaaagactgtcccgcatggccatctctggggatgactgcgttgtgaaaccgattgatgaccggtttgctagcgccctcaccgcgctgaatgatatgggaaaggtcagaaaagacatccagcaatgggagccttcccgcggctggaacgattggacacaggtgcccttctgctctcaccactttcatgaacttgttatgaaggacgggcgggtgctggtcgtgccctgtagaagccaggatgagctcattggccgcgcccggatctcccagggagctggctggtctctgaaagaaaccgcctgcctgggaaagagctatgctcaaatgtggacactcatgtacttccacagacgcgacctgcggcttgccgctaacgccatttgttccgcggtccctagccattgggtgccgacctctagaacgacatggtccatccacgccaagcacgagtggatgaccaccgaggatatgctggctgtttggaatcgcgtgtggattcaggaaaacccctggatggaggacaaaacacctgtcgaaagctgggaggaagtgccctatctcggaaagcgggaggaccagtggtgcggctctctgatcgggcttacctccagagccacatgggccaaaaatatccagacggctattaaccaagtgcggagcctgatcggaaatgaggaatacaccgattatatgccttccatgaagagatttcgccgggaggaagaggaagccggcgttctctggtga

SEQ ID NO: 20027 - RNA, 9876 nt, synthetic construct
  misc_feature 1..9876: note = derived and/or modified CDS sequence (opt5) from DENV-2__FJ898467__SS-prME
  source 1..9876: mol_type = other RNA
acagccggcgtgatcattatgctgatccccacagctatggccttccacctcacgaccagaaatggggaacctcatatgattgtcggacggcaggaaaagggcaagagcctgctttttaagacagaagacggggttaatatgtgcaccctgatggcgatcgatctcggagaactgtgtgaggacacaattacctacaaatgcccgcttctgagacaaaatgaacccgaggatatcgactgttggtgcaatagcacatctacctgggtgacgtatggcacctgtacaaccacaggggagcacagacgggaaaagagaagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagaatccagtatgagggggacggatccccctgcaagattcccttcgaaatcaccgatctcgagaaacgccatgtgctgggccggctgattacagtcaaccctatcgtgattgaaaaggacagcccggttaacatcgaggccgaacccccttttggggattcttacatcattatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtctttacgagcattgggaaggctctccaccaggtgttcggcgccatctacggagcggctttttccggcgtttcttggacaatgaaaatcctgattggggtggtcatcacctggattggaatgaacagccggtccaccagcctgtctgtgtcccttgtgctcgttggcgtcgtgacactgtatctgggggccatggtgcaggccgacagcggatgtgtcgtgtcttggaagaataaagaactcaagtgcggctccgggatcttcattaccgataacgttcacacatggacggagcagtacaagtttcaacctgaaagcccctccaaactggcttctgccatccagaaggctcatgaggaaggcatctgtggaattagaagcgtgacccgccttgagaatctgatgtggaaacagatcacaccggagctcaaccacattctgtccgaaaatgaggtcaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccgtgagctttgttacactgattaccggaaatatgtccttccgggaccttggcagagtgatggtcatggtgggcgctacaatgaccgatgacatcgggatgggagttacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatggtcctgaaaatcgtgcggaacatggaaaagtaccaacttgctgttaccattatggccatctcttgcgtgcctaatgcggtcattctgcgcaacgcttggaaggtgagctgtacaatcctcgccgccgtgtccgtcagccccctgctcctgacctcttcccagcagaaagctgactggattcctcttgccctgacaatcaagggcctcaatcccaccgctatctttctgacgacactgagcagaacctctaaaaagcggtcctggccgcttaacgaggccattatggcggttgggatggtgagcatcctggcctcttccctcctgaaaaatgacattcctatgaccggacccctcgtggctggcggcctgcttacagtctgctatgtgctgaccgggcgcagcgccgatctggaactcgagagagctgccgacgttaagtgggaggatcaggccgaaatctccggaagctctcctattctgagcatcacaatttccgaggacggctctatgagcatcaaaaacgaagaggaggaacaaacgcttaccatcctgattcggacagggctcctggtgatctccggagtcttccccgtgtctattccgatcaccgctgcggcctggtacctctgggaggttaagaagcagcgcgctggcgtgctgtgggatgtcccttctccccctcccgtggggaaagccgaacttgaggacggagcctatagaattaagcagcggggcatcctgggctactcccagatcggggctggagtctataaagaaggcacatttcacaccatgtggcatgtgacgcgcggggccgttctgatgcacagaggaaagcggattgagccctcctgggcggatgtgaaaaaggacctcatcagctacggcgggggatggaagctggagggcgaatggaaagagggcgaagaggtccaagtgcttgctctggaacctgggaagaatccgagagccgttcagaccaaacccggaattttcaagacaaacaccggcacaatcggggccgtgtccctcgattttagccctggaacctctggctcccccattgtcgaccgcaaagggaaggtggtgggactgtacggcaatggcgttgtcacacggagcggggcttatgtgtctgccatcgcgcagacggagaagtccatcgaggataaccctgaaattgaggacgatatcttccgcaagaagcgcctcaccattatggacctgcatcccggagctggcaaaacaaagcggtaccttcctgccatcgtgagagaagccattaaacgcgggctgcggaccctgatcctcgctccgaccagagtcgtggccgctgagatggaagaggccctgcgcggacttcccattcggtatcagacccctgcgatcaaggccgagcacacgggcagagaaatcgttgacctgatgtgtcatgctaccttcacaatgcggctcctgagccccgtgcgcgtccctaactacaatctcattatcatggatgaggcccactttaccgaccccgcttccattgccgccagagggtatatctctacacgggtggaaatgggcgaggctgcgggaattttcatgaccgccacgccgcctggcagccgcgatccctttccccaatccaacgctcctatcatggacgaggaaagagagatccccgaacggagctggaactctgggcacgagtgggttacagatttcaagggaaaaaccgtgtggtttgtcccttccattaaggccggcaacgacatcgccgcttgcctgcgcaagaatgggaagaaagtgattcagcttagccgcaagaccttcgattctgaatacgttaagacacgggccaacgactgggattttgtggtcaccacagacatcagcgagatgggagcgaatttcaaagctgagagagtgattgatccgcgccggtgtatgaagcccgtgatcctgaccgacggcgaagagagagtcatcctggccgggcctatgcccgttacgcattcctctgccgctcagcgccggggcagaattggacgcaaccctaaaaatgaaaacgaccaatatatctacatgggcgagcccctcgaaaatgatgaggactgcgcccactggaaggaggcgaaaatgctgcttgataacattaatacaccggaagggatcattcctagcatgtttgagcccgaaagagagaaggtggacgccatcgatggagaataccggctgcgcggcgaggctagaaaaaccttcgtggacctcatgcggcgcggggatctgcctgtctggctggcctataaggtggctgccgagggaattaactacgctgacagaaagtggtgttttgatggcatcaaaaataaccagatcctcgaagagaacgttgaagtggagatttggacaaaggagggggaacggaagaaacttaaacccagatggctggacgcccgcatctattccgatcctctggcgctcaaagagttcaaggagttcgccgctggccggaaatctctgacccttaatctgattacggagatgggaagactccccacctttatgacacagaaggcccgcaacgctctggacaatctggccgtcctccataccgccgaagctggcgggaaagcgtacaaccacgcccttagcgagctgccggagacactggaaaccctcctgcttctgacactcctggctaccgtgacgggaggcatcttcctgtttctcatgtccgggaagggaattggcaaaatgacacttggcatgtgctgcatcatcaccgccagcgttctgctgtggtatgcccagattcaacctcactggatcgctgcctctattatcctcgagttctttctgattgtgcttctgatccccgaacccgagaagcagcggacccctcaggataatcagctcacatacgtcgtgatcgcgattctgaccgtcgtggccgctacaatggccaacgaaatggggttcctggagaagacgaaaaaggacctcggacttggctccatcaccacacaagagagcgaatccaatattctggacatcgatctgagaccggcttctgcctggaccctctatgcggttgccacaacctttgtgacgcccatgctgcggcatagcattgagaactcctctgtgaatgtcagccttaccgctatcgccaaccaggctacagttctgatggggctcggaaaaggctggcctctgtccaagatggacattggggtgcccctgctcgccatcggatgttacagccaggtgaatcctatcacccttacagctgccctgctgctcctggtcgcgcactacgccattatcggccccggccttcaggctaaagccacccgcgaagctcaaaagagagccgccgcggggattatgaagaaccctacggtggatggaatcacagttattgacctggagccgatcccctatgatcctaaattcgaaaagcagctcggccaggtgatgctgctgatcctctgcgtcacccaggtgcttatgatgcggacaacctgggctctgtgtgaggccctgaccctcgctacagggcccatttctacgctgtgggagggaaatcctggccgcttttggaacaccacaatcgccgtctccatggccaatattttcagagggagctaccttgctggagccggcctgctcttttctatcatgaaaaacaccacaaatacccggcgcggcacggggaacattggagaaacactgggcgagaagtggaaatccagactgaacgcgctcggaaagagcgagttccaaatctataaaaagtctggaatccaggaggtggaccggacccttgccaaggagggcattaaacgcggggaaaccgatcatcacgctgttagcagaggatccgccaagctgcggtggtttgtggagagaaatatggtcacacccgaaggcaaagtggttgacctgggctgcgggcgcggaggctggtcttactattgtgggggactcaagaacgtgcgggaggtcaaaggcctgaccaaagggggaccgggccatgaagaacctatccccatgagcacatacggctggaatcttgtgagactgcagtccggggtggatgttttcttcacgccccctgagaagtgcgacaccctcctgtgtgatattggagaaagctcccccaaccctacaatcgaggctggccgcaccctgcgggtcctcaatcttgtggaaaactggctgaataacaatacacaattttgcattaaagtgctgaacccgtatatgccctctgtcatcgagaagatggaaaccctccagagaaaatacgggggagccctggttcgcaatcctcttagccggaactccacgcacgagatgtactgggtgtctaatgcgaccggcaacatcgtgagctccgtcaatatgatttctagaatgctgatcaaccgcttcacaatgaagcacaaaaaggccacctatgagcccgacgtggatctcgggagcggaacacggaacattggcatcgaatccgagattcctaatctggacatcattggcaagagaatcgagaagatcaagcaggagcatgaaaccagctggcactacgaccaggatcatccctataaaacatgggcttaccacgggtcttatgagaccaagcaaacgggatccgccagctctatggttaacggcgtggtccgcctgctcacaaaaccgtgggacgtggttcctatggtgacccagatggctatgaccgatacaacgccctttgggcagcagcgggtcttcaaggagaaggtggacaccagaacacaagaacctaaagagggaaccaagaaacttatgcgcattacagccgaatggctgtggaaggagctgggcaaaaagaaaacccccagaatgtgtacacgggaggaatttacccgcaaggtgagatccaatgctgccctcggggcgatcttcacggatgagaacaagtggaaaagcgcccgggaagctgtcgaggacggaagattttgggaactggttgataaggagcggaatcttcacctggagggcaaatgcgaaacctgtgtgtacaacatgatgggcaagcgcgagaaaaagctcggggagttcggaaaggccaaaggctctagagctatttggtatatgtggctgggggcccggtttctggagttcgaagccctcggatttctgaatgaggaccattggttctcccgcggcaacagcctttccggggtggagggcgaaggactgcacagactcggctacatcctgcgggatgtcgggaagaaagagggaggcgcgatgtacgctgacgatacagccgggtgggacacccgcattacacttgaagacctgaagaatgaggaaatggtgaccaaccatatgaaaggagagcacaagaagctcgccgaggctatctttaaactgacgtatcagaataaggttgtgagagtccagcggcctacaccccgcggcaccgtgatggatatcattagcagacgggaccagcgcgggtctggccaagttggaacatacggcctgaacaccttcacgaatatggaagcccagctcatcagacagatggagggggaaggaattttcaaaagcatccaacatctgaccgctacagaggagattgccgtgcagaactggcttgcgcgggtcggccgcgaaagactgtcccggatggccatctctggggatgactgcgtggttaagccgatcgatgacagatttgctagcgccctcaccgctctgaatgatatgggaaaagtgcgcaaggacattcagcagtgggagccttcccggggctggaacgattggacacaagtccccttctgctctcaccactttcatgaacttgtgatgaaggacgggagagtcctggtggttccctgtcgcaaccaggatgagctcatcggccgggccagaattagccagggagcgggctggtccctgaaagaaaccgcctgcctggggaagtcttatgctcagatgtggacactcatgtacttccaccgccgggacctgagacttgccgctaatgccatctgtagcgctgtgccttcccattgggtcccgaccagccgcacgacatggtctattcacgccaaacacgagtggatgaccaccgaggatatgctggcggtgtggaaccgggtgtggatccaagaaaatccctggatggaggacaagacacctgttgaatcctgggaggaagtgccctatctcggaaaaagagaggaccagtggtgcggcagcctgattgggcttacctctcgcgccacatgggctaagaacatccagacggccatcaatcaggtccggtccctgattggaaacgaggaatacaccgattatatgcctagcatgaagagatttcggagagaggaagaggaagccggcgtgctctggtga

SEQ ID NO: 20028 - RNA, 9876 nt, synthetic construct
  misc_feature 1..9876: note = derived and/or modified CDS sequence (opt5) from DENV-2__GQ868595__SS-prME
  source 1..9876: mol_type = other RNA
acagcgggagtgatcattatgctgatccccacagctatggccttccacctcacgaccagaaatggggagcctcatatgattgtcagccggcaggaaaaggggaagtccctgctttttaagacagaggacggcgttaatatgtgcaccctgatggcgatcgatctcggggaactgtgtgaggacacaattacctacaaatgcccgcttctgcgccaaaatgaacccgaggatatcgactgttggtgcaattctacaagcacctgggtgacgtatggaacctgtacaaccacaggcgagcacagacgggaaaagcgctccgtggctctcgtccctcatgtggggatgggactggagaccagaacggaaacatggatgtctagcgagggcgcctggaaacacgttcagcggatcgagacctggattctgcgccatcccggcttcgccatcatggctgccattctcgcttacacaatcgggaccacccactttcagagagccctgattttcatccttctgacagcggtggccccttccatgacgatgcggtgcattggaatctctaaccgcgattttgtcgaaggcgtgagcgggggatcctgggttgacatcgtgctcgagcacggcagctgtgtcaccacaatggctaagaataagcccaccctggatttcgaacttattaaaacagaggccaagcagcctgctaccctgagaaaatattgcatcgaagccaagctcacgaacacaaccaccgagtctcggtgtccgacacaaggggagccctccctgaatgaagaacaggacaaacgctttatttgcaagcatagcatggtggatagaggatggggcaacggctgtgggctgttcggaaagggcgggatcgtgacctgcgcgatgtttacatgcaaaaagaatatggaaggaaaagtcgttctccctgagaacctggaatacacgattgtgatcacaccccactctggcgaggagcatgccgtggggaatgacacaggaaagcacggcaaagaaatcaagattacccctcagtccagcatcacagaggctgaacttaccggctatgggacggtcaccatggagtgttctccccggacaggactggatttcaacgaaatggtgctcctgcagatggaggagaaagcctggcttgttcaccgccaatggtttctggacctcccgctgccttggctgcccggcgctgatacccaggggtccaattggattcagaaggaaacactcgtgaccttcaagaaccctcatgccaaaaagcaggacgtcgtggttctgggaagccaagagggcgccatgcacacggctcttacaggggcgaccgaaatccagatgtcctctggcaatctgctctttacaggacatctgaaatgcagacttcggatggacaagctgcagctcaaaggcatgagctactccatgtgtaccgggaagttcaagattgtgaaagagatcgccgagacccaacacggaacaatcgtcattagagtgcagtatgaaggcgatgggagcccctgcaagatccccttcgagattatggacctggaaaaacgccatgtcctgggacggctcatcacggtgaaccctattgttaccgagaaggattctccggtgaacatcgaagctgagcccccttttggcgactcctacattatcatcggggtcgagcccggccagctgaaacttaattggttcaagaagggaagctctattggccagatgtttgaaacaaccatgagaggggccaaacgcatggccatcctgggagatacagcttgggacttcggcagcctcgggggagtgtttacctccattggcaaggccctgcaccaagttttcggggcgatctacggcgctgccttttctggagtgagctggacgatgaaaattctgatcggcgtcatcattacatggatcgggatgaactcccggagcacctctctttccgtgagcctcgtgctggttggagtcgtgaccctgtatctcggcgccatggtgcaggctgattctgggtgtgtcgtgtcctggaagaataaagagctgaagtgcggaagcggcattttcatcacagacaacgttcacacctggacagaacagtacaagtttcagcctgagtccccctctaaacttgccagcgctattcaaaaggcccatgaagaggggatctgtggcatcagatccgtgacgcgcctggagaatctcatgtggaaacagattaccccggaactgaaccacatcctgtctgagaatgaagtcaaacttacaattatgaccggagatatcaaaggcattatgcaggcggggaagcggagcctcagacctcagcccacagagctgaaatattcctggaagacctggggaaaggccaaaatgctgagcacggaatctcataaccaaaccttcctcatcgacggccctgagacagctgagtgccccaataccaaccgcgcctggaactccctggaagtggaggattacgggtttggagttttcacaaccaacatctggcttaagctgcgggaaaaacaggacgtgttttgtgacagcaagctcatgtctgctgccattaaagataatagagcggtccacgccgacatgggctattggatcgagtccgctctgaacgatacatggaagatggagaaggccagcttcattgaagtgaaatcttgccactggcctaagagccataccctgtggtccaatggcgttcttgagagcgaaatgatcattcccaaaaacttcgctgggccggtgtctcagcacaactaccgccctggatatcatacgcagacagccggcccctggcacctcgggaagctggagatggactttgatttctgtgaaggaaccaccgtcgtggtgacagaggactgcggcaatcgggggccctccctgagaaccacgacagccagcggaaaactcatcaccgagtggtgctgtcggtcctgcacactgcctccgcttcgctacagaggcgaagatggctgttggtacgggatggagattcggcccctgaaggaaaaggaggaaaacctcgtcaattctctggttaccgctggacatggccaaatcgacaactttagcctgggggtgcttggaatggccctcttcctggaggagatgctgagaacacgcgtgggcaccaaacacgccatcctcctggtcgctgtgtcctttgttacgcttattaccgggaatatgtctttccgggatctgggaagagtgatggtcatggtgggcgccacaatgaccgacgatatcggcatgggggttacatatctcgccctgctggctgcctttaaggtgcgccctaccttcgcggctggacttctgctcagaaaactgacgagcaaggaactcatgatggccacaattggcatcgccctgctttcccagtctaccattcccgagacaatcctggaactcaccgacgctctggccctggggatgatggtccttaaaatcgtgcggaacatggagaagtaccagctggcggttaccattatggctatcagctgcgtgcctaatgccgtcattctcctgaacgcctggaaggtgtcctgtacaatcctcgctgccgtgagcgtctctcccctgcttctgacgtccagccaacagaaagctgattggattcctctcgccctgaccatcaagggactgaatcccacagcgatctttcttaccacactgtctcgcacctccaaaaagagaagctggccgctcaacgaagccgttatggctgtgggcatggtgtctattctggcctccagcctcctgaaaaatgacatccctatgacggggccccttgtcgctggaggcctgctgacagtgtgctatgttctcaccggccggtccgccgacctggagcttgagcgcgccgctgatgtgaagtgggaagaccaggcggagattagcgggtctagccctatcctgtccattaccatctctgaagatggaagcatgtccattaaaaacgaggaggaagaacagacactcaccatcctgatcagaacaggcctcctggtcatttctggggtgttccccgttagcatcccgattacggccgctgcctggtacctttgggaagtgaagaagcaacgggccggagtcctgtgggacgtgccttctccccctcccgtcggcaaagctgagctggaagatggggcctatcgcatcaagcagagaggcattctcggctacagccagatcggcgcgggggtgtataaagagggaacctttcacacaatgtggcatgttacccggggcgctgtgctgatgcaccgcgggaagagaatcgagcccagctgggccgacgtcaaaaaggatcttatttcctacggaggcgggtggaagctggaaggagagtggaaagaaggcgaggaagtgcaggttctcgccctggagcctggcaagaatccgcgggctgtgcaaacaaaacccggactcttcaagaccaacacgggaaccatcggcgccgtcagcctggacttttctcctgggacatccggaagccccattgtggatagaaaaggcaaggtggttgggctttacggaaatggcgtcgtgacccgctctggcgcgtatgtgtccgctatcgcccagacagaaaagagcattgaagacaaccctgagatcgaagatgacatcttccggaaaaagagactgaccattatggatctgcatcccggggccggaaaaacaaagcgctacctccctgctatcgtccgggaggccattaaaagaggcctgcgcacgcttatcctggctccgacccgggtggttgccgcggaaatggaggaggccctcagagggctgcccattcgctatcagacccctgctatccgggccgaacacaccggaagagagattgtggacctcatgtgtcatgctaccttcacaatgcggctgctttcccccgtccgcgtgcctaactacaatctgatcatcatggacgaagcccactttacggatcccgcctctattgctgcgagaggctatatcagcacccgggttgagatgggggaggccgctggcattttcatgacagccaccccgcctggatcccgcgacccctttccccagagcaacgcccctatcatggatgaagagagagaaattcccgagcggtcttggaactccggccacgaatgggtgacagacttcaaggggaagaccgtctggtttgtgcctagcatcaaagctggaaacgatatcgccgcgtgcctgagaaagaatggcaaaaaggttattcaactctctcgcaaaacgttcgacagcgagtacgtgaagacacgggctaacgattgggactttgtcgtgaccaccgatatctccgagatgggggccaatttcagagccgaacgcgtgattgacccgcggagatgtatgaagcccgtcatcctgacagatggagaggaacgcgttattcttgctggccctatgcccgtgacccattctagcgccgcgcagcggagagggcgcatcggcagaaaccctaaaaatgagaacgaccagtatatctacatgggagaacccctggagaatgacgaggattgcgcccactggaaggaagctaaaatgctcctggacaacattaatacaccggagggcatcattccttccatgtttgaacccgagcgggaaaaggtggatgccatcgacggggagtaccgcctgagaggagaggctcggaaaaccttcgtcgatctcatgcgcagaggcgaccttcctgtgtggctggcctatcgggttgctgccgaagggattaactacgcggatagacgctggtgttttgacggaatcaagaataaccaaattctggaggaaaacgtggaggtcgagatctggacgaaagaaggcgagcggaagaagctcaaacccagatggctggatgcccgcatctattctgaccctcttgctctgaaggagttcaaagagttcgccgctgggcggaagtccctcacactgaatctgattaccgaaatgggcagactccccacatttatgacccagaaagcccgggatgcccttgacaacctggctgtgctgcatacggcggaggccggaggccgcgcttacaatcacgccctctccgagctgccggaaacccttgagacactgctcctgctgaccctccttgccacagttaccgggggaatcttcctgtttctgatgagcggcaaggggattggaaagatgacactcggcatgtgctgcatcattaccgcttctatcctgctttggtatgcccagatccagcctcactggattgcggcctccatcattctggagttctttctcatcgtgctgctgattcccgagcccgaaaaacaaagaacgcctcaggataaccagctcacatacgtcgtgatcgctatccttaccgtcgtggccgctaccatggccaatgagatgggcttcctggagaagaccaagaaggacctggggctcggaagcattaccacacaggaatccgagtctaacatcctggacattgatcttcggccggcgagcgcctggacgctgtatgctgttgccaccacatttgtgacccccatgctccgccattccatcgaaaattctagcgtgaacgtctccctgacagctattgccaatcaagctaccgttctgatgggcctcgggaaaggatggcctcttagcaagatggacatcggcgtgcccctgctggccattgggtgttactctcaggtgaaccctatcacgctcaccgcggccctgcttctgctcgtcgctcactacgccatcattggacccggcctgcaggctaaggccacaagagaggcccagaaacgggcggctgccggcatcatgaagaatcctaccgtggatgggattacagttatcgacctggaaccgattccctatgatcctaaattcgagaagcaactcggacaggtgatgcttctgatcctgtgcgtcacccaggtgctcatgatgcgcacgacatgggctctgtgtgaggcccttaccctggccacaggccccatctccaccctctgggaagggaaccctggaagattttggaataccacaattgctgtcagcatggccaacatcttccggggctcttacctggcgggggccggactgctcttttccattatgaaaaatacgaccaacacacgcagaggcaccggcaatatcggggagacacttggagaaaagtggaaaagccggctgaacgctctgggcaaatctgagttccagatttataagaaaagcgggatccaagaggtggacagaaccctcgccaaggaaggaatcaaacgcggcgagacggatcatcacgctgtttcccgggggtctgccaagctgagatggtttgtggaacgcaacatggtcacacccgagggaaaagtggttgaccttggctgcggcagagggggatggagctactattgtggcgggctgaagaatgtgcgggaagtcaagggactcaccaaaggcgggccgggacatgaggagcctattcccatgtccacctacggctggaacctggtgcgcctgcagagcggcgtggatgttttcttcacaccccctgaaaagtgcgacaccctcctttgtgatatcggggagtcctctcccaatcctacaattgaagcgggacggacgctgagagtcctgaacctcgtggagaattggctgaacaataacacccagttttgcatcaaagtgcttaatccgtatatgcccagcgtcattgaaaagatggagacactgcaacgcaaatacggcggggccctcgttcggaaccctctgtccagaaattctacccacgagatgtactgggtgagcaacgctacaggaaatatcgtgtcctctgtcaacatgatcagccgcatgctgattaatcggttcaccatgaagcacaagaaagccacgtatgaacccgacgtggatctcggctccgggaccagaaacatcggaattgagagcgaaatccctaaccttgacattatcggcaagcgcattgagaaaatcaagcaggaacatgagacatcttggcactacgaccaggatcatccctataaaacctgggcttaccacggctcctatgagacaaagcagaccgggagcgcctcttccatggttaatggagtggtcagactgctgacaaagccgtgggacgtggttcctatggtgacccaaatggctatgacggatacaaccccctttggccagcagcgggtcttcaaagaaaaggtggacacccgcacacaggagcctaaagaagggacgaagaaactcatgagaatcaccgccgagtggctgtggaaggagcttggaaagaaaaagacaccccggatgtgtaccagagaagagtttacacggaaagtgcgcagcaacgcggccctgggcgctattttcaccgatgaaaataagtggaaatctgccagagaggctgtcgaagactcccggttttgggagctcgttgatcgcgagagaaacctgcacctggaagggaagtgcgagacatgtgtgtacaatatgatgggaaaacgggaaaagaagctcggcgagttcggcaaagccaaggggagccgcgccatctggtatatgtggctgggagcgagatttcttgagttcgaggctctgggctttctcaacgaggaccattggttctcccgggggaatagcctgtctggagtggaaggcgaggggcttcaccgcctgggctacattctcagagatgtcagcaaaaaggaaggaggcgccatgtacgccgacgataccgctgggtgggacacgcggatcaccctggaggacctgaaaaacgaagagatggtgacaaatcatatgcgcggagagcacaagaagctcgccgaagctatttttaaactgacctatcaaaacaaggttgtgagagtccagcggcctacaccccgcggcaccgtgatggatatcatctccagacgggaccagagagggtctggacaggttggcacgtacgggcttaatacattcaccaacatggaggcccaactgattcgccagatggaaggcgagggaatcttcaaaagcattaagcatctcacagtgaccgaggaaatcgcggtccagaattggctggcccgggtgggcagagagcgcctttcccggatggctatttctggggatgactgcgttgtgaaaccgctggatgacagatttgccagcgctctcacggccctgaacgatatgggaaaggtccgcaaggacatccaacagtgggaaccttcccggggctggaatgattggacccaggtgcccttctgctctcaccactttcatgagctggtcatgaaagacgggagagtgctcgttgtgccctgtcgcaaccaggatgaactgatcggacgggcgagaattagccaaggcgccgggtggtcccttaaggagacagcttgcctgggcaaaagctatgcccagatgtggaccctcatgtacttccaccgccgggacctgagacttgctgccaacgctatctgttctgccgtcccttcccattgggtgccgacaagccggaccacatggtctattcacgcgaagcacgagtggatgaccacggaagatatgctggccgtgtggaatagagtttggatccaggagaacccctggatggaagacaaaacacctgtggagtcctgggaagaggtcccctatctcggaaagcgcgaggaccagtggtgcggcagcctgattgggctgacctcccgggctacctgggccaagaatatccaaacagccattaaccaggtgagatctctcatcggaaatgaagagtacaccgattatatgcctagcatgaaacgctttagacgggaagaggaagaggctggcgttctgtggtga

SEQ ID NO: 20029 - RNA, 9876 nt, synthetic construct
  misc_feature 1..9876: note = derived and/or modified CDS sequence (opt5) from DENV-2__GQ868540__SS-prME
  source 1..9876: mol_type = other RNA
acagcgggagtgatcattatgctgatccccacagctatggccttccacctcacgacccggaatggggaacctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaagggggaatcgtgacctgcgcgatgtttacatgcaaaaagaatatggaaggcaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctgggccggctcatcacggtgaaccctattgttaccgagaaggatagcccggtgaacatcgaagctgagcccccttttggggactcttacattatcatcggcgtcgagcccggacagctgaaacttaattggttcaagaagggctccagcattgggcagatgtttgaaacaaccatgagaggagccaaacgcatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaagaataaagagctgaagtgcggctccgggattttcatcacagacaacgttcacacctggacagaacagtacaagtttcagcctgagagcccctccaaacttgcctctgctattcaaaaggcccatgaagagggcatctgtggaatcagaagcgtgacgcgcctggagaatctcatgtggaaacagattaccccggaactgaaccacatcctgtccgagaatgaagtcaaacttacaattatgaccggcgatatcaaagggattatgcaggcgggaaagcggtctctcagacctcagcccacagagctgaaatatagctggaagacctggggcaaggccaaaatgctgtccacggaaagccataaccaaaccttcctcgtggacgggcctgagacagctgagtgccccaataccaaccgcgcctggaactctctggaagttgaggattacggatttggcgtgttcacaaccaacatctggcttaagctgcgggaaaaacaggacgtcttttgtgactccaagctcatgagcgctgccatcaaagataatagagcggtgcacgccgacatgggctattggattgagtctgctctgaacgatacatggaagatggagaaggcctccttcatcgaagttaaaagctgccactggcctaagtctcataccctgtggagcaatggggtgcttgagtccgaaatgattatccccaaaaacttcgctggaccggtcagccagcacaactaccgccctggctatcatacgcagacagccgggccctggcacctcggaaagctggagatggactttgatttctgtgaaggcaccaccgtggtggtcacagaggactgcgggaatcggggaccctctctgagaaccacgacagcctccggcaaactcattaccgagtggtgctgtcggagctgcacactgcctccgcttcgctacagaggcgaagatgggtgttggtacggaatggagatccggcccctgaaggaaaaggaggaaaacctcgttaattccctggtgaccgctggccatgggcaaattgacaacttttctctgggagtgcttggcatggccctcttcctggaggagatgctgagaacacgcgtcgggaccaaacacgccatcctcctggtggctgttagctttgtgacgcttatcaccggaaatatgtccttccgggatctgggcagagtcatggtgatggttggcgccacaatgaccgacgatattgggatgggagtgacatatctcgccctgctggctgcctttaaggtccgccctaccttcgcggctggccttctgctcagaaaactgacgtctaaggaactcatgatggccacaatcgggattgccctgcttagccagtccaccatccccgagacaattctggaactcaccgacgctctggccctgggaatgatggtgcttaaaatcgttcggaacatggagaagtaccagctggcggtgaccatcatggctatttcttgcgtccctaatgccgtgatcctcctgaacgcctggaaggtgagctgtacaattctcgctgccgtctccgttagccccctgcttctgacgtcttcccaacagaaagctgattggatccctctcgccctgaccattaagggcctgaatcccacagcgatctttcttaccacactgagccgcacctctaaaaagagatcctggccgctcaacgaagccgtgatggctgtggggatggtcagcatcctggcctcttccctcctgaaaaatgacattcctatgacgggaccccttgtggctggcggcctgctgacagtttgctatgtgctcaccgggcggagcgccgacctggagcttgagcgcgccgctgatgtcaagtgggaagaccaggcggagatctccggaagctctcctattctgagcatcaccatttccgaagatggctctatgagcatcaaaaacgaggaggaagaacagacactcaccattctgatcagaacagggctcctggtgatctccggagttttccccgtgtctattccgatcacggccgctgcctggtacctttgggaagtcaagaagcaacgggccggcgtgctgtgggacgtcccttctccccctcccgtggggaaagctgagctggaagatggagcctatcgcattaagcagagaggcatcctcggctactcccagattggggcgggagtttataaagagggcacctttcacacaatgtggcatgtgaccagaggggctgtcctgatgcaccgcggaaagagaatcgagccctcctgggccgacgtgaaaaaggatcttatcagctacggcgggggatggaagctggaaggcgagtggaaagaaggcgaggaagttcaggtgctcgccctggagcctgggaagaatccgcgggctgtccaaacaaaacccggactcttcaagaccaacacgggcaccattggggccgtgtccctggactttagccctggaacatctggctcccccatcgtggatagaaaagggaaggttgtcggactttacggcaatggcgtggtgacccgcagcggggcgtatgtctctgctattgcccagacagagaagtccatcgaagacaaccctgagattgaagatgacatcttccggaaaaagagactgaccatcatggatctgcatcccggagccggcaaaacaaagcgctacctccctgctattgtgcgggaggccatcaaaagagggctgcgcacgcttattctggctccgacccgggttgtggccgcggaaatggaggaggccctcagaggactgcccatccgctatcagacccctgctattcgggccgaacacaccggcagagagatcgtcgacctcatgtgtcatgctaccttcacaatgcggctgcttagccccgtgcgcgttcctaactacaatctgattatcatggacgaagcccactttacggatcccgcctccatcgctgcgagagggtatatttctacccgggtggagatgggcgaggccgctggaatcttcatgacagccaccccgcctggcagccgcgacccctttccccagtccaacgcccctattatggatgaagagagagaaatccccgagcggagctggaactctgggcacgaatgggtcacagacttcaagggaaagaccgtgtggtttgttccttccattaaagctggcaacgatatcgccgcgtgcctgagaaagaatgggaaaaaggtgatccaactcagccgcaaaacgttcgactctgagtacgtcaagacacgggctaacgattgggactttgtggtgaccaccgatattagcgagatgggagccaatttcagagccgaacgcgtcatcgacccgcggagatgtatgaagcccgttattctgacagatggcgaggaacgcgtgatccttgctgggcctatgcccgtgacccattcctctgccgcgcagcggagaggccgcattggaagaaaccctaaaaatgagaacgaccagtatatctacatgggcgaacccctggagaatgacgaggattgcgcccactggaaggaagctaaaatgctcctggacaacatcaatacaccggaggggattatccctagcatgtttgaacccgagcgggaaaaggtcgatgccattgacggagagtaccgcctgagaggcgaggctcggaaaaccttcgtggatctcatgcgcagaggggaccttcctgtttggctggcctatcgggtggctgccgaaggaatcaactacgcggatagacgctggtgttttgacggcattaagaataaccaaatcctggaggaaaacatggaggtcgagatttggacgaaagaaggggagcggaagaagctcaaacccagatggctggatgcccgcatctattccgaccctcttgctctgaaggagttcaaagagttcgccgctggccggaagtctctcacactgaatctgatcaccgaaatgggaagactccccacatttatgacccagaaagcccgggatgcccttgacaacctggctgtgctgcatacggcggaggccggcgggcgcgcttacaatcacgccctcagcgagctgccggaaacccttgagacactgctcctgctgaccctccttgccacagttaccggaggcattttcctgtttctgatgtccgggaagggaatcggcaagatgacactcggcatgtgctgcattatcaccgctagcattctgctttggtatgcccagatccagcctcactggatcgcggcctctattatcctggagttctttctcattgtgctgctgatccccgagcccgaaaaacaaagaacgcctcaggataaccagctcacatacgtcgtgattgctatccttaccgtcgtggccgctaccatggccaatgagatggggttcctggagaagaccaagaaggacctgggactcggctccatcaccacacaggaaagcgagtccaacattctggacatcgatcttcggccggcgtctgcctggacgctgtatgctgttgccaccacatttgtgacccccatgctccgccatagcattgaaaattcctctgtgaacgtcagcctgacagctatcgccaatcaagctaccgttctgatggggctcggaaaaggctggcctctttccaagatggacattggggtgcccctgctggccatcggatgttacagccaggtgaaccctattacgctcaccgcggccctgcttctgctcgtcgctcactacgccatcatcggccccggcctgcaggctaaggccacaagagaggcccagaaacgggcggctgccgggattatgaagaatcctaccgtggatggaatcacagttattgacctggaaccgatcccctatgatcctaaattcgagaagcaactcggccaggtgatgcttctgattctgtgcgtcacccaggtgctcatgatgcgcacgacatgggctctgtgtgaggcccttaccctggccacagggcccatctctaccctctgggaaggaaaccctggcagattttggaataccacaatcgctgtctccatggccaacattttccgggggagctacctggcgggagccggcctgctcttttctatcatgaaaaatacgaccaacacacgcagaggcaccgggaatattggagagacacttggcgaaaagtggaagtcccggctgaacgctctggggaaaagcgagttccagatctataagaaatctggcattcaagaggtggacagaaccctcgccaaggaaggcatcaaacgcggggagacggatcatcacgctgttagccggggatccgccaagctgagatggtttgtggaacgcaacatggtcacacccgagggcaaagtggttgaccttggctgcgggcggggaggctggtcttactattgtgggggactgaagaatgtgagagaagtcaagggcctcaccaaagggggaccgggccatgaggagcctatccccatgagcacctacggctggaacctggtgcgcctgcagtccggggtggatgttttcttcacaccccctgaaaagtgcgacaccctcctttgtgatattggagagagctcccccaatcctacaatcgaagcgggccggacgctgagagtcctgaacctcgtggagaattggctgaacaataacacccagttttgcattaaagtgcttaatccgtatatgccctctgtcatcgaaaagatggagacactgcaacgcaaatacgggggagccctcgttcggaaccctctgagcagaaattccacccacgagatgtactgggtgtctaacgctacaggcaatattgtgagctccgtcaacatgatctctcgcatgctgatcaatcggttcaccatgaagcacaagaaagccacgtatgaacccgacgtggatctcgggagcggaaccagaaacattggcatcgagtccgaaattcctaaccttgacatcattggcaagcgcatcgagaaaattaagcaggaacatgagacaagctggcactacgaccaggatcatccctataaaacctgggcttaccacgggtcttatgagacaaagcagaccggatccgccagctctatggttaatggcgtggtcagactgctgacaaagccgtgggacgtggttcctatggtgacccaaatggctatgacggatacaaccccctttgggcagcagcgggtcttcaaagaaaaggtggacacccgcacacaggagcctaaagaaggaacgaagaaactcatgagaatcaccgccgagtggctgtggaaggagcttggcaagaaaaagacaccccggatgtgtaccagagaagagtttacacggaaagtgcgctccaacgcggccctgggggctatcttcaccgatgaaaataagtggaaaagcgccagagaggctgtcgaagactctcggttttgggagctcgttgatcgcgagagaaacctgcacctggaaggaaagtgcgagacatgtgtgtacaatatgatgggcaaacgggaaaagaagctcggcgagttcgggaaagccaagggatcccgcgccatttggtatatgtggctgggcgcgagatttcttgagttcgaggctctggggtttctcaacgaggaccattggttcagccggggaaattccctgagcggcgtggaaggggagggccttcaccgcctgggatacatcctcagagatgtctctaaaaaggaaggcggggccatgtacgccgacgataccgctggatgggacacgcggattaccctggaggacctgaaaaacgaagagatggtgacaaatcatatgaagggcgagcacaagaaactcgccgaagctatctttaagctgacctatcaaaacaaagttgtgcgcgtccagagacctacaccccgggggaccgtgatggatattatcagccgcagagaccagcggggatccggccaggttgggacgtacggccttaatacattcaccaacatggaggcccaactgatcagacagatggaaggagagggcattttcaagtctatccagcatctcacagtgaccgaggaaattgcggtccaaaattggctggcccgcgtggggcgggagagacttagccgcatggctatctccggagatgactgcgttgtgaaaccgctggatgaccggtttgcctctgctctcacggccctgaacgatatgggcaaggtcagaaaggacattcagcagtgggaacctagccgcgggtggaatgattggacccaggtgcccttctgctcccaccactttcatgagctggtcatgaaagacggacgggtgctcgttgtgccctgtagaaaccaagatgaactgatcggccgcgcgcggatctctcagggggccggctggagccttaaggagacagcttgcctgggaaaatcctatgcccagatgtggaccctcatgtacttccacagacgcgacctgcggcttgctgccaacgctatttgtagcgccgtcccttctcattgggtgccgacatccagaaccacatggagcatccacgcgaagcacgagtggatgaccacggaagatatgctggccgtgtggaatcgggtttggattcaggagaacccctggatggaagacaaaacacctgtggagtcttgggaagagatcccctatctcggcaagagagaggaccaatggtgcgggtccctgattggactgaccagccgcgctacctgggccaagaatatccagacagccattaaccaggtccggtccctcatcggcaatgaagagtacaccgattatatgccttctatgaaaagatttcgcagagaagaggaagaggctggggtgctgtggtga

SEQ ID NO: 20030 - RNA, 9876 nt, synthetic construct
  misc_feature 1..9876: note = derived and/or modified CDS sequence (opt5) from DENV-2__GQ868541__SS-prME
  source 1..9876: mol_type = other RNA
acagcgggcgtgatcattatgctgatccccacagctatggccttccacctcacgacccggaatggggaacctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaagggggaatcgtgacctgcgcgatgtttacatgcaaaaagaatatggaaggcaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctgggccggctcatcacggtgaaccctattgttaccgagaaggatagcccggtgaacatcgaagctgagcccccttttggggactcttacattatcatcggcgtcgagcccggacagctgaaacttaattggttcaagaagggctccagcattgggcagatgtttgaaacaaccatgagaggagccaaacgcatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaagaataaagagctgaagtgcggctccgggattttcatcacagacaacgttcacacctggacagaacagtacaagtttcagcctgagagcccctccaaacttgcctctgctattcaaaaggcccatgaagagggcatctgtggaatcagaagcgtgacgcgcctggagaatctcatgtggaaacagattaccccggaactgaaccacatcctgtccgagaatgaagtcaaacttacaattatgaccggcgatatcaaagggattatgcaggcgggaaagcggtctctcagacctcagcccacagagctgaaatatagctggaagacctggggcaaggccaaaatgctgtccacggaaagccataaccaaaccttcctcatcgacgggcctgagacagctgagtgccccaataccaaccgcgcctggaactctctggaagtggaggattacggatttggcgttttcacaaccaacatctggcttaagctgcgggaaaaacaggacgtgttttgtgactccaagctcatgagcgctgccattaaagataatagagcggtccacgccgacatgggctattggatcgagtctgctctgaacgatacatggaagatggagaaggcctccttcattgaagtgaaaagctgccactggcctaagtctcataccctgtggagcaatggggttcttgagtccgaaatgatcattcccaaaaacttcgctggaccggtgagccagcacaactaccgccctggctatcatacgcagacagccgggccctggcacctcggaaagctggagatggactttgatttctgtgaaggcaccaccgtcgtggtgacagaggactgcgggaatcggggaccctctctgagaaccacgacagcctccggcaaactcatcaccgagtggtgctgtcggagctgcacactgcctccgcttcgctacagaggcgaagatgggtgttggtacggaatggagattcggcccctgaaggaaaaggaggaaaacctcgtcaattccctggttaccgctggccatgggcaaatcgacaacttttctctgggagtgcttggcatggccctcttcctggaggagatgctgagaacacgcgtggggaccaaacacgccatcctcctggtcgctgtgagctttgttacgcttattaccggaaatatgtccttccgggatctgggcagagtgatggtcatggtgggcgccacaatgaccgacgatatcgggatgggagttacatatctcgccctgctggctgcctttaaggtgcgccctaccttcgcggctggccttctgctcagaaaactgacgtctaaggaactcatgatggccacaattgggatcgccctgcttagccagtccaccattcccgagacaatcctggaactcaccgacgctctggccctgggaatgatggtccttaaaatcgtgcggaacatggagaagtaccagctggcggttaccattatggctatctcttgcgtgcctaatgccgtcattctcctgaacgcctggaaggtgagctgtacaatcctcgctgccgtgtccgtcagccccctgcttctgacgtcttcccaacagaaagctgattggattcctctcgccctgaccatcaagggcctgaatcccacagcgatctttcttaccacactgagccgcacctctaaaaagagatcctggccgctcaacgaagccgttatggctgtggggatggtgagcattctggcctcttccctcctgaaaaatgacatccctatgacgggaccccttgtcgctggcggcctgctgacagtgtgctatgttctcaccgggcggagcgccgacctggagcttgagcgcgccgctgatgtgaagtgggaagaccacgcggagatttccggaagctctcctatcctgagcattaccatctccgaagatggctctatgagcattaaaaacgaggaggaagaacagacactcaccatcctgatcagaacagggctcctggtcatttccggagtgttccccgtttctatcccgattacggccgctgcctggtacctttgggaagtgaagaagcagcgggccggcgtcctgtgggacgtgccttctccccctcccgtcgggaaagctgagctggaagatggagcctatcgcatcaagcaaagaggcattctcggctactcccagatcggggcgggagtgtataaagagggcacctttcatacaatgtggcacgttaccagaggggctgtgctgatgcatcgcggaaagagaatcgagccctcctgggccgacgtcaaaaaggatcttattagctacggcgggggatggaagctggaaggcgagtggaaagaaggcgaggaagtgcaggttctcgccctggagcctgggaagaatccgcgggctgtgcagacaaaacccggactcttcaagaccaacacgggcaccatcggggccgtctccctggactttagccctggaacatctggctcccccattgtggatagaaaagggaaggtggttggactttacggcaatggcgtcgtgacccgcagcggggcgtatgtgtctgctatcgcccaaacagagaagtccattgaagacaaccctgagatcgaagatgacatcttccggaaaaagagactgaccattatggatctgcaccccggagccggcaaaacaaagcgctacctccctgctatcgtccgggaggccattaaaagagggctgcgcacgcttatcctggctccgacccgggtggttgccgcggaaatggaggaggccctcagaggactgcccattcgctatcagacccctgctatccgggccgaacataccggcagagagattgtggacctcatgtgtcacgctaccttcacaatgcggctgcttagccccgtccgcgtgcctaactacaatctgatcatcatggacgaagcccactttacggatcccgcctccattgctgcgagagggtatatctctacccgggttgagatgggcgaggccgctggaattttcatgacagccaccccgcctggcagccgcgacccctttccccagtccaacgcccctatcatggatgaagagagagaaattcccgagcggagctggaactctgggcatgaatgggtgacagacttcaagggaaagaccgtctggtttgtgccttccatcaaagctggcaacgatatcgccgcgtgcctgagaaagaatgggaaaaaggttattcagctcagccgcaaaacgttcgactctgagtacgtgaagacacgggctaacgattgggactttgtcgtgaccaccgatatcagcgagatgggagccaatttcagagccgaacgcgtgattgacccgcggagatgtatgaagcccgtcatcctgacagatggcgaggaacgcgttattcttgctgggcctatgcccgtgacccactcctctgccgcgcaacggagaggccgcatcggaagaaaccctaaaaatgagaacgaccagtatatctacatgggcgaacccctggagaatgacgaggattgcgcccattggaaggaagctaaaatgctcctggacaacattaatacaccggaggggatcattcctagcatgtttgaacccgagcgggaaaaggtggatgccatcgacggagagtaccgcctgagaggcgaggctcggaaaaccttcgtcgatctcatgcgcagaggggaccttcctgtgtggctggcctatcgggttgctgccgaaggaattaactacgcggatagacgctggtgttttgacggcatcaagaataaccagattctggaggaaaacgtggaggtcgagatctggacgaaagaaggggagcggaagaagctcaaacccagatggctggatgcccgcatctattccgaccctcttgctctgaaggagttcaaagagttcgccgctggccggaagtctctcacactgaatctgattaccgaaatgggaagactccccacatttatgacccaaaaagcccgggatgcccttgacaacctggctgtgctgcacacggcggaggccggcgggcgcgcttacaatcacgccctcagcgagctgccggaaacccttgagacactgctcctgctgaccctccttgccacagttaccggaggcatcttcctgtttctgatgtccgggaagggaattggcaagatgacactcggcatgtgctgcatcattaccgctagcatcctgctttggtatgcccagatccagcctcattggattgcggcctctatcattctggagttctttctcatcgtgctgctgattcccgagcccgaaaaacagagaacgcctcaagataaccagctcacatacgtcgtgatcgctatccttaccgtcgtggccgctaccatggccaatgagatggggttcctggagaagaccaagaaggacctgggactcggctccattaccacacaggaaagcgagtccaacatcctggacattgatcttcggccggcgtctgcctggacgctgtatgctgttgccaccacatttgtgacccccatgctccgccacagcatcgaaaattcctctgtgaacgtcagcctgacagctattgccaatcaggctaccgttctgatggggctcggaaaaggctggcctctttccaagatggacatcggggtgcccctgctggccattggatgttacagccaagtgaaccctatcacgctcaccgcggccctgcttctgctcgtcgctcattacgccatcattggccccggcctgcaggctaaggccacaagagaggcccagaaacgggcggctgccgggatcatgaagaatcctaccgtggatggaattacagttatcgacctggaaccgattccctatgatcctaaattcgagaagcagctcggccaagtgatgcttctgatcctgtgcgtcacccaggtgctcatgatgcgcacgacatgggctctgtgtgaggcccttaccctggccacagggcccatctctaccctctgggaaggaaaccctggcagattttggaataccacaattgctgtctccatggccaacatcttccgggggagctacctggcgggagccggcctgctcttttctattatgaaaaatacgaccaacacacgcagaggcaccgggaatatcggagagacacttggcgaaaagtggaagtcccggctgaacgctctggggaaaagcgagttccagatttataagaaatctggaatccaggaggtggacagaaccctcgccaaggaaggcatcaaacgcggggagacggatcaccatgctgttagccggggatccgccaagctgagatggtttgtggaacgcaacatggtcacacccgagggcaaagtggttgaccttggctgcgggcggggaggctggtcttactattgtgggggactgaagaatgtgagagaagtcaagggcctcaccaaagggggaccgggccacgaggagcctattcccatgagcacctacggctggaacctggtgcgcctgcaatccggggtggatgttttcttcacaccccctgaaaagtgcgacaccctcctttgtgatatcggagagagctcccccaatcctacaattgaagcgggccggacgctgagagtcctgaacctcgtggagaattggctgaacaataacacccagttttgcatcaaagtgcttaatccgtatatgccctctgtcattgaaaagatggagacactgcagcgcaaatacgggggagccctcgttcggaaccctctgagcagaaattccacccacgagatgtactgggtgtctaacgctacaggcaatatcgtgagctccgtcaacatgatctctcgcatgctgattaatcggttcaccatgaagcataagaaagccacgtatgaacccgacgtggatctcgggagcggaaccagaaacatcggcattgagtccgaaatccctaaccttgacattatcggcaagcgcattgagaaaatcaagcaagaacacgagacaagctggcatcacgaccaggatcacccctacaaaacctgggcttatcatgggtcttacgagacaaagcagaccggatccgccagctctatggttaatggcgtggtcagactgctgacaaagccgtgggacgtggttcctatggtgacccagatggctatgacggatacaaccccctttgggcaacagcgggtcttcaaagaaaaggtggacacccgcacacaggagcctaaagaaggaacgaagaaactcatgagaatcaccgccgagtggctgtggaaggagcttggcaagaaaaagacaccccggatgtgtaccagagaagagtttacacggaaagtgcgctccaacgcggccctgggggctattttcaccgatgaaaataagtggaaaagcgccagagaggctgtcgaagactctcggttttgggagctcgttgatcgcgagagaaacctgcacctggaaggaaagtgcgagacatgtgtgtataatatgatgggcaaacgggaaaagaagctcggcgagttcgggaaagccaagggatcccgcgccatctggtacatgtggctgggcgcgagatttcttgagttcgaggctctggggtttctcaacgaggaccattggttcagccggggaaattccctgagcggcgtggaaggggagggccttcaccgcctgggatatattctcagagatgtctctaaaaaggaaggcggggccatgtacgccgacgataccgctggatgggacacgcggatcaccctggaggacctgaaaaacgaagagatggtgacaaatcatatgaagggcgagcacaagaaactcgccgaagctatttttaagctgacctaccagaacaaagttgtgcgcgtccaaagacctacaccccgggggaccgtgatggatatcatcagccgcagagaccagcggggatccggccaggttgggacgtatggccttaatacattcaccaacatggaggcccagctgattagacaaatggaaggagagggcatcttcaagtctattcagcacctcacagtgaccgaggaaatcgcggtccagaattggctggcccgcgtggggcgggagagacttagccgcatggctatttccggagatgactgcgttgtgaaaccgctggatgaccggtttgcctctgctctcacggccctgaacgatatgggcaaggtcagaaaggacatccaacagtgggaacctagccgcgggtggaatgattggacccaggtgcccttctgctcccatcactttcatgagctggtcatgaaagacggacgggtgctcgttgtgccctgtagaaaccaggatgaactgatcggccgcgcgcggatttctcaaggggccggctggagccttaaggagacagcttgcctgggaaaatcctacgcccagatgtggaccctcatgtatttccacagacgcgacctgcggcttgctgccaacgctatctgtagcgccgtcccttctcactgggtgccgacatccagaaccacatggagcattcatgcgaagcacgagtggatgaccacggaagatatgctggccgtgtggaatcgggtttggatccaggagaacccctggatggaagacaaaacacctgtggagtcttgggaagaggtcccctacctcggcaagagagaggaccagtggtgcgggtccctgattggactgaccagccgcgctacctgggccaagaatatccaaacagccattaaccaggtgcggtccctcatcggcaatgaagagtataccgattacatgccttctatgaaaagatttcgcagagaagaggaagaggctggggttctgtggtga

SEQ ID NO: 20031 - RNA, 9876 nt, synthetic construct
  misc_feature 1..9876: note = derived and/or modified CDS sequence (opt5) from DENV-2__GQ868603__SS-prME
  source 1..9876: mol_type = other RNA
accgccggagtgatcattatgctgatccccacagctatggccttccaccttacgaccagaaatggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttctgtgcaagcattccatggtggatagaggctggggcaacgggtgtggactcttcggcaaaggcgggattgtgacatgcgccatgtttacgtgcaaaaagaatatggaagggaaagtcgttctgcctgagaaccttgaatacaccatcgtgattacaccccacagcggggaggagcatgcggtgggaaatgacaccggcaagcacggcaaagaaatcaagatcacacctcagtcttccattaccgaggccgaactgacggggtatggaaccgtcacaatggagtgtagcccccggaccggcctcgatttcaacgaaatggtgctgcttcagatggaggacaaggcttggctggttcaccgccaatggtttctcgatctgccgctgccttggctccccggggccgacacacagggatctaattggatccagaaggagaccctggtgacgttcaagaaccctcatgctaaaaagcaggacgtcgtggttcttggctcccaagaaggggccatgcacacagccctgaccggcgctacagagattcagatgagctccggaaatctcctgtttaccggccatcttaaatgcagactgcggatggataagctccagctgaaagggatgtcttacagcatgtgtaccggaaagttcaagatcgtgaaagaaattgcggagacacaacacggcacgatcgtcatcagagtgcagtatgagggggacggatccccctgcaagattcccttcgaaatcatggatctggagaaacgccatgtcctcggccggctgattaccgtgaaccctatcgttacagaaaaggacagcccggtgaacattgaggccgaacccccttttggggattcttacatcattatcggcgtcgagcccggacagcttaaactgaattggttcaagaagggctccagcatcgggcagatgtttgagaccacaatgagaggagctaaacgcatggccattctcggcgacaccgcctgggatttcgggtctctgggaggcgtgtttacgagcatcgggaaggctctgcaccaagttttcggcgccatttacggagcggctttttccggcgtgtcttggacaatgaaaatccttattggggtcatcatcacctggattggaatgaacagccggtccaccagcctctctgtgtccctggtgctggttggcgtcgtgacactctatctgggggccatggtgcaggccgacagcggatgtgtcgtgtcttggaagaataaagaacttaagtgcggctccgggatcttcattaccgataacgttcacacatggacggagcagtacaagtttcagcctgaaagcccctccaaactggcttctgccatccaaaaggctcatgaggaaggcatttgtggaatcagaagcgtgacccgcctcgagaatctgatgtggaaacagatcacaccggagctgaaccacattctttccgaaaatgaggtcaagctcaccatcatgacaggcgacattaaagggatcatgcaggccggaaagcggtctctgagacctcagcccaccgaactgaaatatagctggaagacgtggggcaaggcgaaaatgctctccaccgagagccataaccaaacattcctgattgatgggcctgaaaccgccgagtgccccaatacaaaccgcgcttggaactctcttgaggtggaagactacggatttggcgttttcaccacaaacatctggctgaagctccgggagaaacaggacgtgctgtgtgattccaagctgatgagcgccgctatcaaagacaatagagccgtccacgcggatatgggctattggattgaatctgcccttaacgacacctggaagatggagaaggcttcctttatcgaggtgaaaagctgccactggcctaagtctcatacgctctggagcaatggggttctggaatccgagatgattatccccaaaaacttcgccggaccggtgagccagcacaactaccgccctggctatcatacacagaccgctgggccctggcacctgggaaagctcgaaatggatttcgacttttgtgagggcaccacagtcgtggtgaccgaagattgcgggaatcggggaccctctctgagaacgacaaccgcctccggcaaacttattacagagtggtgctgtcggagctgcaccctgcctccgctccgctacagaggcgaggacgggtgttggtacggaatggaaatccggcccctgaaggagaaggaagagaacctggtcaattcccttgttacagccggccatgggcaaattgataacttctctctcggagtgctgggcatggctctgtttctcgaagagatgctgagaacccgcgtggggacgaaacacgcgatccttctggccgctgtcagcttcgtgaccctcatcacaggaaatatgtcctttcgggacctgggcagagttatggtgatggtcggcgccaccatgacagatgacattgggatgggagtgacctatctggcccttctggctgccttcaaggttcgccctacgtttgcggctggcctcctgctcagaaaactgacatctaaggagcttatgatggccaccatcgggattgccctgctcagccagtccacaatccccgaaaccattctggagctgaccgatgctcttgccctgggaatgatggtgctcaaaatcgtccggaacatggaaaagtaccagctggtggttacaatcatggcgatttcttgcgtgcctaatgctgtcatcctccaaaacgcctggaaggtgagctgtacgattctggccgctgtgtccgtcagcccccttctgctcacctcttcccgccagaaagccgactggatccctctggctctgacaattaagggccttaatcccaccgccatcttcctgacaaccctcagcagaacgtctaaaaagcggtcctggccgctgaacgaggcgatcatggccgttgggatggtgagcattctcgcttcttccctgcttaaaaatgacatccctatgacaggacccctggtggccggcggcctgctcaccgtctgctatgtgctgaccgggcgcagcgctgatcttgaactggagagagccgccgacgttaagtgggaggatcaggctgaaatttccggaagctctcctatcctcagcattacaatctccgaggacggctctatgagcattaaaaacgaagaggaggaacagaccctgacaatcctcatccggacggggctgcttgtgatttccggagtctttcccgtgtctatcccgattaccgcggccgcttggtacctgtgggaggttaagaagcaacgcgccggcgtgctgtgggatgtcccttctccccctcccgtggggaaagccgaactcgaggacggagcttatagaatcaagcagcggggcattctgggctactcccagatcggggccggagtctataaagaaggcacattccacaccatgtggcatgtgacacgcggggcggttcttatgcacagaggaaagcggatcgagccctcctgggctgatgtgaaaaaggacctgattagctacggcgggggatggaagctcgagggcgaatggaaagagggcgaagaggtccaggtgctggccctcgaacctgggaagaatccgagagccgttcaaaccaaacccggactgtttaagacgaacaccggcacaatcggggctgtgtcccttgatttcagccctggaacctctggctcccccattgtcgaccgcaaagggaaggtggtgggactgtacggcaatggcgttgtcacacggagcggggcctatgtgtctgcgatcgctcagaccgagaagtccattgaggataaccctgaaatcgaggacgatatctttcgcaagaagcgcctgacaattatggacctccatcccggagccggcaaaacgaagcggtacctgcctgccatcgtgagagaagctattaaacgcgggcttcggaccctgatcctcgccccgacaagagtcgtggctgccgagatggaagaggcgctgcgcggactccccattcggtatcagacccctgccatcagagctgagcacaccggccgggaaattgttgacctgatgtgtcatgccacattcacgatgcgccttctgagccccgtgagagtccctaactacaatctgatcatcatggatgaggctcacttcaccgaccccgcctccattgccgctcgggggtatatctctacacgcgtggaaatgggcgaggcggccggaatttttatgaccgctacaccgcctggcagcagagatcccttcccccagtccaacgcccctatcatggacgaggaacgggagattcccgaaagaagctggaactctgggcacgagtgggttaccgattttaagggaaagacggtgtggttcgtcccttccatcaaagccggcaacgacatcgctgcctgcctccgcaagaatgggaaaaaggtgattcaactgagccggaaaacatttgattctgaatacgttaagaccagagcgaacgactgggatttcgtggtcaccacagacatcagcgagatgggagctaattttaaggccgagcgcgtgattgatccgcggagatgtatgaaacccgtgatccttaccgacggcgaagaaagagtcattctggccgggcctatgcccgttacacattcctctgctgcccagcggagaggccgcatcggaagaaaccctaagaatgaaaacgaccagtatatctacatgggcgagcccctcgaaaatgatgaggactgcgcgcactggaaagaggccaagatgctgctggataacattaataccccggaagggatcattcctagcatgttcgagcccgaacgggagaaagtggacgctatcgatggagaataccgcctcagaggcgaggcccggaagacgtttgtggaccttatgcgcagaggggatctgcctgtctggctggcttatcgggtggccgctgagggaattaactacgccgacagacgctggtgtttcgatggcatcaaaaataaccaaattctcgaagagaacgttgaagtggagatctggacaaaggagggggaacggaagaaactgaagcccagatggcttgacgcgcgcatctattccgatcctctggccctcaaagagtttaaggagttcgctgccggccggaaatctctgaccctgaatctcattacagagatgggaagacttcccaccttcatgacgcagaaggctcgggacgccctggataacctggccgtcctccataccgctgaagcgggcgggcgcgcctacaatcacgctctgagcgagcttccggagacactggaaaccctcctgctgctcacacttctggccaccgtgacaggaggcatctttctgttcctcatgtccgggaagggagttggcaaaatgaccctgggcatgtgctgcattatcacggccagcattcttctgtggtatgctcagatccagcctcactggatcgccgcgtctattatcctcgagtttttcctgattgtgctgctcatccccgaacccgagaagcaaagaacacctcaggacaaccagcttacctacgtcgtgattgccatcctgaccgtcgtggctgccacaatggctaatgaaatggggtttctggagaaaaccaagaaagacctcggactgggctccatcacaacgcaggagagcgaatccaacattcttgatatcgacctgcggccggcctctgcgtggaccctctatgccgttgctacaaccttctttacacccatgctgcgccatagcattgaaaatagctctgtgaacgtgagcctgaccgccatcgctaatcaagccacggtcctcatggggcttggaaagggctggcctctgtccaagatggatattggggttcccctgctcgctatcggatgttacagccaggtgaaccctattaccctgacagccgcgcttctgctcctggtggcccactacgctatcatcggccccggcctgcaggccaaagctaccagagaagcccagaagcgggccgcggctgggattatgaaaaatcctacagtcgacggaatcaccgtgattgatctcgagccgatcccctatgaccctaagttcgaaaaacaacttggccaggttatgctgctgattctctgcgtgacgcaggtcctgatgatgcgcacaacctgggccctttgtgaggctctgacactcgccaccgggcccatctctaccctgtgggagggaaaccctggcagattttggaatacaacgatcgccgtgtccatggctaacattttccgggggagctacctggccggagcgggcctcctcttttctatcatgaagaataccacaaacacccgcagaggcacagggaatattggagaaaccctgggcgagaagtggaaatcccggctgaacgccctcggaaagagcgagttccagatctataaaaagtctggcattcaagaggtcgatagaacgctggctaaagagggcatcaagcgcggggaaacagaccatcacgccgtgagccggggatccgctaaacttagatggtttgttgagcgcaacatggtgacccccgaaggcaaggtcgtggatctgggctgcgggcggggaggctggtcttactattgtgggggactcaagaatgttagagaggtgaaaggcctgaccaaagggggaccgggccatgaggaacctatccccatgagcacatacggctggaacctggtccgcctccagtccggggtggacgtgttcttcacaccccctgagaaatgcgatacacttctgtgtgacattggagaaagctcccccaatcctacgatcgaggccggccggaccctgagagttctcaacctggtcgaaaattggcttaacaataacacacagttttgcattaaggtgctgaatccgtatatgccctctgtgatcgagaaaatggaaaccctccaacgcaagtacgggggagcgctggtccggaaccctctgagcagaaattccacacacgagatgtactgggtttctaacgccaccggcaatattgtgagctccgtgaacatgatctctcgcatgctcatcaatcggttcacgatgaagcacaaaaaggctacctatgagcccgatgtcgaccttgggagcggaacaagaaacattggcatcgaatccgagattcctaacctggacatcattggcaaacgcatcgaaaagattaaacaggagcatgaaaccagctggcactacgatcaggaccatccctataagacatgggcctaccacgggtcttatgagaccaagcagacaggatccgctagctctatggtgaatggcgttgtgagactgctcaccaaaccgtgggatgtcgtgcctatggttacgcaaatggccatgacagacaccaccccctttgggcagcagcgggtgttcaaggagaaagtcgatacacgcacgcaggaacctaaggagggaaccaaaaagctgatgaagatcacagctgaatggctttggaaagagctgggcaagaaaaagatccccagaatgtgtacccgggaggaatttacaagaaaagtgcggtccaacgccgcgctcggggccattttcaccgacgagaataagtggaaaagcgctcgcgaagccgtggaggattctagattttgggaactggtcgaccgggagcgcaacctgcacctcgagggaaagtgcgaaacatgtgtttacaatatgatgggcaagagagagaaaaagctgggcgagttcgggaaagctaagggatcccgggccatctggtatatgtggcttggcgcccgctttctggagttcgaagcgctcgggtttctgaacgaggatcattggttcagcagaggaaattcccttagcggcgtggagggggaaggcctgcaccggctcggatacattctgcgcgacgtgtctaaaaaggagggcggggctatgtacgccgatgacaccgccggatgggacacgagaatcaccctggaagatctcaagaacgaggaaatggtcacaaatcatatgaaaggcgagcacaagaaactggctgaggccatttttaaacttacctatcaaaacaaagtggttcgggtgcagcgccctacacccagagggaccgtcatggacatcatcagccggcgcgatcagagaggatccggccaggtggggacgtacggcctgaatacattcaccaacatggaagctcaactcattcggcagatggagggagaaggcatcttcaagtctattcagcatctgacagttaccgaggagatcgccgtgcaaaattggcttgcgagagtcgggcgcgaacggctgagcagaatggccatttccggagacgattgcgtggttaagccgctcgacgatcgctttgcttctgccctgacggctctgaacgacatgggcaaagtgcggaaggatatccagcagtgggagcctagcagagggtggaatgactggacccaggtccccttctgctcccaccactttcatgaactcgtgatgaaagatggacgcgtcctggtggttccctgtcggaaccaagacgagcttatcggcagagcccgcatttctcagggggcgggctggagcctgaaggaaacagcctgcctcggaaaatcctatgctcagatgtggaccctgatgtacttccaccggagagatcttcgcctggccgctaacgccatctgtagcgctgtgccttctcattgggtcccgacatcccggaccacatggagcattcacgccaagcacgagtggatgaccacggaggacatgctcgcggtgtggaatagagtgtggatccaggaaaacccctggatggaggacaagacacctgttgaatcttgggaggaagtgccctatctgggcaaacgggaggatcaatggtgcgggtccctgattggactcaccagcagagccacctgggctaagaatatccagacagccattaaccaggtccgctccctgatcggcaatgaggaatacaccgactatatgccttctatgaaacggtttagacgcgaggaagaggaagccggggtgctttggtga

SEQ ID NO: 20032 - RNA, 9876 nt, synthetic construct
  misc_feature 1..9876: note = derived and/or modified CDS sequence (opt5) from DENV-2__FJ898450__SS-prME
  source 1..9876: mol_type = other RNA
accgcgggcgtgatcattatgctgatccccaccgctatggccttccacctcacgacccggaatggggaacctcatatgattgtcggacggcaggaaaagggcaagagcctgctttttaagaccgaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttctccctgagaacctggaatacaccattgtgatcacaccccacagcggggaggagcatgcggtgggaaatgacaccggcaagcacggcaaagaaatcaagattacacctcagtcttccatcaccgaggccgaacttacggggtatggaaccgtcacaatggagtgtagcccccggaccggcctggatttcaacgaaatggtgctcctgcagatggaggacaaggcttggcttgttcaccgccaatggtttctggatctcccgctgccttggctgcccggggccgacacacagggatctaattggattcagaaggagaccctcgtgacgttcaagaaccctcatgctaaaaagcaggacgtcgtggttctgggctcccaagaaggggccatgcacacagcccttaccggcgctacagagatccagatgagctccggaaatctgctctttaccggccatctgaaatgcagacttcggatggataagctgcagctcaaagggatgtcttacagcatgtgtaccggaaagttcaagattgtgaaagaaatcgcggagacacaacacggcacgatcgtcattagagtgcagtatgagggggacggatccccctgcaagatccccttcgaaattatggatctggagaaacgccatgtcctgggccggctcatcaccgtgaaccctattgttacagaaaaggacagcccggtgaacatcgaggccgaacccccttttggggattcttacattatcatcggcgtcgagcccggacagctgaaacttaattggttcaagaagggctccagcattgggcagatgtttgagaccacaatgagaggagctaaacgcatggccatcctgggcgacaccgcctgggatttcgggtctctcggaggcgtgtttacgagcattgggaaggctctgcaccaagttttcggcgccatctacggagcggctttttccggcgtgtcttggacaatgaaaattctgatcggggtcatcattacctggatcggaatgaacagccggtccaccagcctttctgtgtccctcgtgctggttggcgtcgtgacactgtatctcggggccatggtgcaggccgacagcggatgtgtcgtgtcttggaagaataaagaactgaagtgcggctccgggattttcatcaccgataacgttcacacatggacggagcagtacaagtttcagcctgaaagcccctccaaacttgcttctgccattcaaaaggctcatgaggaaggcatctgtggaatcagaagcgtgacccgcctggagaatctcatgtggaaacagattacaccggagctgaaccacatcctgtccgaaaatgaggtcaaacttaccattatgacaggcgacatcaaagggattatgcaggccggaaagcggtctctcagacctcagcccaccgaactgaaatatagctggaagacgtggggcaaggcgaaaatgctgtccaccgagagccataaccaaacattcctcatcgatgggcctgaaaccgccgagtgccccaatacaaaccgcgcttggaactctctggaggtggaagactacggatttggcgttttcaccacaaacatctggcttaagctgcgggagaaacaggacgccttttgtgattccaagctcatgagcgctgccattaaagacaatagagcggtgcacgccgatatgggctattggatcgaatctgctctgaacgacacctggaagatggagaaggcctccttcattgaggtcaaaagctgccactggcctaagtctcatacgctgtggagcaatggggtgcttgaatccgagatgatcattcccaaaaacttcgctggaccggttagccagcacaactaccgccctggctatcatacacagaccgccgggccctggcacctcggaaagctggaaatggattttgacttctgtgagggcaccacagtggtcgtgaccgaagattgcgggaatcggggaccctctctgagaacgacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgtgaatagcctggtcacagctggccatgggcaaatcgataacttttctctgggagttcttggcatggccctcttcctggaagagatgctgagaacccgcgtggggacgaaacacgccatcctcctggtggctgtcagctttgtgacccttattacaggaaatatgtccttccgggacctgggcagagttatggtgatggtcggcgccaccatgacagatgacatcgggatgggagtgacctatctcgccctgctggctgcctttaaggttcgccctacgttcgcggctggccttctgctcagaaaactgacatctaaggagctcatgatggccaccattgggatcgccctgcttagccagtccacaattcccgaaaccatcctggagctcaccgatgctctggccctgggaatgatggtgcttaaaatcgtccggaacatggaaaagtaccagctggcggtgacaattatggctatctcttgcgttcctaatgccgtgattctccaaaacgcctggaaggtcagctgtacgatcctggctgccgtgtccgtgagccccctcctgcttacctcttcccagcagaaagctgactggattcctctggccctcacaatcaagggcctgaatcccaccgcgatctttctgacaacccttagccgcacgtctaaaaagagatcctggccgctgaacgaggccgtcatggctgttgggatggtgagcattctcgcctcttccctgctcaaaaatgacatccctatgacaggacccctggtggctggcggccttctgaccgtctgctatgtgctgaccgggcggagcgccgatctcgaactggagcgcgccgctgacgttaagtgggaggatcaggcggaaatttccggaagctctcctatccttagcattacaatctccgaggacggctctatgagcattaaaaacgaagaggaggaacaaaccctgacaatcctcatcagaacggggctgctcgtgatttccggagtcttccccgtgtctatcccgattaccgccgctgcctggtacctgtgggaggttaagaagcagcgggccggcgtgctttgggatgtcccttctccccctcccgtggggaaagctgaactggaggacggagcctatcgcatcaagcagagaggcattctgggctactcccagatcggggcgggagtctataaagaaggcacatttcacaccatgtggcatgtgacaagaggggctgttctcatgcaccgcggaaagagaatcgagccctcctgggccgatgtgaaaaaggacctgattagctacggcgggggatggaaacttgagggcgaatggaaagagggcgaagaggtccaagtgctggccctcgaacctgggaagaatccgcgggctgttcagaccaaacccggactgttcaagacgaacaccggcacaatcggggccgtgtccctcgattttagccctggaacctctggctcccccattgtcgacagaaaagggaaggtggtgggactgtacggcaatggcgttgtcacacgcagcggggcgtatgtgtctgctatcgcccagaccgagaagtccattgaggataaccctgaaatcgaggacgatatcttccggaaaaagagacttacaattatggacctgcatcccggagccggcaaaacgaagcgctacctgcctgctatcgtgcgggaagccattaaaagagggctccgcaccctgatccttgctccgacacgggtcgtggccgcggagatggaagaggccctgagaggactccccattcgctatcagacccctgctatccgggccgagcacaccggcagagaaattgttgacctgatgtgtcatgctacattcacgatgcggctcctgagccccgtgcgcgtccctaactacaatcttatcatcatggatgaggcccactttaccgaccccgcctccattgctgcgagagggtatatctctacacgggtggaaatgggcgaggccgctggaattttcatgaccgccacaccgcctggcagccgcgatccctttccccaatccaacgcccctatcatggacgaggaaagagagattcccgaacggagctggaactctgggcacgagtgggttaccgatttcaagggaaagacggtgtggtttgtcccttccatcaaagctggcaacgacatcgccgcgtgcctgagaaagaatgggaaaaaggtgattcagctgagccgcaaaacattcgattctgaatacgttaagacccgggctaacgactgggattttgtggtcaccacagacatcagcgagatgggagccaatttcagagccgagcgcgtgattgatccgcggagatgtatgaagcccgtgatcctcaccgacggcgaagaacgcgtcattctggctgggcctatgcccgttacacattcctctgccgcgcagcggagaggccgcatcggaagaaaccctaaaaatgaaaacgaccaatatatctacatgggcgagccccttgaaaatgatgaggactgcgcccactggaaggaggctaaaatgctgctcgataacattaataccccggaagggatcattcctagcatgtttgagcccgaacgggagaaggtggacgccatcgatggagaataccgcctgagaggcgaggctcggaaaacgttcgtggacctgatgcgcagaggggatctccctgtctggcttgcctatcgggtggctgccgagggaattaactacgcggacagacgctggtgttttgatggcatcaagaataaccagattctggaagagaacgttgaagtggagatctggacaaaagagggggaacggaagaagctgaaacccagatggctcgacgcccgcatctattccgatcctctggctcttaaggagttcaaagagttcgccgctggccggaagtctctgaccctcaatctgattacagagatgggaagactgcccacctttatgacgcagaaagcccgggacgccctcgataaccttgctgtcctgcataccgcggaagccggcgggcgcgcttacaatcacgccctgagcgagctcccggagacactggaaacccttctgctcctgacactgctcgccaccgtgacaggaggcatcttcctttttctgatgtccgggaagggaattggcaagatgaccctgggcatgtgctgcatcattacggctagcatcctcctgtggtatgcccagatccaacctcactggattgcggcctctatcattcttgagttctttctgatcgttctcctgattcccgaacccgagaaacagagaacacctcaggacaaccagctgacctacgtggtcatcgctatcctcaccgtggtcgccgctacaatggccaatgaaatggggttccttgagaagaccaaaaaggacctgggactgggctccattacaacgcaagagagcgaatccaacatcctcgatattgacctgcggccggcgtctgcctggaccctttatgctgtggccacaacctttgttacacccatgctgcgccatagcatcgaaaattcctctgtgaacgtgagcctcaccgctattgccaatcaggctacggtcctgatggggctgggaaaaggctggcctctctccaagatggatatcggggttccccttctggccattggatgttacagccaggtgaaccctatcaccctgacagcggccctcctgcttctggtggctcactacgccatcattggccccggcctccaggctaaggccaccagagaagcccaaaaacgggcggctgccgggatcatgaagaatcctacagtcgacggaattaccgtgatcgatctggagccgattccctatgaccctaaattcgaaaagcagctgggccaggttatgctccttatcctgtgcgtgacgcaggtcctgatgatgcgcacaacctgggctctctgtgaggccctgacacttgccaccgggcccatctctaccctgtgggagggaaaccctggcagattttggaatacaacgattgctgtgtccatggccaacatcttccgggggagctacctcgcgggagccggcctgctgttttctattatgaaaaataccacaaacacccgcagaggcacagggaatatcggagaaaccctcggcgagaagtggaagtcccggcttaacgctctggggaaaagcgagttccaaatttataagaaatctggaatccaggaggtcgatagaacgctggccaaggagggcatcaaacgcggggaaacagaccatcacgctgtgagccggggatccgccaagctcagatggtttgttgagcgcaacatggtgacccccgaaggcaaagtcgtggatctgggctgcgggcggggaggctggtcttactattgtgggggacttaagaatgttagagaggtgaagggcctgaccaaagggggaccgggccatgaagaacctattcccatgagcacatacggctggaacctcgtccgcctgcagtccggggtggacgtgttcttcacaccccctgagaagtgcgatacactgctctgtgacatcggagaaagctcccccaatcctacgattgaggcgggccggacccttagagttctgaacctggtcgaaaattggctcaacaataacacacaattttgcatcaaagtgctgaatccgtatatgccctctgtgattgagaagatggaaacccttcagcgcaaatacgggggagccctggtccggaaccctctcagcagaaattccacacacgagatgtactgggtttctaacgctaccggcaatatcgtgagctccgtgaacatgatctctcgcatgctgattaatcggttcacgatgaagcacaagaaagccacctatgagcccgatgtcgacctggggagcggaacaagaaacatcggcattgaatccgagatccctaacctcgacattatcggcaagcgcattgagaagatcaagcaggagcatgaaaccagctggcactacgatcaggaccatccctatagaacatgggcttaccacgggtcttatgagaccaaacaaacaggatccgccagctctatggtgaatggcgttgtgcggcttctgaccaagccgtgggatgtcgtgcctatggttacgcagatggctatgacagacaccaccccctttgggcagcagcgcgtgttcaaggagaaagtcgatacaagaacgcaagaacctaaggagggaaccaaaaagctgatgcggatcacagccgaatggctctggaaagagctgggcaagaagaaaacccccagaatgtgtacacgggaggaatttacccgcaaggtgagatccaacgcggcccttggggctattttcacagacgagaataaatggaaaagcgcccgggaagctgtggaggattctcgcttttgggaactggtcgacagagagcggaacctccacctggagggaaaatgcgaaacctgtgtttacaatatgatgggcaagcgcgagaaaaagctgggcgagttcgggaaggccaaaggatccagagccatctggtatatgtggctcggcgcgcggtttctggagttcgaagctcttgggtttctgaacgaggatcattggttcagccgcggaaattccctcagcggcgtggagggggaaggcctgcacagacttggatacattctgcgggacgtgtctaagaaagagggcggggccatgtacgccgatgacacggctggatgggacacccgcatcacactcgaagatctgaagaacgaggaaatggtcaccaatcatatgaaaggcgagcacaagaagctggccgaggctatttttaaactcacatatcagaacaaggtggttagagtgcagcggcctacaccccgcgggacggtcatggacatcatcagcagacgggatcagagaggatccggccaagtggggacatacggcctgaataccttcacaaacatggaagcccagcttattcgccagatggagggagaaggcatcttcaaatctattcaacatctgaccgttacggaggagatcgcggtgcagaattggctcgcccgggtcgggagagaacgcctgagccggatggctatttccggagacgattgcgtggttaagccgcttgacgatagatttgcctctgctctgaccgccctcaacgacatgggcaaagtgcgcaaggatatccagcagtgggagcctagccgggggtggaatgactggacacaagtccccttctgctcccaccactttcatgaactggtgatgaaggatggaagagtcctggtggttccctgtcgcaaccaggacgagctcatcggccgggcgagaatttctcagggggccggctggagcctgaaagaaaccgcttgccttggaaagtcctatgcccagatgtggacactgatgtacttccaccgccgggatctcagactggctgccaacgctatctgtagcgccgtgccttctcattgggtcccgacctcccggacaacctggagcattcacgcgaaacacgagtggatgacgacagaggacatgcttgccgtgtggaatagagtgtggatccaagaaaacccctggatggaggacaagacccctgttgaatcttgggaggaagtgccctatctgggcaaacgcgaggatcagtggtgcgggtccctcattggactgaccagccgggctacatgggccaagaatatccagaccgccattaaccaggtcagatccctgatcggcaatgaggaatacacagactatatgccttctatgaagcgctttagacgggaggaagaggaagctggggtgctctggtga

SEQ ID NO: 20033 - RNA, 9876 nt, synthetic construct
  misc_feature 1..9876: note = derived and/or modified CDS sequence (opt5) from DENV-2__FJ898453__SS-prME
  source 1..9876: mol_type = other RNA
accgccggagtgatcgtcatgctgattcccaccgctatggccttccacctcacgacccggaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttctccaccaacatctggctgaaacttcgggagagacaggacgtgttttgtgatagcaaactgatgtctgccgctatcaaggacaatcgcgccgtccacgcggatatgggctattggattgaatccgccctcaacgacacgtggaaaatggagaaggctagcttcatcgaggtgaagtcttgccactggcctaaaagccatacactgtggtccaatggggttctggaaagcgagatgattatccccaagaacttcgccggaccggtgtctcagcacaactaccggcctggctatcatacccaaaccgctgggccctggcaccttggaaaactcgaaatggattttgacttctgtgagggcacaaccgtcgtggtgacggaagattgcgggaatagaggaccctccctgcggacaaccacagccagcggcaagctgattaccgagtggtgctgtcgctcctgcacactccctccgctgagataccggggcgaggacgggtgttggtacggaatggaaatcagaccccttaaagagaaggaagagaacctggtcaattctctcgttaccgccggccatgggcagattgataactttagcctgggagtgctgggcatggctcttttcctcgaagagatgctgcgcacgcgggtggggaccaagcacgcgatcctgctcgtcgccctgtcctttgtgacacttatcaccggaaatatgtctttcagagacctgggccgcgttatggtgatggtcggcgctacaatgaccgatgacattgggatgggagtgacgtatctcgccctgctggccgcttttaaagttagacctacattcgccgcgggccttctgctccggaagctgaccagcaaagagctcatgatggctacaatcgggattgccctgctttcccagtctaccctgcccgaaaccatcctcgagctgacagatgccctggctcttggaatgatggtgctgaagattgtccgcaacatggaaaaataccaactcgccgtgacgatcatggcgatcagctgcgttcctaatgctgtgattctgcagaacgcctggaaggtctcctgtaccatcctcgccgctgtgagcgtgtctcccctgcttctgacatccagccagcagaaggccgactggattcctctcgctctgaccatcaaaggcctgaatcccacagccatttttcttaccacgctgtctagaacatccaagaaacggagctggccgctcaacgaggcgatcatggccgtcgggatggtttctatcctggcttccagcctcctgaagaatgacattcctatgaccggaccccttgtggccggcggcctgctgaccgtgtgctatgtcctcacagggcgctccgctgatctggaacttgagagagccgccgacgtgaaatgggaggatcaagctgaaatcagcggatctagccctattctgtccatcaccatttctgaggacggcagcatgtccatcaagaacgaagaggaggaacagacactcacgattctgatccggaccgggctcctggttatctctggagtgttccccgtcagcattccgatcacagcggccgcttggtacctttgggaggtgaaaaagcagcgcgccggcgttctgtgggatgtgccttctccccctcccgtcgggaaggccgaactggaggacggagtgtatagaattaaacagcggggcatcctcggctacagccaaattggggctggagtctataaggaaggcacctttcacacaatgtggcatgtgacccgcggggccgttctgatgcacagaggaaaacggatcgagcccagctgggcggatgtgaagaaagaccttatctcctacggcgggggatggaagctggagggcgaatggaaggagggcgaagaggtccaggtgctcgctctggaacctgggaaaaatccgagagccgttcagacgaagcccggaattttcaaaaccaacacaggcaccatcggggccgtgagcctcgatttttctcctggaacatccggcagccccattgtcgaccgcaaggggaaagtggtgggactgtacggcaatggcgttgtcacccggtctggggcttatgtgtccgccatcgcgcagacagaaaagagcattgaggataaccctgaaatcgaggacgatatcttcagaaagaaacgccttacgattatggacctgcatcccggagctggcaagaccaaacggtacctgcctgccatcgtgagagaagccattaagcgcgggctccggacactgatccttgctccgaccagagtcgtggccgctgagatggaagaggccctgcgcggactccccattcggtatcaaacccctgcgatcagagccgagcacacaggccgggaaattgttgacctgatgtgtcatgctacgttcaccatgcgcctcctgtcccccgtgagagtccctaactacaatcttatcatcatggatgaggcccactttacagaccccgcttctattgccgcccgggggtatatcagcacccgcgtggaaatgggcgaggctgcgggaattttcatgacagccaccccgcctggctccagagatccctttccccagagcaacgctcctatcatggacgaggaacgggagattcccgaaagatcttggaactccgggcacgagtgggttacggatttcaaaggaaagacagtgtggtttgtccctagcatcaaggccggcaacgacatcgccgcttgcctgcgcaaaaatgggaagaaagtgattcagctgtctcggaagaccttcgatagcgaatacgttaaaaccagagccaacgactgggattttgtggtcacaaccgacatctccgagatgggagcgaatttcaaggctgagcgcgtgattgatccgcggagatgtatgaagcccgtgatcctcacagacggcgaagaaagagtcattctggccgggcctatgcccgttacccattctagcgccgctcaacggagaggccgcatcggaagaaaccctaaaaatgaaaacgaccagtatatctacatgggcgagccccttgaaaatgatgaggactgcgcccactggaaggaggcgaaaatgctgctcgataacattaatacgccggaagggatcattccttccatgtttgagcccgaacgggagaaggtggacgccatcgatggagaataccgcctgagaggcgaggctcggaaaacattcgtggacctgatgcgcagaggggatctccctgtctggcttgcctataaggtggctgccgagggaattaactacgctgaccggaaatggtgttttgatggcatcaagaataaccagattctggaagagaacgttgaagtggagatctggaccaaggagggggaacgcaagaagctgaaaccccgctggctcgacgcccggatctattctgatcctctggcgcttaaggagttcaaagagttcgccgctggcagaaagagcctgacactcaatctgattaccgagatgggacgcctgcccacgtttatgacccagaaggcccggaacgctctcgacaatcttgccgtcctgcatacagccgaagtgggcgggagagcttacaaccacgcgctgtccgagctcccggagaccctggaaacacttctgctcctgaccctgctcgccacagttaccggaggcatcttcctttttctgatgagcgggaaaggaattggcaagatgacgctgggcatgtgctgcatcattacagcttctatcctcctgtggtatgcccaaatccagcctcactggattgccgcttccatcattcttgagttctttctgatcgtgctcctgattcccgaacccgagaaacagcggacccctcaggataatcaactgacctacgtcgtgatcgccatcctcacagtcgtggcggccaccatggctaacgaaatggggttccttgagaagaccaagaaggacctgggatttggcagcattacgacccaggagtccgaatctaatatcctggacattgatctccgcccggccagcgcttggacactgtatgccgttgcgaccacattcgtgacccccatgcttagacattccatcgagaactctagcgtgaatgtctccctgacggccattgctaaccaggccaccgttctcatggggctgggaaagggctggcctctgagcaaaatggacatcggggtgcccctccttgctattggatgttactctcaggtgaatcctatcacactgaccgccgctctgctcctgcttgtcgcccactacgcgatcattggccccggcctgcaagccaaggctacacgggaagcccagaaacgcgctgccgccgggatcatgaagaaccctaccgtggatggaattacggttatcgacctcgagccgattccctatgatcctaaatttgaaaagcagctgggccaggtgatgctgctcatcctttgcgtcacacaagtgctgatgatgagaaccacatgggcgctgtgtgaggctctcaccctggccaccgggcccatctccacactttgggagggaaatcctggccggttctggaacacgaccattgctgtcagcatggccaatatctttcgcgggtcttacctggccggagctggcctcctgttctccattatgaagaacacaaccaatacaagacggggcaccgggaacgtgggagaaacgctgggcgagaaatggaagtcccgcctcaacgcccttgggaaatctgaatttcagatctataagaaaagcggcattcaggaggttgacagaacactggcgaaggagggcatcaaaagaggggaaaccgatcatcacgccgtgtccagaggatctgctaagctgcgctggttcgtcgagcggaatatggtggcccccgaaggcaaggttgtggacctcggctgcgggagaggaggctggagctactattgtgggggactgaaaaacgtccgcgaggtgaagggccttaccaaagggggaccgggccatgaggaacctatccccatgtccacatacggctggaatctggtgcggctccaaagcggggttgatgtcttctttacaccccctgagaagtgcgacaccctgctgtgtgatattggagaatcctctcccaaccctacgatcgaggctggcagaaccctccgcgtgcttaatctggtggaaaactggctgaataacaatacacagttctgcattaaagtcctcaacccgtatatgcccagcgttatcgagaagatggaaaccctgcagcggaagtacgggggagcccttgtgagaaatcctctgtcccgcaactctacacacgagatgtactgggtgagcaatgcgaccggcaacattgtctcctctgtgaatatgatcagccggatgctcatcaacagatttacgatgaaacacaagaaagccacctatgagcccgacgttgatctggggtccggaacacgcaacattggcatcgaaagcgagattcctaatctggacatcattggcaagcggatcgagaaaattaagcaggagcatgaaacctcttggcactacgaccaagatcatccctataagacatgggcttaccacgggtcctatgagaccaaacagacaggaagcgcctcttccatggtgaacggcgtcgtgagactccttaccaagccgtgggacgttgtgcctatggtcacgcagatggctatgacagataccacccccttcgggcagcaacgcgtgtttaaagagaaggtggacacaagaacgcaggaacctaaagagggaaccaagaagctgatgaaaatcacagccgaatggctgtggaaggagctcggcaaagagaagacaccccggatgtgtacacgcgaagagttcaccagaaaagtccggagcaatgctgccctgggggcgatctttacagatgaaaacaagtggaaatctgccagagaggctgttgaagacggacggttctgggagcttgtggatcgcgagagaaatctgcacctcgaaggcaagtgcgagacctgtgtgtacaacatgatgggcaagcgggagaaaaagctgggggagtttggaaaagccaagggctcccgcgctatttggtatatgtggctgggggccagattcctcgaatttgaggccctgggattccttaatgaggaccattggtttagccggggcaactccctgagcggggtcgaaggcgagggactccaccgcctgggctacatccttagagaagtggggaaaaaggagggaggcgcgatgtacgctgatgacacggccgggtgggatacccggattacactggaagacctcaagaatgaggagatggttaccaaccatatgaaaggagaacacaagaaactggccgaggctatcttcaagctgacatatcagaataaagtggtccgcgtgcagagacctacaccccggggcacggttatggacattatctctcgcaaggatcaaagagggagcggccaggtgggaacatacggcctcaacaccttcacaaatatggaagcccagctgatccggcaaatggagggggagggaatttttaagtccatccagcatcttaccgtcacggaagagattgctgtgcagaactggctggcccgcgttggcagagaacggctctctagaatggcgatcagcggggacgattgcgtggtcaaaccgattgacgatcgcttcgcctccgctctgaccgcccttaatgacatgggaaaggtgcggaaagatatccagcaatgggagccttctagaggctggaacgactggacacaggtccccttttgcagccaccacttccatgaactggtgatgaaggatgggcgcgttctcgtggtcccctgtcggaaccaggacgagctgatcggcagagctcgcatttcccagggagccggctggtctctgaaagagaccgcgtgcctcggaaagagctatgcccaaatgtggacactgatgtactttcaccggagagatcttcgcctggctgccaatgctatctgttccgccgtgcctagccattgggtgccgacctctcggacaacctggtccattcacgctaagcacgaatggatgacgacagaggacatgctcgccgtttggaacagagtgtggatccaggaaaatccctggatggaggataaaacccctgtcgaaagctgggaggaggtgccctatctgggaaagcgcgaagaccagtggtgcggctctcttattgggctgacctcccgggcgacatgggccaaaaacatccagaccgctattaatcaagttagaagcctcatcggaaacgaggaatacacagactatatgccttccatgaagcggttcagacgcgaggaagaggaggccggcgtgctgtggtga

SEQ ID NO: 20034 - RNA, 9876 nt, synthetic construct
  misc_feature 1..9876: note = derived and/or modified CDS sequence (opt5) from DENV-2__EU482445__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccctgaaaatcctgattggcgttatcattacgtggatcgggatgaactcccgcagcacatctctttccgtcagcctcgtgctggtgggaatcgtcaccctgtacctcggcgtgatggttcaggctgattctgggtgtgtggtctcctggaagaataaggagctgaaatgcggaagcggcattttcatcaccgacaacgtgcacacatggaccgaacagtataagtttcaacctgagtccccctctaaacttgccagcgccattcagaaggctcaggaagaggggatctgtggcattcggtccgttacaagactggagaatctcatgtggaaacagatcacgccggaactgaaccacatcctggccgagaatgaagtgaaacttaccattatgacaggagatatcaaaggcattatgcaagctgggaagcgctctctccggcctcagcccaccgagctgaagtacagctggaaaacatggggaaaggccaaaatgctgtccaccgaaagctataaccagacgttcctcatcgacggccctgagaccacagagtgccccaataccaacagagcgtggaactctctggaagtcgaggattacgggtttggagtgttcacaaccaacatttggcttaagctgaaagaaaagcaggacgccttttgtgactccaagctcatgagcgctgccatcaaagataatcgcgctgttcatgccgacatgggctattggatcgagtctgcgctgaacgatacatggaagattgagaaagcctccttcatcgaagtgaagaattgccactggcctaaaagccataccctgtggtctaacggcgtccttgagagcgaaatgattatccccaagaacctcgctgggccggtgtcccaacacaattaccggcctggataccacacgcagattgccggcccctggcatctggggaagctggagatggacttcgatttttgtgacggaacaaccgtgatcgtcaccgaagattgcggcaacagagggcccagcctccgcacaaccacggcttctggaaaactgattacagagtggtgctgtcggtcctgcacccttcctccgctgagatatcggggcgaggacggctgttggtacgggatggaaatccgccccctcaaggagaaagaagagaatctggttaacagcctggtgacagccggacacggccaggtggataatttctcccttggggtcctcggaatggccctgtttctggaagagatgctcagaacccgggtgggcacaaagcatgctatcctgcttgttgcggtgtctttcgtcaccctgattacggggaacatgagctttaaagacctcggaagagtggttgtgatggtcggcgccaccatggctgatgacatcggcatgggggtgacatatctggccctgcttgccgctttcaaggttcgccctacctttgccgcgggactgctcctgcggaagctcacatccaaagagctgatgatgaccacgattggcatcgtgcttctgtctcaaagcacaattcccgaaaccgtcctcgagctgacagatgctctggcccttgggatgatggtgctgaagatcgtgagaaatatggaaaaataccagctcgccgtcaccatcatggctattctgtgcgttcctaacgccgtgatcctccagaatgcgtggaaggtgtcctgtaccattctggctgtcgtgtctgttagcccccttctgctcacatccagccagcagaagacggactggatccctctggccctgaccattaagggacttaaccccacagccatcttcctgaccacactctctcgcaccaataaaaagagatcctggccgctgaacgaggctatcatggccgtgggcatggtcagcattctcgcttcttccctgcttaagaatgacatccctatgacggggcccctggtggccggaggcctgctcacagtttgctatgtgctgaccggccggagcgcggatcttgaactggagcgcgccaccgacgtcaaatgggaggatcaggctgaaatttctgggtccagccctatcctctccattacaatcagcgaggacggatctatgagcattaagaacgaagaggaggaacagaccctgacaatcctcatcagaacgggcctgcttgtgatttccgggctgtttcccatctctattccgatcaccgccgctgcctggtacctgtgggaggtcaaaaagcagcgggccggagtgctctgggatgttccttctccccctcccatgggcaaagctgaactggaggacggggcgtatcgcattaagcaaaagggaatccttggctactcccagatcggcgccggggtgtacaaagaaggaacattccacaccatgtggcatgtcacaagaggcgctgtgctgatgcacaaggggaaacggattgagccctcctgggccgatgttaagaaagacctcatcagctatggaggcgggtggaagctggagggagaatggaaggagggcgaagaggtgcaggtcctcgccctggaacctggcaaaaatccgcgcgctgtgcagaccaagcccgggctttttaaaacgaacaccggaacaattggcgccgtgtccctggatttctctcctgggaccagcggatcccccatcattgacaagaaaggcaaggttgtcgggctgtacggaaacggcgtggtgacaagaagcggcgcgtatgtctctgctatcgcccaaaccgagaagtccatcgaggataatcctgaaattgaggacgatatctttcggaaacgcagactcacaattatggacctgcaccccggggccggaaagacgaaacggtaccttcctgctatcgtgagagaagccattaagcgcggcctgcggaccctcatcctggcgccgacaagagttgtggctgccgagatggaagaggccctccgcgggctgcccattcggtatcagacccctgctatcagagccgagcataccggacgcgaaatcgtcgaccttatgtgtcacgctacattcacgatgcggctgctgagccccgtgagagttcctaactacaatctcattatcatggatgaggcccatttcaccgaccccgcgtctattgccgctcgcggctatatctccacacgggtggaaatgggggaggccgctggcatttttatgaccgccacaccgcctggaagcagagatcccttcccccagtccaacgcccctatcatcgacgaggaacgggagattcccgaacgctcttggaataccggccacgagtgggtcacggattttaaagggaagacagtgtggttcgttcctagcatcaaggctggaaacgacattgcggcctgcctgcgcaaaaatggcaagaaagtgatccaactttcccggaagacctttgatagcgaatacgtcaaaacccgcacaaacgactgggatttcgtggtgaccacagacatttctgagatgggggctaattttaaggccgagagagtcatcgatccgcggagatgtatgaaacccgttatcctgaccgacggagaggaacgcgtgattctcgccggccctatgcccgtgacgcattccagcgctgcccagcggagagggcgcatcggccggaaccctaagaatgaaaacgaccagtacatttatatgggagagcccctggaaaatgatgaggactgcgcgcactggaaggaggctaaaatgctgctcgataacatcaatacaccggaaggcattatcccttctatgttcgagcccgaaagagagaaggtcgacgccattgatggggaataccgccttcggggagaggccagaaaaacctttgtggacctgatgcgcagaggcgatctgcctgtttggctcgcttataaggtggccgcggaggggatcaactacgccgaccggcgctggtgtttcgatggaatcaaaaacaatcagattctggaagagaacgtcgaagtggagatctggacaaaggagggcgaaagaaagaaacttaagccccggtggctggacgctcgcatttatagcgatcctctcgccctgaaagagtttaaggagttcgctgccgggagaaaatccctgaccctcaatcttatcacggagatgggccggctgcccaccttcatgacacaaaagaccagagacgctctggataacctcgccgttctgcacacagcggaagccggaggccgcgcttacaatcatgccctttctgagctgccggagaccctcgaaacactgctgctccttaccctgctggctacggtgacagggggaatttttctcttcctgatgagcggccgggggatcggaaagatgacccttggcatgtgctgcatcattaccgcctccatcctgctctggtatgcccagattcagcctcactggatcgctgcgtctattatcctggagtttttcctgatcgtcctccttattcccgaacccgagaaacagagaacacctcaagacaaccagctgacctacgtggtcatcgccattctgacagtggttgctgccacgatggccaatgaaatgggctttctcgagaagaccaaaaaggacctggggcttggaagcatcgctacacagcagccggagtccaacattctggatatcgacctccgccccgccagcgcgtggaccctgtacgccgtggctacaaccttcgtgacgcctatgctgcggcattctattgaaaattccagcgtcaacgtttccctcaccgccatcgctaatcaagccacagtgcttatgggcctggggaaaggatggcccctgtctaagatggatatcggcgtgcctctcctggcgattgggtgttatagccaggtcaaccccatcacccttacagccgctctgctcctgctggtggcccactacgctattatcggacctggcctccaggccaaggctaccagagaggcccagaaacgggcggccgctggcattatgaagaatccgacggttgacgggatcacagtgatcgatcttgaccccattccttatgatcccaaatttgaaaagcaactgggacaggtcatgctgctcatcctgtgcgtgacccaggtccttatgatgcgcacaacctgggccctgtgtgaggctctcaccctggccacaggccctatttccacgctgtgggaagggaaccccggaagattctggaataccacaatcgccgtgtctatggcgaacatttttcggggcagctacctcgctggggccggacttctgttctccatcatgaaaaataccacaaacacccgcagaggcacgggcaacatcggggagacactgggagagaagtggaaaagccggctcaatgctctgggcaagtctgaatttcaaatttataagaaatccgggatccaggaggttgaccgcacccttgccaaggaaggaattaaaagaggcgagaccgatcaccatgccgtgagccgggggtctgctaagctgcgctggttcgtcgagagaaacatggtgacaccggaaggaaaagttgtggacctcggctgcggcagagggggatggtcctactattgtggcgggctgaagaatgtccgggaggtgaagggactgaccaaaggcgggcctggacacgaagaacccatccccatgagcacatacggctggaacctcgtgcgccttcagtctggcgttgatgtctttttcattcctcccgaaaagtgcgacacgctgctgtgtgatatcggggagagctcccctaatccgaccgtggaggccggacggacactcagagtgctgaaccttgtcgaaaattggctgaacaataacacccagttctgcatcaaagttctcaatccctacatgccttctgtgattgagaagatggaagcgctgcaacgcaaatatggcggggccctggtgcggaaccccctcagcagaaattccacacatgagatgtactgggtcagcaacgcttccggaaatatcgtgtctagcgttaacatgatttcccgcatgcttatcaaccggtttaccatgagacacaagaaggccacgtatgaacctgacgtggacctgggctctgggacccgcaatattggaatcgagagcgagattcccaacctggatatcatcggcaaacggattgaaaagatcaaacaggagcatgaaacatcctggcactacgaccaggatcacccgtataagacctgggcttaccatggctcttatgagacaaaacagaccgggagcgcctccagcatggtcaatggagtggttagactcctgacaaagccttgggacgtgcttcccaccgtcacgcaaatggcgatgacagataccacccctttcggccagcagcgcgtgtttaaggaaaaagtggacacacggacgcaggagcccaaggaggggaccaaaaagctgatgaaaattacagccgaatggctctggaaggagctgggcaaaaagaagacccctagaatgtgtacacgcgaagagttcaccagaaaagtccggtctaacgctgccctgggcgctatctttacagatgagaataagtggaaatccgcccgcgaagctgttgaggacagcagattctgggaactcgtggataaggagcggaacctgcaccttgaagggaaatgcgagacctgtgtgtacaatatgatgggaaagagagagaagaaactgggcgaatttggcaaggccaaagggtctcgggcgatttggtacatgtggctcggagcccgcttcctggagtttgaagctcttggcttcctgaacgaggaccattggttttccagagaaaatagcctctctggggtcgagggagagggcctgcacaagctggggtatatcctccgggatgtgtccaaaaaggaaggcggagccatgtacgctgacgacacggccggctgggatacccgcatcacactggaggaccttaagaacgaagagatggttaccaatcacatggaaggggagcataaaaagctggccgaggcgattttcaaactcacatatcaaaacaaggtggtcagagtgcagcggcccaccccgcgcggaacggttatggatatcattagcagacgggaccagcgcggctccgggcaagtgggaacatacggcctgaatacctttacaaacatggaagctcagcttatcagacagatggagggggaaggcgtcttcaaaaatattcagcacctgaccgtgacggaggaggttgccgtgcaaaactggctcgcccgggtcggacgcgaaagactgagccggatggctatctctggcgatgactgcgtggtcaagcctctggatgaccgcttcgccaacgctctcaccgccctgaatgatatggggaagatcagaaaagacattcagcagtgggagcccagcaagggatggaacgattggacacaggtgcccttttgctcccatcacttccatgaacttatcatgaaagacggccgggttctggtggtcccttgtagaaatcaagatgagctcattgggcgcgcgcggatctctcagggagccggctggagcctgagagaaaccgcttgccttgggaagtcctatgcccagatgtggtctctgatgtactttcaccgccgggacctcagactggctgccaacgcgatttgtagcgccgtgccgtcccactgggtgcccacatctcgcaccacatggagcatccatgctaaacacgagtggatgaccacggaggacatgctgacagtttggaatcgggtgtggattagagaaaacccttggatggaggataagacccccgtcgaatcctgggaggaaatcccttatctcggcaagcgcgaggaccagtggtgcggaagcctgatcggccttacctctcgggccacatgggctaaaaatattcaagccgctatcaaccaggtgagatccctgattgggaatgaggaatacaccgattacatgcccagcatgaagcgcttccggagagaggaagaggaagccggagttctctggtga

SEQ ID NO: 20035 - RNA, 9876 nt, synthetic construct
  misc_feature 1..9876: note = derived and/or modified CDS sequence (opt5) from DENV-2__EU482446__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccacagagtgccccaataccaacagagcgtggaactctctcgaagtcgaggattacgggtttggagtgttcacaaccaacatttggctgaaacttaaagaaaagcaggacgccttttgtgactccaagctgatgagcgctgccatcaaagataatcgcgctgttcatgccgacatgggctattggatcgagtctgcgctcaacgatacatggaagattgagaaagcctccttcatcgaagtgaagaattgccactggcctaaaagccataccctgtggtctaacggcgtcctggagagcgaaatgattatccccaagaaccttgctgggccggtgtcccaacacaattaccggcctggataccacacgcagattgccggcccctggcatctcgggaagctggagatggacttcgatttttgtgacggaacaaccgtgatcgtcaccgaagattgcggcaacagagggcccagcctgcgcacaaccacggcttctggaaaactcattacagagtggtgctgtcggtcctgcaccctgcctccgcttagatatcggggcgaggacggctgttggtacgggatggaaatccgccccctgaaggagaaagaagagaatctcgttaacagcctggtgacagccggacacggccaggtggataatttctccctgggggtccttggaatggccctctttctggaagagatgctgagaacccgggtgggcacaaagcatgctatcctcctggttgcggtgtctttcgtcacccttattacggggaacatgagctttaaagacctgggaagagtggttgtgatggtcggcgccaccatggctgatgacatcggcatgggggtgacatatctcgccctgctggccgctttcaaggttcgccctacctttgccgcgggacttctgctccggaagctgacatccaaagagctcatgatgaccacgattggcatcgtgctgctttctcaaagcacaattcccgaaaccgtcctggagctcacagatgctctggccctggggatgatggtgcttaagatcgtgagaaatatggaaaaataccagctggccgtcaccatcatggctattctctgcgttcctaacgccgtgatcctgcagaatgcgtggaaggtgtcctgtaccattctcgctgtcgtgtctgttagccccctgcttctgacatccagccagcagaagacggactggatccctctcgccctgaccattaagggactgaaccccacagccatcttccttaccacactgtctcgcaccaataaaaagagatcctggccgctcaacgaggctatcatggccgtgggcatggtcagcattctggcttcttccctcctgaagaatgacatccctatgacggggccccttgtggccggaggcctgctgacagtttgctatgtgctcaccggccggagcgcggatctggaacttgagcgcgccaccgacgtcaaatgggaggatcaggctgaaatttctgggtccagccctatcctgtccattacaatcagcgaggacggatctatgagcattaagaacgaagaggaggaacagaccctcacaatcctgatcagaacgggcctcctggtgatttccgggctttttcccatctctattccgatcaccgccgctgcctggtacctgtgggaggtcaaaaagcagcgggccggagtgctgtgggatgttccttctccccctcccatgggcaaagctgaactcgaggacggggcgtatcgcattaagcaaaagggaatcctgggctactcccagatcggcgccggggtgtacaaagaaggaacattccacaccatgtggcatgtcacaagaggcgctgtgcttatgcacaaggggaaacggattgagccctcctgggccgatgttaagaaagacctgatcagctatggaggcgggtggaagctcgagggagaatggaaggagggcgaagaggtgcaggtcctggccctcgaacctggcaaaaatccgcgcgctgtgcagaccaagcccgggctgtttaaaacgaacaccggaacaattggcgccgtgtcccttgatttctctcctgggaccagcggatcccccatcattgacaagaaaggcaaggttgtcgggctgtacggaaacggcgtggtgacaagaagcggcgcgtatgtctctgctatcgcccaaaccgagaagtccatcgaggataatcctgaaattgaggacgatatctttcggaaacgcagactgacaattatggacctccaccccggggccggaaagacgaaacggtacctgcctgctatcgtgagagaagccattaagcgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaactacaatctgattatcatggatgaggcccatttcaccgaccccgcgtctattgccgctcgcggctatatctccacacgggtggaaatgggggaggccgctggcatttttatgaccgccacaccgcctggaagcagagatcccttcccccagtccaacgcccctatcatcgacgaggaacgggagattcccgaacgctcttggaataccggccacgagtgggtcacggattttaaagggaagacagtgtggttcgttcctagcatcaaggctggaaacgacattgcggcctgcctccgcaaaaatggcaagaaagtgatccaactgtcccggaagacctttgatagcgaatacgtcaaaacccgcacaaacgactgggatttcgtggtgaccacagacatttctgagatgggggctaattttaaggccgagagagtcatcgatccgcggagatgtatgaaacccgttatccttaccgacggagaggaacgcgtgattctggccggccctatgcccgtgacgcattccagcgctgcccagcggagagggcgcatcggccggaaccctaagaatgaaaacgaccagtacatttatatgggagagcccctcgaaaatgatgaggactgcgcgcactggaaggaggctaaaatgctgctggataacatcaatacaccggaaggcattatcccttctatgttcgagcccgaaagagagaaggtcgacgccattgatggggaataccgcctccggggagaggccagaaaaacctttgtggaccttatgcgcagaggcgatctgcctgtttggctggcttataaggtggccgcggaggggatcaactacgccgaccggcgctggtgtttcgatggaatcaaaaacaatcagattctcgaagagaacgtcgaagtggagatctggacaaaggagggcgaaagaaagaaactgaagccccggtggcttgacgctcgcatttatagcgatcctctggccctcaaagagtttaaggagttcgctgccgggagaaaatccctgaccctgaatctcatcacggagatgggccggcttcccaccttcatgacacaaaagaccagagacgctctggataacctggccgttctccacacagcggaagccggaggccgcgcttacaatcatgccctgtctgagcttccggagaccctggaaacactcctgctgctcacccttctggctacggtgacagggggaatttttctgttcctcatgagcggccgggggatcggaaagatgaccctgggcatgtgctgcatcattaccgcctccatccttctgtggtatgcccagattcagcctcactggatcgctgcgtctattatcctcgagtttttcctgatcgtcctgctcattcccgaacccgagaaacagagaacacctcaagacaaccagcttacctacgtggtcatcgccattctgacagtggttgctgccacgatggccaatgaaatgggctttctggagaagaccaaaaaggacctcgggctgggaagcatcgctacacagcagccggagtccaacattcttgatatcgacctgcgccccgccagcgcgtggaccctctacgccgtggctacaaccttcgtgacgcctatgctgcggcattctattgaaaattccagcgtcaacgtttccctgaccgccatcgctaatcaagccacagtgctcatgggccttgggaaaggatggcccctgtctaagatggatatcggcgtgcctctgctcgcgattgggtgttatagccaggtcaaccccatcaccctgacagccgcccttctgctcctggtggcccactacgctattatcggacctggcctgcaggccaaggctaccagagaggcccagaaacgggcggccgctggcattatgaagaatccgacggttgacgggatcacagtgatcgatctcgaccccattccttatgatcccaaatttgaaaagcaacttggacaggtcatgctgctgatcctctgcgtgacccaggtcctgatgatgcgcacaacctgggccctttgtgaggctctgaccctcgccacaggccctatttccacgctgtgggaagggaaccccggaagattctggaataccacaatcgccgtgtctatggcgaacatttttcggggcagctacctggctggggccggactccttttctccatcatgaaaaataccacaaacacccgcagaggcacgggcaacatcggggagacactgggagagaagtggaaaagccggctgaatgctctcggcaagtctgaatttcaaatttataagaaatccgggatccaggaggttgaccgcaccctggccaaggaaggaattaaaagaggcgagaccgatcaccatgccgtgagccgggggtctgctaaacttcgctggttcgtcgagagaaacatggtgacaccggaaggaaaagttgtggacctgggctgcggcagagggggatggtcctactattgtggcgggctcaagaatgtccgggaggtgaagggactgaccaaaggcgggcctggacacgaagaacccatccccatgagcacatacggctggaacctggtgcgcctccagtctggcgttgatgtctttttcattcctcccgaaaagtgcgacacgcttctgtgtgatatcggggagagctcccctaatccgaccgtggaggccggacggacactgagagtgctcaacctggtcgaaaattggcttaacaataacacccagttctgcatcaaagttctgaatccctacatgccttctgtgattgagaagatggaagcgctccaacgcaaatatggcggggccctggtgcggaaccccctgagcagaaattccacacatgagatgtactgggtcagcaacgcttccggaaatatcgtgtctagcgttaacatgatttcccgcatgctcatcaaccggtttaccatgagacacaagaaggccacgtatgaacctgacgtggaccttggctctgggacccgcaatattggaatcgagagcgagattcccaacctggatatcatcggcaaacggattgaaaagatcaaacaggagcatgaaacatcctggcactacgaccaggatcacccgtataagacctgggcttaccatggctcttatgagacaaaacagaccgggagcgcctccagcatggtcaatggagtggttagactgctcacaaagccttgggacgtgctgcccaccgtcacgcaaatggcgatgacagataccacccctttcggccagcagcgcgtgtttaaggaaaaagtggacacacggacgcaggagcccaaggaggggaccaagaaacttatgaaaattacagccgaatggctgtggaaagagctcggcaagaagaagacccctagaatgtgtacacgcgaagagttcaccagaaaagtccggtctaacgctgccctgggcgctatctttacagatgagaataagtggaaatccgcccgcgaagctgttgaggacagcagattctgggaactggtggataaggagcggaacctccacctggaagggaaatgcgagacctgtgtgtacaatatgatgggaaagagagagaagaaacttggcgaatttggcaaggccaaagggtctcgggcgatttggtacatgtggctgggagcccgcttcctcgagtttgaagctctgggcttccttaacgaggaccattggttttccagagaaaatagcctgtctggggtcgagggagagggcctccacaagctggggtatatcctgcgggatgtgtccaaaaaggaaggcggagccatgtacgctgacgacacggccggctgggatacccgcatcacactcgaggacctgaagaacgaagagatggttaccaatcacatggaaggggagcataagaaacttgccgaggcgattttcaaactgacatatcaaaacaaagtggtcagagtgcagcggcccaccccgcgcggaacggttatggatatcattagcagacgggaccagcgcggctccgggcaagtgggaacatacggcctcaatacctttacaaacatggaagctcagctgatcagacagatggagggggaaggcgtcttcaaaaatattcagcaccttaccgtgacggaggaggttgccgtgcaaaactggctggcccgggtcggacgcgaaagactcagccggatggctatctctggcgatgactgcgtggtcaagcctctggatgaccgcttcgccaacgctctgaccgccctcaatgatatggggaagatcagaaaagacattcagcagtgggagcccagcaagggatggaacgattggacacaggtgcccttttgctcccatcacttccatgaactgatcatgaaagacggccgggttcttgtggtcccttgtagaaatcaagatgagctgattgggcgcgcgcggatctctcagggagccggctggagcctcagagaaaccgcttgcctggggaagtcctatgcccagatgtggtctcttatgtactttcaccgccgggacctgagactcgctgccaacgcgatttgtagcgccgtgccgtcccactgggtgcccacatctcgcaccacatggagcatccatgctaaacacgagtggatgaccacggaggacatgctgacagtttggaatcgggtgtggattagagaaaacccttggatggaggataagacccccgtcgaatcctgggaggaaatcccttatctgggcaagcgcgaggaccagtggtgcggaagcctcatcggcctgacctctcgggccacatgggctaaaaatattcaagccgctatcaaccaggtgagatcccttattgggaatgaggaatacaccgattacatgcccagcatgaagcgcttccggagagaggaagaggaagccggagttctgtggtga

SEQ ID NO: 20036 - RNA, 9876 nt, synthetic construct
  misc_feature 1..9876: note = derived and/or modified CDS sequence (opt5) from DENV-2__EU482448__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccacagagtgccccaataccaacagagcgtggaactctctcgaagtcgaggattacgggtttggagtgttcacaaccaacatttggctgaaacttaaagaaaagcaggacgccttttgtgactccaagctgatgagcgctgccatcaaagataatcgcgctgttcatgccgacatgggctattggatcgagtctgcgctcaacgatacatggaagattgagaaagcctccttcatcgaagtgaagaattgccactggcctaaaagccataccctgtggtctaacggcgtcctggagagcgaaatgattatccccaagaaccttgctgggccggtgtcccaacacaattaccggcctggataccacacgcagattgccggcccctggcatctcgggaagctggagatggacttcgatttttgtgacggaacaaccgtgatcgtcaccgaagattgcggcaacagagggcccagcctgcgcacaaccacggcttctggaaaactcattacagagtggtgctgtcggtcctgcaccctgcctccgcttagatatcggggcgaggacggctgttggtacgggatggaaatccgccccctgaaggagaaagaagagaatctcgttaacagcctggtgacagccggacacggccaggtggataatttctccctgggggtccttggaatggccctctttctggaagagatgctgagaacccgggtgggcacaaagcatgctatcctcctggttgcggtgtctttcgtcacccttattacggggaacatgagctttaaagacctgggaagagtggttgtgatggtcggcgccaccatggctgatgacatcggcatgggggtgacatatctcgccctgctggccgctttcaaggttcgccctacctttgccgcgggacttctgctccggaagctgacatccaaagagctcatgatgaccacgattggcatcgtgctgctttctcaaagcacaattcccgaaaccgtcctggagctcacagatgctctggccctggggatgatggtgcttaagatcgtgagaaatatggaaaaataccagctggccgtcaccatcatggctattctctgcgttcctaacgccgtgatcctgcagaatgcgtggaaggtgtcctgtaccattctcgctgtcgtgtctgttagccccctgcttctgacatccagccagcagaagacggactggatccctctcgccctgaccattaagggactgaaccccacagccatcttccttaccacactgtctcgcaccaataaaaagagatcctggccgctcaacgaggctatcatggccgtgggcatggtcagcattctggcttcttccctcctgaagaatgacatccctatgacggggccccttgtggccggaggcctgctgacagtttgctatgtgctcaccggccggagcgcggatctggaacttgagcgcgccaccgacgtcaaatgggaggatcaggctgaaatttctgggtccagccctatcctgtccattacaatcagcgaggacggatctatgagcattaagaacgaagaggaggaacagaccctcacaatcctgatcagaacgggcctcctggtgatttccgggctttttcccatctctattccgatcaccgccgctgcctggtacctgtgggaggtcaaaaagcagcgggccggagtgctgtgggatgttccttctccccctcccatgggcaaagctgaactcgaggacggggcgtatcgcattaagcaaaagggaatcctgggctactcccagatcggcgccggggtgtacaaagaaggaacattccacaccatgtggcatgtcacaagaggcgctgtgcttatgcacaaggggaaacggattgagccctcctgggccgatgttaagaaagacctgatcagctatggaggcgggtggaagctcgagggagaatggaaggagggcgaagaggtgcaggtcctggccctcgaacctggcaaaaatccgcgcgctgtgcagaccaagcccgggctgtttaaaacgaacaccggaacaattggcgccgtgtcccttgatttctctcctgggaccagcggatcccccatcattgacaagaaaggcaaggttgtcgggctgtacggaaacggcgtggtgacaagaagcggcgcgtatgtctctgctatcgcccaaaccgagaagtccatcgaggataatcctgaaattgaggacgatatctttcggaaacgcagactgacaattatggacctccaccccggggccggaaagacgaaacggtacctgcctgctatcgtgagagaagccattaagcgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaactacaatctgattatcatggatgaggcccatttcaccgaccccgcgtctattgccgctcgcggctatatctccacacgggtggaaatgggggaggccgctggcatttttatgaccgccacaccgcctggaagcagagatcccttcccccagtccaacgcccctatcatcgacgaggaacgggagattcccgaacgctcttggaataccggccacgagtgggtcacggattttaaagggaagacagtgtggttcgttcctagcatcaaggctggaaacgacattgcggcctgcctccgcaaaaatggcaagaaagtgatccaactgtcccggaagacctttgatagcgaatacgtcaaaacccgcacaaacgactgggatttcgtggtgaccacagacatttctgagatgggggctaattttaaggccgagagagtcatcgatccgcggagatgtatgaaacccgttatccttaccgacggagaggaacgcgtgattctggccggccctatgcccgtgacgcattccagcgctgcccagcggagagggcgcatcggccggaaccctaagaatgaaaacgaccagtacatttatatgggagagcccctcgaaaatgatgaggactgcgcgcactggaaggaggctaaaatgctgctggataacatcaatacaccggaaggcattatcccttctatgttcgagcccgaaagagagaaggtcgacgccattgatggggaataccgcctccggggagaggccagaaaaacctttgtggaccttatgcgcagaggcgatctgcctgtttggctggcttataaggtggccgcggaggggatcaactacgccgaccggcgctggtgtttcgatggaatcaaaaacaatcagattctcgaagagaacgtcgaagtggagatctggacaaaggagggcgaaagaaagaaactgaagccccggtggcttgacgctcgcatttatagcgatcctctggccctcaaagagtttaaggagttcgctgccgggagaaaatccctgaccctgaatctcatcacggagatgggccggcttcccaccttcatgacacaaaagaccagagacgctctggataacctggccgttctccacacagcggaagccggaggccgcgcttacaatcatgccctgtctgagcttccggagaccctggaaacactcctgctgctcacccttctggctacggtgacagggggaatttttctgttcctcatgagcggccgggggatcggaaagatgaccctgggcatgtgctgcatcattaccgcctccatccttctgtggtatgcccagattcagcctcactggatcgctgcgtctattatcctcgagtttttcctgatcgtcctgctcattcccgaacccgagaaacagagaacacctcaagacaaccagcttacctacgtggtcatcgccattctgacagtggttgctgccacgatggccaatgaaatgggctttctggagaagaccaaaaaggacctcgggctgggaagcatcgctacacagcagccggagtccaacattcttgatatcgacctgcgccccgccagcgcgtggaccctctacgccgtggctacaaccttcgtgacgcctatgctgcggcattctattgaaaattccagcgtcaacgtttccctgaccgccatcgctaatcaagccacagtgctcatgggccttgggaaaggatggcccctgtctaagatggatatcggcgtgcctctgctcgcgattgggtgttatagccaggtcaaccccatcaccctgacagccgcccttctgctcctggtggcccactacgctattatcggacctggcctgcaggccaaggctaccagagaggcccagaaacgggcggccgctggcattatgaagaatccgacggttgacgggatcacagtgatcgatctcgaccccattccttatgatcccaaatttgaaaagcaacttggacaggtcatgctgctgatcctctgcgtgacccaggtcctgatgatgcgcacaacctgggccctttgtgaggctctgaccctcgccacaggccctatttccacgctgtgggaagggaaccccggaagattctggaataccacaatcgccgtgtctatggcgaacatttttcggggcagctacctggctggggccggactccttttctccatcatgaaaaataccacaaacacccgcagaggcacgggcaacatcggggagacactgggagagaagtggaaaagccggctgaatgctctcggcaagtctgaatttcaaatttataagaaatccgggatccaggaggttgaccgcaccctggccaaggaaggaattaaaagaggcgagaccgatcaccatgccgtgagccgggggtctgctaaacttcgctggttcgtcgagagaaacatggtgacaccggaaggaaaagttgtggacctgggctgcggcagagggggatggtcctactattgtggcgggctcaagaatgtccgggaggtgaagggactgaccaaaggcgggcctggacacgaagaacccatccccatgagcacatacggctggaacctggtgcgcctccagtctggcgttgatgtctttttcattcctcccgaaaagtgcgacacgcttctgtgtgatatcggggagagctcccctaatccgaccgtggaggccggacggacactgagagtgctcaacctggtcgaaaattggcttaacaataacacccagttctgcatcaaagttctgaatccctacatgccttctgtgattgagaagatggaagcgctccaacgcaaatatggcggggccctggtgcggaaccccctgagcagaaattccacacatgagatgtactgggtcagcaacgcttccggaaatatcgtgtctagcgttaacatgatttcccgcatgctcatcaaccggtttaccatgagacacaagaaggccacgtatgaacctgacgtggaccttggctctgggacccgcaatattggaatcgagagcgagattcccaacctggatatcatcggcaaacggattgaaaagatcaaacaggagcatgaaatttcctggcactacgaccaggatcacccgtataagacatgggcttaccatggctcttatgagaccaaacagacagggagcgcctccagcatggtcaatggagtggttagactgctcaccaagccttgggacgtgctgcccacagtcacccaaatggcgatgacggatacaacccctttcggccagcagcgcgtgtttaaggaaaaagtggacacccggacacaggagcccaaggaggggacgaagaaacttatgaaaatcaccgccgaatggctgtggaaagagctcggcaagaagaagacacctagaatgtgtacccgcgaagagttcacaagaaaagtccggtctaacgctgccctgggcgctatttttaccgatgagaataagtggaaatccgcccgcgaagctgttgaggacagcagattctgggaactggtggataaggagcggaacctccacctggaagggaaatgcgagacatgtgtgtacaatatgatgggaaagagagagaagaaacttggcgaatttggcaaggccaaagggtctcgggcgatctggtacatgtggctgggagcccgcttcctcgagtttgaagctctgggcttccttaacgaggaccattggttttccagagaaaatagcctgtctggggtcgagggagagggcctccacaagctggggtatatcctgcgggatgtgtccaaaaaggaaggcggagccatgtacgctgacgacaccgccggctgggatacgcgcattaccctcgaggacctgaagaacgaagagatggttacaaatcacatggaaggggagcataagaaacttgccgaggcgatcttcaaactgacctatcaaaacaaagtggtcagagtgcagcggcccacaccgcgcggaaccgttatggatattatcagcagacgggaccagcgcggctccgggcaagtgggaacgtacggcctcaatacatttaccaacatggaagctcagctgattagacagatggagggggaaggcgtcttcaaaaatatccagcaccttacagtgaccgaggaggttgccgtgcaaaactggctggcccgggtcggacgcgaaagactcagccggatggctatctctggcgatgactgcgtggtcaagcctctggatgaccgcttcgccaacgctctgacggccctcaatgatatggggaagattagaaaagacatccagcagtgggagcccagcaagggatggaacgattggacccaggtgcccttttgctcccatcacttccatgaactgattatgaaagacggccgggttcttgtggtcccttgtagaaatcaagatgagctgatcgggcgcgcgcggatttctcagggagccggctggagcctcagagaaacagcttgcctggggaagtcctatgcccagatgtggtctcttatgtactttcaccgccgggacctgagactcgctgccaacgcgatctgtagcgccgtgccgtcccactgggtgcccacctctcgcacaacctggagcattcatgctaaacacgagtggatgacaaccgaggacatgctgacggtttggaatcgggtgtggatcagagaaaacccttggatggaggataagacacccgtcgaatcctgggaggaaatcccttatctgggcaagcgcgaggaccagtggtgcggaagcctcattggcctgacctctcgggccacctgggctaaaaatatccaagccgctattaaccaggtgagatcccttatcgggaatgaggaatacacagattacatgcccagcatgaagcgcttccggagagaggaagaggaagccggagttctgtggtga

SEQ ID NO: 20037 - RNA, 9876 nt, synthetic construct
  misc_feature 1..9876: note = derived and/or modified CDS sequence (opt5) from DENV-2__EU482449__SS-prME
  source 1..9876: mol_type = other RNA
accgccggcgtgatcattatgctgatccccacagctatggccttccacctcacgacccggaacggggagcctcatatgattgtcggacggcaggaaaagggcaagagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccaacaccgaggctgaactgacggggtatggaaccgtgacaatggagtgtagcccccggaccggccttgatttcaatgaaatggtcctgctccaaatggaggacaaagcctggctggtgcaccgccagtggtttcttgatctgccgctcccttggctgcccggggctgacacacagggatctaactggatccagaaggagaccctggttacgttcaagaatcctcatgccaaaaagcaagacgtggtcgtgctcggctcccaggaaggggccatgcacacagctctgaccggcgcgacagagattcagatgagctccggaaaccttctgtttaccggccatctcaaatgcagactgcggatggataaacttcaactgaaagggatgtcttacagcatgtgtaccggaaagttcaagatcgttaaagaaattgccgagacacagcacggcacgatcgtgatcagagtccagtatgagggggacggatccccctgcaagattcccttcgaaatcatggatctcgagaaacgccatgtgctgggccggctgattaccgtcaaccctatcgtgacagaaaaggacagcccggttaatattgaggctgaacccccttttggggattcttacatcattatcggcgtggagcccggacagctcaaactgaactggttcaagaagggctccagcatcgggcaaatgtttgagaccacaatgagaggagccaaacgcatggccattcttggcgacaccgcttgggatttcgggtctctgggaggcgtctttacgagcatcgggaaggccctccaccaggtgttcggcgcgatttacggagctgccttttccggcgtttcttggacaatgaaaatcctgattggggccatcatcacctggattggaatgaatagccggtccaccagcctgtctgtgtcccttgtcctcgtgggcgtgatcacactgtatctgggggctatggttcaggccgacagcggatgtgtcgtgtcttggaagaacaaagaactcaagtgcggctccgggattttcatcaccgataatgtgcacacatggacggagcagtacaagtttcaacctgaaagcccctccaaactggcttctgccattcagaaggcgcatgaggaaggcatctgtggaatcagaagcgtcacccgccttgagaacctgatgtggaaacagattacaccggagctcaatcacatcctgtccgaaaacgaggtgaagctgaccattatgacaggcgacatcaaagggattatgcaggccggaaagcggtctcttagacctcaacccaccgaactcaaatatagctggaagacgtggggcaaggctaaaatgctgtccaccgagagccataatcagacattcctgatcgatgggcctgaaaccgccgagtgccccaacacaaatcgcgcttggaactctctcgaggttgaagactacggatttggcgtgttcaccacaaatatctggctgaaacttcgggagaaacaggacgtcttttgtgattccaagctgatgagcgccgcgattaaagacaacagagccgtgcacgctgatatgggctattggatcgaatctgccctcaatgacacctggaagatggagaaggcttccttcattgaggttaaaagctgccactggcctaagtctcatacgctgtggagcaacggggtgctggaatccgagatgatcattcccaagagcttcgccggaccggtctctcagcacaactaccgccctggctattacacacaaaccgccgggccctggcatcttggaaagctcgaaatggattttgacttctgtgagggcaccacagtggttgtgaccgaagattgcgggaatcggggaccctccctgagaacgacaaccgctagcggcaaactgatcacagagtggtgctgtcggtcctgcaccctccctccgctgcgctacagaggcgaggacgggtgttggtatggaatggaaattcggccccttaaggagaaggaagagaacctggtcaattctctcgtgacagcgggccacgggcagatcgataactttagcctgggagtgctgggcatggcccttttcctcgaagagatgctgagaacccgcgtcgggacgaaacatgctatcctgctcgttgccgtgtcctttatgaccctgattacaggaaatatgtctttccgggaccttggcagagtgatggtcatggtgggcgccaccatgacagatgacatcgggatgggagttacctacctggctctcctggccgcgtttaaggtgcgccctacgttcgctgccggcctgcttctgagaaaactcacaagcaaggagctgatgatggccaccattgggatcgctctcctgtcccagtctacaattcccgaaaccatccttgagctgaccgatgccctcgcgctgggaatgatggtcctgaaaatcgtgcggaacatggaaaagtatcaacttgctgttacaattatggccatcagctgcgtgcctaatgccgtcattctgcagaacgcttggaaggtgtcctgtacgatcctcgccgctgttagcgtgtctcccctgctcctgacctccagccagcagaaagccgactggattcctcttgcgctgacaatcaagggcctcaatcccaccgccatctttctgacaaccctgtctcgcacgtccaaaaagagaagctggccgcttaacgaggctattatggccgtcgggatggtgtctatcctggcttccagcctcctgaaaaatgacattcctatgacaggacccctcgtggccggcggcctgcttaccgtctgctacgttctgaccgggcggtccgccgatctggaactcgagcgcgctacagacgtgaagtgggaggatcaagcggaaatcagcggatctagccctattctgtccatcaccatttctgaggacggcagcatgtccatcaaaaacgaagaggaggaacagacacttacgatcctgattagaaccgggctcctggtgatctctggactcttccccgtcagcattccgatcacagccgctgcctggtatctgtgggaggtgaagaagcagcgggccggcgttctttgggatgtgccttctccccctcccgtcgggaaagctgaactggaggacggagcctaccgcattaagcagaaaggcatcctgggctatagccaaatcggggcgggagtgtacaaggaaggcacctttcacacaatgtggcacgttaccagaggggctgtgctcatgcatcggggaaaacgcattgagcccagctgggccgatgtcaagaaggacctgatctcctacggcgggggatggaaacttgagggcgaatggaaggagggcgaagaggtgcaggtcctggccctcgaacctgggaaaaatccgagagctgtgcagacgaagcccggactgttcaaaaccaacacaggcaccattggggccgttagcctcgatttttctcctggaacatccggcagccccatcgtggaccggaaggggaaggtcgtgggactgtatggcaatggcgttgtgaccagatctggggcgtacgtctccgctattgcccagacagagaaaagcatcgaggataaccctgaaatcgaggacgatattttccgcaagaaacggcttacgatcatggacctgcaccccggagccggcaagaccaaaagatatctgcctgctattgtgcgcgaagccatcaagcgggggctcagaacactgattcttgctccgacccgcgtggttgccgcggagatggaagaggccctgcggggactccccatcagataccaaacccctgctattcgcgccgagcatacaggccgggaaatcgtcgacctgatgtgtcacgctacgttcaccatgagactcctgtcccccgtgcgggtgcctaactataatcttatcattatggatgaggcccattttacagaccccgcctctatcgctgcgcgcgggtacattagcaccagagtcgaaatgggcgaggccgctggaatcttcatgacagccaccccgcctggctcccgggatccctttccccagagcaacgcccctattatcgacgaggaacgcgagatccccgaaagatcttggtccagcgggcacgagtgggtgacggatttcaagggaaaaacagtttggtttgtgccttctattaaggctggcaatgacatcgccgcgtgcctgcggaaaaacgggaagaaagtcattcagctgagcagaaagaccttcgattccgaatatgtgaagacccgcacaaatgactgggattttgttgtgaccacagacatctctgagatgggagctaacttcaaagccgagcgggtcattgatccgagacgctgtatgaagcccgtgatcctcaccgacggcgaagaacgggttatcctggccgggcctatgcccgtgacgcacagctccgctgcccaaagacgcggccggattggaagaaatcctaaaaacgaaaatgaccagtacatctacatgggcgagccccttgaaaacgatgaggactgcgcgcattggaaggaggccaaaatgctgctcgataatattaacacaccggaagggatcattccttctatgtttgagcccgaacgcgagaaggtcgacgctatcgatggagaatatagactgcggggcgaggcccgcaaaaccttcgtggacctgatgagaagaggggatctccctgtgtggcttgcttaccgcgtcgccgctgagggaattaattatgccgacagacggtggtgttttgatggcgttaagaacaatcagatcctggaagagaacgtggaagtggagatctggacaaaggagggggaacgcaagaagctgaaaccccgctggctcgacgcgcggatttacagcgatcctctggcccttaaggagttcaaagagttcgctgccggcagaaagtccctgaccctcaacctgatcacggagatgggacgcctgcccacctttatgacacagaaggctcgggacgccctcgataatcttgccgtcctgcacaccgctgaagcgggcgggagagcctataaccatgctctgagcgagctcccggagacactggaaacccttctgctcctgacactgctcgccaccgtgacgggaggcattttcctttttctgatgtctgggaaaggagttggcaagatgacactgggcatgttctgcatcattaccgcctccatcctcctgtggtacgctcaaatccagcctcactggattgccgcgagcatcattcttgagtttttcctgatcgtgctcctgattcccgaacccgagaaacagcggacccctcaggacaatcaactgacatatgtcgtgatcgccatcctcaccgttgtggctgccacaatggctaacgaaatggggtttcttgagaagacgaaaaaggacctgggactgggctccattgccacccaggagccggaatctaatatcctcgatattgacctgcgccccgcgagcgcctggacactttacgctgtcgccaccacattcgtgacccctatgctgagacactccatcgagaactctagcgtcaatgtgtccctcacggctattgccaaccaggctaccgttctgatggggctgggaaagggctggcccctcagcaaaatggatatcggggtgcctcttctggccattggatgctactctcaggtgaatcccatcacactgaccgcggccctcctgcttctgatcgctcattatgccattatcggccctggcctccaagctaaggccacacgggaagcccagaaacgcgcggctgccgggattatgaagaacccgaccgtcgacggaatcacggttattgatctggaccccatcccttacgatcccaaatttgagaagcagctgggccaggtgatgctccttatcctgtgtgtgacacaagtcctgatgatgagaaccacatgggctctctgcgaagccctgacccttgccaccgggcctatttccacactgtgggagggaaatcccggccggttctggaacacgaccatcgctgtgagcatggccaatatttttcgcgggtcttatctcgcgggagccggcctgctgttctccatcatgaagaacacaaccaatacaagacggggcaccgggaacattggagagacgctcggcgaaaaatggaagtcccgccttaatgctctggggaaatctgagtttcagatctacaagaaaagcggaatccaggaagttgacagaacactggccaaggagggcattaaaagaggggagaccgatcaccatgctgtgtccagaggatctgccaagctccgctggttcgtcgaacggaacatggtgaccccggagggcaaggtcgtggacctgggctgtgggagaggaggctggagctattactgcgggggacttaaaaacgttcgcgaagtgaagggcctgacaaaagggggacctggccacgaggaacccatccccatgtccacctatggctggaatctcgtccggctgcaaagcggggtggatgttttctttacacctcccgagaagtgtgacacgctgctctgcgatattggagagtcctctcctaacccgaccatcgaagcgggcagaacacttcgcgtgctgagcctggtcgagaattggctcaacaatgacacccagttctgtattaaagtgctgaacccctacatgccttccgtgatcgaaaagatggagacacttcagcggaagtacgggggagccctggttagaaatcccctctctcgcaacagcacccatgaaatgtattgggtctccaatgctacgggcaacatcgtgtctagcgtgaatatgatttcccggatgctgatcaacagatttaccatgaaacacaagaaagccacatacgagcctgacgtcgatctggggagcggaacccgcaatattggcatcgagtctgaaattcccaacctcgacatcattggcaagcggatcgagaaaatcaagcaggaacacgagacatcctggcattatgatcaagaccacccgtacaagacctgggcttatcatgggagctacgaaacaaaacagaccggatctgcctccagcatggttaatggcgtggtgagacttctgacgaagccttgggatgtcgtgcccatggttacacagatggctatgaccgacaccacacctttcgggcagcaacgcgtgtttaaagagaaggtcgatacgagaacccaggagcccaaagaaggaacaaagaagctgatgaaaattaccgccgagtggctctggaaggaactgggcaaaaagaaaacacctcggatgtgcacccgcgaggagttcacaagaaaggtgcggtctaacgcggcccttggggctatctttaccgacgaaaacaaatggaagtccgccagagaggctgttgaagatagccggttctgggagctggtggacaaggaacgcaatctccacctggagggaaaatgtgagacgtgcgtctataacatgatgggcaagagagagaagaagctgggcgagtttgggaaagccaagggatcccgggccatttggtacatgtggctcggcgcgcgcttcctggaatttgaggctcttgggttcctgaatgaagatcactggtttagcagagagaactctctcagcggagtggagggcgaagggctgcataaacttggctacatcctgcgggacgtgtccaaaaaggagggaggcgccatgtatgccgacgataccgctgggtgggacacacgcattaccctcgaagatctgaaaaatgaggaaatggtcacaaaccacatggagggagagcataagagactggccgaagctatcttcaaactcacctaccagaataaggttgtgcgggtgcagcgccccacgccgagaggcacagtcatggacatcatttctcggcgcgatcaaagagggagcggacaggtgggcacctatgggctgaacacattcaccaatatggaggcccagcttatccggcaaatggaaggcgagggaatttttaagtccatccagcacctgacggttaccgaggaaattgcggtgcagaactggctcgcccgcgtcggcagagagcggctgtctagaatggctatcagcggggacgattgtgtggttaaacctcttgacgatcgcttcgcctccgctctgacagccctcaatgacatgggaaaggtgcggaaagatatccagcaatgggaaccctctaagggctggaacgactggacccaggtccccttttgcagccatcacttccacgagctgattatgaaagatgggagagtgctggttgtgccttgccgcaatcaggacgaactcatcggacgggcgagaatttcccagggcgccgggtggagcctgaaggagacagcttgtcttggcaagtcttacgcccaaatgtggtccctgatgtattttcatcgccgggacctcagactggctgccaacgctatctgcagcgccgtcccgtctcactgggtgcccacctcccgcacaacctggagcattcatgcgaaacacgagtggatgacgacagaagatatgcttaccgtctggaatcgggtgtggatccaggagaacccttggatggaagacaagacccccgttgagtcctgggaagaggtgccttacctgggaaaaagagaggatcagtggtgtggctctctcattgggctgacaagccgcgccacctgggctaagaacatccagacagccatcaatcaagtccggtccctgattggaaacgaagagtatacggactacatgcccagcatgaaaagattccggagagaagaggaagaggccggcgtgctctggtga

SEQ ID NO: 20038 - RNA, 9876 nt, synthetic construct
  misc_feature 1..9876: note = derived and/or modified CDS sequence (opt5) from DENV-2__EU482450__SS-prME
  source 1..9876: mol_type = other RNA
agcgccggaatgatcattatgctgatccccaccgtcatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtggtcgttaccgaagattgcggcaacagagggcccagcctgcgcaccacaaccgcctctggaaagctcatcacggagtggtgctgtcggtcctgcacactgcctccgcttagatatcggggcgaggacggctgttggtacgggatggaaattcgccccctgaaagagaaggaagagaatctcgtgaacagcctggtgaccgccggacacggccaagtcgataatttctccctgggggtgcttggaatggctctctttctggaagagatgctgagaacacgggttggcaccaaacatgcgatcctcctggtggccgtctctttcgtgacacttatcaccgggaacatgagctttaaggacctgggaagagttgtggtcatggtgggcgctacgatgaccgatgacattggcatgggggttacatatctcgccctgctggccgctttcaaagtgcgccctacctttgccgcgggacttctgctccggaagctgacatccaaggagctcatgatgaccacgatcggcattgtcctgctttctcagagcgctatccccgaaacagtgctggagctcaccgatgccctggccctggggatgatggtgcttaaaattgtcagaaatatggaaaagtaccagctggctgttacaatcatggccatcctctgcgtgcctaacgcggtgattctgcagaatgcttggaaagtctcctgtaccatcctcgccgtggtttctgtgagccccctgcttctgacctccagccaacagaagacagactggattcctctcgccctgacgatcaaaggactgaaccccaccgctattttccttacaaccctgtctcgcacaaataagaaaagatcctggccgctcaacgaggccatcatggctgtcggcatggtgagcatcctggcctcttccctcctgaagaatgacattcctatgaccgggccccttgttgcgggaggcctgctgacggtgtgctatgtcctcacaggccggagcgccgatctggaacttgagcgcgctaccgacgtgaagtgggaggatcaggccgaaatctctgggtccagccctattctgtccatcaccattagcgaggacggatctatgagcatcaaaaacgaagaggaggaacagacactcaccattctgatcagaacaggcctcctggtcatctccgggctttttcccatttctatcccgattacggctgccgcctggtacctgtgggaggtgaagaaacaacgggctggagttctgtgggatgtgccttctccccctcccatgggcaaggcggaactcgaggacggggcctatcgcatcaaacagaagggcattctgggctactcccagatcggcgctggggtctacaaggaaggaaccttccacacaatgtggcatgtgaccagaggcgccgttcttatgcacaaagggaagcggatcgagccctcctgggccgatgtgaaaaaggacctgattagctatggaggcgggtggaaactcgagggagaatggaaggagggcgaagaggtccaggtgctggctctcgaacctggcaagaatccgcgcgccgtgcaaacaaaacccgggctgtttaagaccaacacgggaaccatcggcgcggtttcccttgatttctctcctgggacaagcggatcccccattatcgacaaaaagggcaaagtcgtggggctgtacggaaacggcgtggtcaccagaagcggcgcttatgtgtctgccattgcccagacagagaagtccatcgaggataatcctgaaatcgaggacgatatttttcggaagcgcagactgaccatcatggacctccaccccggggctggaaaaacaaagcggtacctgcctgccattgttagagaagcgatcaaacgcggccttcggacgctgattctcgctccgaccagagtggtcgccgccgagatggaagaggctctgcgcgggctccccatccggtatcagacccctgccattagagctgagcataccggacgcgaaatcgtggacctgatgtgtcacgccaccttcacaatgcggcttctgagccccgttagagtgcctaactacaatctgatcattatggatgaggcgcatttcacggaccccgcctctatcgctgcccgcggctatatttccacccgggtcgaaatgggggaggctgccggcatctttatgacagccaccccgcctggaagcagagatcccttcccccaatccaacgctcctattatcgacgaggaacgggagatccccgaacgctcttggaatagcggccacgagtgggtgacagattttaaggggaaaaccgtttggttcgtgccttccattaaggcgggaaacgacatcgccgcttgcctcagaaagaatggcaaaaaggtcattcagctgagccggaaaacgtttgattctgaatacgtgaagacacgcaccaacgactgggatttcgtggtcaccacagacatctccgagatgggggccaattttaaagccgagagagttattgatccgcggagatgtatgaagcccgtgatccttaccgacggagaggaacgcgtgatcctggctggccctatgcccgtcacacatagctctgccgcgcagcggagagggcgcattggccggaaccctaaaaatgaaaacgaccagtacatctatatgggagagcccctcgaaaatgatgaggactgcgctcactggaaggaggccaagatgctgctggataacattaataccccggaaggcatcattcctagcatgttcgagcccgaaagagagaaagtggacgccatcgatggggaataccgcctccggggagaggctagaaagacgtttgttgaccttatgcgcagaggcgatctgcctgtgtggctggcctataaagtcgcggccgaggggattaactacgctgaccggcgctggtgtttcgatggaatcaagaacaatcaaatcctcgaagagaacgtggaagttgagatttggacaaaagagggcgaaagaaagaagctgaaaccccggtggcttgacgcccgcatctattccgatcctctggctctcaaggagtttaaagagttcgccgctgggagaaagtctctgaccctgaatctcattacagagatgggccggcttcccaccttcatgacgcagaaaaccagagacgccctggataacctggcggtgctccacacagccgaagctggaggccgcgcctacaatcatgctctgagcgagcttccggagaccctggaaacactcctgctgctcacccttctggccacagtcaccgggggaatctttctgttcctcatgtccggccgggggattggaaagatgacgctgggcatgtgctgcatcatcacagcctctattcttctgtggtatgctcagatccagcctcactggattgcggccagcatcattctcgagtttttcctgatcgtgctgctcatccccgaacccgagaagcaaagaacccctcaggacaaccagcttacctacgtcgtgattgctatcctgacagttgtggccgccaccatggctaatgaaatgggctttctggagaaaacaaagaaagacctcgggctgggatccattgccacgcagcaaccggagagcaacatccttgatattgacctgcgccccgcgtctgcctggaccctctacgctgtggccacaaccttcgtcacacctatgctgcggcattccatcgaaaatagctccgttaacgtgtctctgaccgctattgccaatcaggcgacggtgctcatgggccttgggaagggatggcccctgagcaaaatggatatcggcgtccctctgctcgccatcgggtgttattcccaggtgaaccccattaccctgacagctgcccttctgctcctggttgctcactacgccatcattggacctggcctgcaggctaaggccaccagagaggcgcaaaagcgggccgctgccggcatcatgaaaaatccgacagtggacgggattaccgtcatcgatctcgaccccatcccttatgatcccaagtttgaaaaacagcttggacaggtgatgctgctgattctctgcgtcacgcaagtgctgatgatgcgcacaacctgggctctttgtgaggccctgacactcgccaccggccctatctctaccctgtgggaagggaaccccggaagattctggaatacaacgattgcggttagcatggctaacatctttcggggctcctacctggccggggctggactccttttcagcattatgaagaataccacaaacacccgcagaggcacaggcaacatgggggagaccctgggagagaaatggaagtctcggctgaatgccctcggcaaatccgaatttcagatctataaaaagagcgggatccaggaggtggaccgcacgctggccaaagaaggaattaagagaggcgagacagatcaccatgctgtctctcgggggtccgccaaacttcgctggttcgtggagagaaacatggttaccccggaaggaaaggtggtcgacctgggctgcggcagagggggatggagctactattgtggcgggctcaaaaatgtgcgggaggtgaagggactgaccaagggcgggcctggacacgaagaacccatccccatgtctacatacggctggaacctggttcgcctccagagcggcgtcgatgtgtttttcattcctcccgaaaaatgcgacacccttctgtgtgatatcggggagtcctctcctaatccgacagtggaggcgggacggacgctgagagtcctcaacctggttgaaaattggcttaacaataacacccaattctgcattaaggtgctgaatccctacatgcctagcgtgatcgagaaaatggaagccctccagcgcaagtatggcggggctctggtccggaaccccctgtccagaaatagcacacatgagatgtactgggtgtccaacgcctctggaaatatcgttagctccgtgaacatgatttctcgcatgctcatcaaccggtttaccatgagacacaaaaaggctacatatgaacctgacgtcgaccttggcagcgggacccgcaatattggaatcgagtccgagattcccaacctggatatcattggcaagcggatcgagaagatcaagcaggagcatgaaacgtcttggcactacgaccaggatcacccgtataaaacctgggcctaccatggcagctatgagacaaagcaaaccgggtccgcgagctctatggtgaatggagttgtgagactgctcacaaaaccttgggacgtcctgcccaccgtgacacagatggccatgaccgatacgacacctttcggccagcagcgcgtgtttaaggaaaaggtcgacacccggacccaagagcccaaagaggggacaaagaaacttatgaagattacggctgaatggctgtggaaagagctcggaaagaaaaagacccctagaatgtgtacacgcgaagagttcaccagaaaggttcggtccaacgccgctctgggcgccatctttacagatgagaataaatggaaaagcgctcgcgaagccgtggaggactctagattctgggaactggtggataaagagcggaacctccacctggaagggaagtgcgagacctgtgtctacaatatgatgggaaaaagagagaagaaacttggcgaatttggcaaagcgaaggggtcccgggccatttggtacatgtggctgggagctcgcttcctcgagtttgaagccctgggcttccttaacgaggaccattggtttagcagagaaaattctctgtccggggtggagggagagggcctccacaaactggggtatatcctgcgggatgttagcaagaaagaaggcggagctatgtacgccgacgacacagccggctgggatacccgcattacgctcgaggacctgaagaacgaagagatggtgaccaatcacatggaaggggagcataagaaacttgcggaggctatcttcaagctgacatatcagaacaaagtcgtgagagttcagcggcccaccccgcgcggaacagtgatggatatcatttccagacgggaccaacgcggcagcgggcaggtcggaacctacggcctcaatacgtttacaaacatggaagcccagctgatcagacagatggagggggaaggcgtgttcaagaatattcaacaccttaccgttacagaggaggtggccgtcaaaaactggctggctcgggtgggacgcgaaagactctctcggatggccatcagcggcgatgactgcgtcgtgaagcctctggatgaccgcttcgctaacgccctgaccgcgctcaatgatatggggaagattagaaaagacatccagcagtgggagccctccaagggatggaacgattggacgcaggttcccttttgctctcatcacttccatgaactgatcatgaaagacggccgggtgcttgtcgtgccttgtagaaatcaagatgagctgattgggcgcgcccggatcagccagggagctggctggtccctcagagaaaccgcctgcctggggaagtcttatgctcagatgtggagccttatgtactttcaccgccgggacctgagactcgccgcgaacgccatttgttccgctgtgccgtctcactgggttcccacaagccgcaccacatggtccatccatgccaaacacgagtggatgaccacagaggacatgctgaccgtgtggaatcgggtctggattagagaaaacccttggatggaggataagacgcccgtggaaagctgggaggaaatcccttatctgggcaagcgcgaggaccagtggtgcggatctctcattggcctgacatcccgggctacctgggccaaaaatatccaagctgccatcaaccaggttagaagccttattgggaatgaggaatacgcggattacatgccctctatgaagcgcttccggagagaggaagaggaagccggagtgctgtggtga

SEQ ID NO: 20039 - RNA, 9876 nt, synthetic construct
  misc_feature 1..9876: note = derived and/or modified CDS sequence (opt5) from DENV-2__EU569721__SS-prME
  source 1..9876: mol_type = other RNA
agcgccggaatgatcatcatgctgatccccaccgtgatggctttccacctgaccacgagaaatggggagcctcatatgattgtcggaatccaggaaaagggcaaatccctgctttttaagaccgaggacggggttaatatgtgcaccctgatggccatggatctcggagaactgtgtgaggacaccattacctacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcggcggggtctttacatccatcgggaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcagagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccaacagaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacaacgggctggagtgctgtgggatgttcctagccccctccctatgggcaaggcggaactggaggacggggcctatcgcattaaacagaagggaatccttggctactcccagatcggcgctggggtgtacaaggaaggaaccttccacacaatgtggcatgtcaccagaggcgccgtgctgatgcacaaagggaagcggattgagccctcttgggccgatgttaaaaaggacctcatcagctatggaggcgggtggaaactggagggagaatggaaggagggcgaagaggtgcaggtcctcgctctggaacccggcaagaatcctcgcgccgtgcaaacaaaaccggggctttttaagaccaacacgggaaccattggcgcggtgtccctggatttctctcccgggacaagcggatcccctatcattgacaaaaagggcaaagttgtcgggctgtacggaaacggcgtggtgaccagaagcggcgcttatgtctctgccatcgcccagacagagaagtccatcgaggataatcccgaaattgaggacgatatctttcggaagaaacgcctcaccattatggacctgcaccctggggctggaaagacaaaaagataccttcccgccatcgtgcgggaagcgattaagagaggcctgcgcacgctcatcctggctcctacccgggttgtggccgccgagatggaagaggctctcagagggctgccgattcgctatcagacacccgccatccgggctgagcataccggaagagaaatcgtcgaccttatgtgtcacgccaccttcacaatgcgcctgctgagccctgtgcgggttcccaactacaatctcattatcatggatgaggcgcatttcacggaccctgcctctattgctgccagaggctatatctccacccgcgtggaaatgggggaggctgccggcatttttatgacagccacacccccgggaagccgggatcctttcccccaatccaacgctcccatcatcgacgaggaaagagagattcctgaacggtcttggaatagcggccacgagtgggtcacagattttaaagggaagaccgtgtggttcgttccctccatcaaggcgggaaacgacattgccgcttgcctgcgcaaaaatggcaagaaagtgatccagcttagcagaaagacgtttgattctgaatacgtcaaaacacggaccaacgactgggatttcgtggtgaccacagacatttccgagatgggggccaattttaaggccgagcgcgtcatcgatcctagacggtgtatgaaaccggttatcctgaccgacggagaagagagagtgattctcgctggccccatgcctgtgacacatagctctgccgcgcagcgccgggggagaatcggccgcaaccccaagaatgaaaacgaccagtacatttatatgggagagcctctggaaaatgatgaggactgcgctcactggaaggaggccaaaatgctgctcgataacatcaatacccccgaaggcattatcccgagcatgttcgagcctgaacgggagaaggtcgacgccattgatggggaatacagacttcgcggagaggctcggaaaacgtttgtggacctgatgagacgcggcgatctgcccgtttggctcgcctataaggtggcggccgaggggatcaactacgctgacagacggtggtgtttcgatggaatcaaaaacaatcaaattctggaagagaacgtcgaagtggagatctggacaaaggagggcgaacgcaagaaacttaagcctagatggctggacgcccggatttattccgatcccctcgctctgaaagagtttaaggagttcgccgctgggcgcaaatctctgaccctcaatcttatcacagagatgggcagactgcctaccttcatgacgcagaagacccgggacgccctggataacctcgcggttctgcacacagccgaagctggaggcagagcctacaatcatgctcttagcgagctgcccgagaccctcgaaacactgctgctccttaccctgctggccacagtgaccgggggaatttttctcttcctgatgtccggccgcgggatcggaaagatgacgcttggcatgtgctgcatcattacagcctctatcctgctctggtatgctcagattcagccgcactggatcgcggccagcattatcctggagtttttcctgatcgtcctccttattcctgaacccgagaaacaacggacaccccaggacaaccagctgacctacgtggtcatcgctattctgacagtggttgccgccaccatggctaatgaaatgggctttctcgagaagaccaaaaaggacctggggcttggatccatcgccacgcagcaacctgagagcaacattctggatatcgacctcagaccggcgtctgcctggaccctgtacgctgtggccacaaccttcgtgacacccatgctgcgccattccattgaaaatagctccgtcaacgtttctctcaccgctatcgccaatcaggcgacggtgcttatgggcctggggaaaggatggcctctgagcaagatggatatcggcgtgcccctcctggccattgggtgttattcccaggtcaaccctatcacccttacagctgccctgctcctgctggtggctcactacgccattatcggacccggcctccaggctaaggccacccgggaggcgcagaaacgggccgctgccggcattatgaagaatcctacagttgacgggatcaccgtgatcgatcttgacccgattccctatgatcctaaatttgaaaagcagctgggacaggtcatgctgctcatcctgtgcgtgacgcaagtccttatgatgcggacaacctgggctctgtgtgaggccctcacactggccaccggccccatttctaccctgtgggaagggaaccctggacgcttctggaatacaacgatcgcggtgagcatggctaacatttttagaggctcctacctcgccggggctggacttctgttcagcatcatgaaaaataccacaaacacccggcgcggcacaggcaacatgggggagaccctgggagagaagtggaaatctagactcaatgccctgggcaagtccgaatttcagatctataagaaaagcgggattcaggaggttgaccggacgcttgccaaggaaggaatcaaacgcggcgagacagatcaccatgctgtgtctagagggtccgccaagctgcggtggttcgtcgagcgcaacatggtgacccccgaaggaaaagttgtggacctcggctgcggcagagggggatggagctactattgtggcgggctgaagaatgtccgggaggtgaagggactgaccaaaggcgggccgggacacgaggaacctattcccatgtctacatacggctggaacctcgtgagacttcagagcggcgttgatgtctttttcattccccctgaaaagtgcgacaccctgctgtgtgatattggggagtcctctcccaatcctacagtggaggcgggacgcacgctccgggtgctgaaccttgtcgaaaattggctgaacaataacacccaattctgcatcaaagttctcaatccgtacatgcccagcgtgatcgagaagatggaagccctgcagagaaaatatggcggggctctggtgcgcaaccctctctcccggaatagcacacatgagatgtactgggtctccaacgcctctggaaatattgtgagctccgttaacatgatctctagaatgcttattaaccgctttaccatgcggcacaagaaggctacatatgaacccgacgtggacctgggcagcgggaccagaaatatcggaattgagtccgagacgcctaacctggatatcattggcaaacgcatcgaaaagatcaaacaggagcatgaaacctcttggcactacgaccaggatcacccctataagacatgggcctaccatggcagctatgagaccaaacaaacagggtccgcgagctctatggtcaatggagtggttcggctcctgaccaagccgtgggacgtgcttcctacagtcacccagatggccatgacggatacaacccccttcggccagcagagagtgtttaaggaaaaagtggacacccgcacacaagagcctaaggaggggacgaaaaagctgatgaaaattaccgctgaatggctctggaaggagctgggcaaaaagaagacaccccggatgtgtaccagagaagagttcacacgcaaagtcagatccaacgccgctctgggcgccatctttaccgatgagaataagtggaaaagcgctcgggaagccgttgaggactctcgcttctgggaactcgtggataaggagagaaacctgcaccttgaagggaaatgcgagacatgtgtgtacaatatgatgggaaagcgggagaagaaactgggcgaatttggcaaggcgaaagggtccagagccatttggtacatgtggctcggagctcggttcctggagtttgaagcccttggcttcctgaacgaggaccattggtttagccgcgaaaattctctctccggggtcgagggagagggcctgcacaagctggggtatatcctcagagatgtgagcaaaaaggaaggcggagctatgtacgccgacgacaccgccggctgggatacgcggattaccctggaggaccttaagaacgaagagatggttacaaatcacatggaaggggagcataaaaagctggcggaggctatcttcaaactcacctatcagaacaaggtggtccgcgtgcagagacctacaccccggggaaccgttatggatatcatttcccgcagagaccaacggggcagcggacaggtgggaacgtacggcctgaatacatttaccaacatggaagcccagcttatccgccagatggagggggaaggcgtcttcaaaaatattcaacacctgacagtgaccgaggaggttgccgtgcagaactggctcgctagagtcggacgggaacgcctgtctagaatggccatcagcggcgatgactgcgtggtcaagccgctggatgaccggttcgctaacgccctcacggcgctgaatgatatggggaagattcgcaaagacatccagcagtgggagccttccaagggatggaacgattggacccaagtgcccttttgctctcatcacttccatgaacttatcatgaaagacggcagagttctggtggtcccctgtcggaatcaggatgagctcattgggagagcccgcatcagccagggagctggctggtccctgcgggaaacagcctgccttgggaagtcttatgctcagatgtggagcctgatgtactttcacagacgcgacctccggctggccgcgaacgccatttgttccgctgtgccttctcactgggtgccgaccagcagaacaacctggtccatccatgccaaacacgagtggatgacaaccgaggacatgctgacggtttggaatcgcgtgtggattcgggaaaacccctggatggaggataagacacctgtcgaaagctgggaggaaatcccctatctcggcaagagagaggaccaatggtgcggatctctgattggccttacctcccgcgctacctgggccaaaaatatccaggctgccatcaaccaggtgcggagcctgattgggaatgaggaatacacagattacatgccttctatgaagagattccgccgggaggaagaggaagcgggagttctctggtga

SEQ ID NO: 20040 - RNA, 9876 nt, synthetic construct
  misc_feature 1..9876: note = derived and/or modified CDS sequence (opt5) from DENV-2__EU482451__SS-prME
  source 1..9876: mol_type = other RNA
agcgccggaatgatcattatgctgatccccaccgtgatggctttccacctcacaacgagaaacggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacaggggcggagctgaccggatatggcacggttaccatggaatgttctcccagaacagggcttgatttcaatgagatggtgctgctccaaatggaaaacaaggcctggctggtccaccggcagtggtttcttgacctgccgctcccttggctgcccggagctgataagcaggagtccaattggattcagaaagagaccctggtgacattcaagaaccctcatgccaaaaagcaagacgttgtggtcctcggcagccaggaaggggctatgcacaccgccctgacgggcgccacagagatccagatgtcctctggaaatcttctgtttaccggccatctcaaatgccgcctgagaatggacaaacttcaactgaaggggatgagctactccatgtgtacaggaaaattcaaggtggtcaaagaaattgctgagacccagcacggcaccatcgtgattcgggttcagtatgagggggatggaagcccctgcaagatccccttcgaaatcatggacctcgagaaaagatacgtgctgggccgcctgattacagtcaaccctatcgtgacggaaaaggattctccggttaacattgaggcggaacccccttttggggactcctacatcattatcggcgtggagcccggacagctcaagctgaattggttcaaaaagggcagctctattgggcaaatgtttgagaccacaatgcggggagccaaaagaatggctatccttggcgataccgcctgggacttcgggagcctgggaggcgtctttacatccatcgggaaggccctccatcaggtgttcggcgctatttatggagccgcgttttctggcgtgagctggaccatgaaaatcctgattggggttatcattacgtggatcggaatgaactcccgcagcacatctctgtccgtcagccttgtgctcgtgggcatcgtcaccctgtacctgggggtgatggttcaggctgattctggatgtgtggtctcctggaagaataaggaactcaaatgcggcagcgggattttcgtgaccgacaacgttcacacatggaccgagcagtataagtttcaacctgaatccccctctaaactggccagcgccatccagaaggctcaggaggaaggcatttgtggaatccggtccgtgacaagacttgagaatctgatgtggaaacagattacgccggagctcaaccacatcctggccgaaaatgaggtcaagctgaccatcatgacaggcgatattaaagggatcatgcaagctggaaagcgctctcttcggcctcagcccaccgaactcaagtacagctggaaaacatggggcaaggccaaaatgctgtccaccgagagctataaccagacgttcctgattgacgggcctgaaaccgcggagtgccccaatacaaacagagcctggaactctctcgaggtggaagattacggatttggcgttttcaccacaaacatctggctgaaacttaaagagaagcaggacgctttttgtgactccaagctgatgagcgccgctattaaagataatcgcgccgtgcatgcggacatgggctattggatcgaatctgccctcaacgatacctggaagatcgagaaggctagcttcattgaggtcaagaattgccactggcctaaaagccatacactgtggtctaacggggtgctggaaagcgagatgatcattcccaagaaccttgccggaccggtgtcccaacacaattaccggcctggctaccacacccagatcgctgggccctggcatctcggaaagctggaaatggacttcgatttttgtgacggcacgacagtcattgttaccgaggattgcgggaacagaggacccagcctgcgcaccacaaccgcctctggcaaactcatcacggaatggtgctgtcggtcctgcacactgcctccgcttagatatcggggcgaggacgggtgttggtacggaatggagattcgccccctgaaggaaaaagaggaaaatctcgtgaacagcctggtgaccgccggccacgggcaggtcgataatttctccctgggagtgcttggcatggctctctttctggaggaaatgctgagaacacgggttgggaccaagcatgcgatcctcctggtggccgtctctttcgtgacacttatcaccggaaacatgagctttaaagacctgggcagagttgtggtcatggtgggcgctacgatggccgatgacattgggatgggagttacctatctcgccctgctggctgccttcaaggtgcgccctacatttgcggctggccttctgctccggaagctgacctccaaagagctcatgatgacaaccatcgggattgtcctgctttctcaaagcacgatccccgagacagtgctggaactcaccgatgccctggccctgggaatgatggtgcttaagattgtcagaaatatggagaaataccagctggctgttacaatcatggccatcctctgcgtgcctaacgcggtgattctgcagaatgcttggaaggtctcctgtaccatcctcgccgtggtttctgtgagccccctgcttctgacctccagccagcagaagaccgactggattcctctcgccctgacgatcaagggcctgaaccccaccgctattttccttacaaccctgtctcgcacaaataaaaagagatcctggccgctcaacgaagccatcatggctgtcgggatggtgagcatcctggcctcttccctcctgaagaatgacattcctatgaccggaccccttgttgcgggcggcctgctgacggtgtgctatgtcctcacagggcggagcgccgatctggagcttgaacgcgctaccgacgtgaaatgggaggatcaggccgagatctctggatccagccctattctgtccatcaccattagcgaagacggctctatgagcatcaagaacgaggaagaggagcagacactcaccattctgatcagaacagggctcctggtcatctccggactttttcccatttctatcccgattacggctgccgcctggtacctgtgggaagtgaaaaagcagcgggctggcgttctgtgggatgtgccttctccccctcccatggggaaagcggagctcgaagacggagcctatcgcatcaagcaaaagggcattctgggctactcccagatcggggctggagtctacaaagagggcaccttccacacaatgtggcatgtgaccagaggggccgttcttatgcacaagggaaaacggatcgaaccctcctgggccgatgtgaagaaagacctgattagctatggcgggggatggaagctcgagggcgagtggaaggaaggcgaggaagtccaggtgctggctctcgagcctgggaaaaatccgcgcgccgtgcagacaaagcccggactgtttaaaacctccacgggcaccatcggggcggtttctcttgatttcagccctggaacatccggcagccccattatcgacaagaaagggaaggtcgtgggactgtacggcaacggcgtggtcaccagatctggggcttatgtgtccgccattgcccaaacagaaaagagcatcgaggataaccctgagatcgaagacgatatttttcggaaacgcagactgaccatcatggacctccaccccggagctggcaagacaaaacggtacctgcctgccattgttagagaggcgatcaagcgcgggcttcggacgctgattctcgctccgaccagagtggtcgccgccgaaatggaggaagctctgcgcggactccccatccggtatcagacccctgccattagagctgagcataccggccgcgagatcgtggacctgatgtgtcacgccaccttcacaatgcggcttctgtctcccgttagagtgcctaattacaacctgatcattatggatgaagcgcatttcacggaccccgcctccatcgctgcccgcgggtatattagcacccgggtcgagatgggcgaagctgccggaatctttatgacagccaccccgcctggctccagagatcccttcccccagtctaatgctcctattatcgacgaggagcgggaaatccccgagcgcagctggaactccgggcacgaatgggtgacagattttaaaggaaagaccgtttggttcgtgcctagcattaaggcgggcaatgacatcgccgcttgcctccgcaagaatgggaagaaagtcattcaactgtctcggaagacgtttgattccgagtacgtgaaaacaaagaccaatgactgggatttcgtggtcaccacagacatcagcgaaatgggagccaactttaaagccgagcgcgttattgatccgagacggtgtatgaagcccgtgatccttaccgacggcgaggaaagagtgatcctggctgggcctatgcccgtcacacattctagcgccgcgcagcgccggggcagaattggacgcaatcctaagaacgagaatgaccagtacatctatatgggcgaacccctcgagaacgatgaagactgcgctcactggaaagaggccaagatgctgctggataatattaacaccccggaggggatcattccttccatgttcgaacccgagcgggaaaaagtggacgccatcgatggagagtacagactccgcggcgaagctcggaagacgtttgttgaccttatgagacgcggggatctgcctgtgtggctggcctataaagtcgcggccgagggaattaattacgctgacagacggtggtgtttcgatggcatcaagaacaaccagatcctcgaggaaaatgtggaggttgaaatttggacaaaggagggggagcgcaaaaagctgaaacccagatggcttgacgcccggatctattctgatcctctggctctcaaggaatttaaagagttcgccgctggccgcaagagcctgaccctgaacctcattacagaaatgggaagacttcccaccttcatgacgcaaaagacccgggacgccctggataatctggcggtgctccacacagccgaggctggcgggagagcctacaaccatgctctgtccgaacttccggagaccctggagacactcctgctgctcacccttctggccacagtcaccggaggcatctttctgttcctcatgtctgggcgcggaattggcaaaatgacgctgggcatgtgctgcatcatcacagccagcattcttctgtggtatgctcagatccagcctcactggattgcggcctccatcattctcgaatttttcctgatcgtgctgctcatccccgagcccgaaaagcagcggacccctcaagacaatcagcttacctacgtcgtgattgctatcctgacagttgtggccgccaccatggctaacgagatggggtttctggagaagacaaagaaagacctcggactgggcagcattgccacgcagcagccggagtctaatatccttgatattgacctgagacccgcgtccgcctggaccctctacgctgtggccacaaccttcgtcacacctatgctgcgccatagcatcgagaactcctctgttaatgtgagcctgaccgctattgccaaccaagcgacggtgctcatggggcttggaaagggctggcccctgtccaagatggatatcggggtccctctgctcgccatcggatgttattctcaggtgaatcccattaccctgacagctgcccttctgctcctggttgctcactacgccatcattggccctggcctgcaggctaaagccacccgggaagcgcagaagagagccgctgccgggatcatgaaaaacccgacagtggacggaattaccgtcatcgatctcgaccccatcccttatgatcccaagtttgagaaacaacttggccaggtgatgctgctgattctctgcgtcacgcaggtcctgatgatgcggacaacctgggctctttgtgaagccctgacactcgccaccgggcctatcagcaccctgtgggagggaaatcccggccgcttctggaacacaacgattgcggtttccatggctaatatctttagagggagctacctggccggagctggcctccttttctctattatgaagaacaccacaaatacccggcgcggcacagggaacatcggagaaaccctgggcgagaaatggaagtccagactgaacgccctcggaaagagcgagtttcaaacgtataaaaagtctggaatccaggaagtggaccggacactggccaaagagggcattaagcgcggggaaaccgatcaccatgctgtctccagaggaagcgccaaacttcggtggttcgtggagcgcaatatggttaccccggagggcaaggtggtcgacctgggctgcgggagaggaggctggtcttactattgtgggggactcaagaacgtgcgggaagtgaaaggcctgacaaaaggcgggcctgggcacgaggaacccatccccatgagcacctacggctggaatctggttagactccagtccggggtcgatgtgtttttcattcctcccgagaaatgcgacacacttctgtgtgatatcggagaatctagccctaacccgacggtggaggcgggccgcaccctgcgggtcctcaatctggttgagaactggcttaataacaatacacagttctgcattaaggtgctgaacccctacatgccttccgtgatcgagaaaatggaggccctccaaagaaagtatgggggagctctggtccgcaatcccctgagccggaactccacccatgaaatgtactgggtgtctaatgccagcggcaacatcgtttcctctgtgaatatgattagcagaatgctcatcaaccgctttacaatgcggcacaagaaagctacctatgagcctgacgtcgaccttgggtccggaacgagaaacattggcaatgaatctgagatccccaacctggatattatcggcaagcgcattgagaaaatcaagcaggaacatgagaccagctggcactacgaccaggatcacccgtataaaacatgggcctaccatgggtcctatgaaaccaagcagacaggaagcgcgtcttccatggtgaatggcgttgtgcggctgctcaccaagccttgggacgtcctgcccacagtgacccaaatggccatgacggatacaacccctttcgggcagcagagagtgtttaaagagaaggtcgacacccgcacacaggaacccaaagagggaacgaagaaacttatgaagatcaccgctgagtggctgtggaaagaactcggcaagaagaaaacacctcggatgtgtaccagagaggagttcacacgcaaggttagaagcaacgccgctctgggggccatttttaccgatgagaataaatggaagtctgctcgggaggccgtggaagactcccgcttctgggagctggtggataaagaaagaaacctccacctggagggaaagtgcgaaacatgtgtctacaatatgatgggcaagcgggagaagaaacttggcgagtttgggaaagcgaaaggaagcagagccatctggtacatgtggctgggcgctcggttcctcgaatttgaggccctggggttccttaacgaagaccattggttttctcgcgaaaattccctgagcggagtggaaggcgaggggctccacaaactgggctatattctgagagatgtttccaagaaggagggaggcgctatgtacgccgacgacaccgccgggtgggatacgcggatcaccctcgaagacctgaaaaacgaggaaatggtgacaaatcacatggagggagaacataagaaacttgcggaggctattttcaagctgacctatcaaaacaaagtcgtgcgcgttcagagacccacaccgcggggcaccgtgatggatatcatcagccgcagagaccagcgggggtctggacaagtcggcacgtacgggctcaatacatttaccaacatggaggcccagctgattcgccagatggaaggcgagggagtgttcaagaatatccagcaccttacagttaccgaagaggtggccgtccaaaactggctggctagagtgggccgggagcgcctcagcagaatggccatttccggggatgactgcgtcgtgaagcctctggatgaccggttcgctaacgccctgacggcgctcaatgatatgggaaaaatccgcaaggacattcagcagtgggaaccctctaaaggctggaacgattggacccaggttcccttttgcagccatcacttccatgagctgatcatgaaggacgggagagtgcttgtcgtgccttgtcggaatcaagatgaactgatcggcagagcccgcatttcccagggcgctgggtggtctctccgggagacagcctgcctgggcaaaagctatgctcagatgtggtcccttatgtactttcacagacgcgacctgcggctcgccgcgaacgccatctgttctgctgtgccgagccactgggttcccacctccagaacaacctggagcattcatgccaagcacgaatggatgacaaccgaggacatgctgacggtgtggaatcgcgtctggatccgggagaacccttggatggaagataagacacccgtggagtcttgggaagagattccttatctgggaaaaagagaagaccagtggtgcggctccctcatcgggctgaccagccgcgctacctgggccaagaatattcaagttgctatcaaccaggtgcggtctcttatcggaaatgaggagtacacagattacatgccctccatgaaaagattccgccgggaagaggaagaggccggcgtcctgtggtga

SEQ ID NO: 20041 - RNA, 9876 nt, synthetic construct
  misc_feature 1..9876: note = derived and/or modified CDS sequence (opt5) from DENV-2__EU660413__SS-prME
  source 1..9876: mol_type = other RNA
agcgccggaatgatcattatgctgatccccaccgtcatggctttccacctcaccacgcggaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggcttcgattttaatgaaatggtgcttctgcaaatggagaacaaggcctggctcgtccaccggcagtggttcctggaccttccgctgccttggctccccggggctgataagcaggagtccaattggattcagaaagaaaccctggtgacatttaagaaccctcatgccaaaaagcaagacgttgtgatcctgggaagccaggagggcgctatgcacaccgccctcacgggggccacagaaattcagatgtcctctggcaatctgcttttcaccggacatctgaaatgccgcctcagaatggacaagctgcaacttaagggcatgagctactccatgtgtacagggaaattcaaggtcgtgaaagagatcgctgagacccagcacggaaccattgtcatccgggtgcagtatgaaggcgatgggagcccctgcaagatcccctttgagattatggacctggagaagcggtacgttctcggacgcctgatcacagtgaaccctattgtcacggagaaggattctccggtgaacatcgaagcggagccccctttcggcgactcctacattatcattggggttgagcccggccagctgaagctcaattggtttaaaaagggaagctctatcggccaaatgttcgaaaccacaatgagaggggccaaaagaatggctatcctgggagataccgcctgggactttggcagccttgggggagtgttcacatccattggcaaggccctgcatcaggtctttggggctatctatggcgccgcgttctctggagtgagctggaccatgaaaattctcatcggcgtgattatcacgtggatcgggatgaactcccgcagcacatctctgtccgttagcctggtccttgtgggaattgtgaccctctacctgggcgtcatggtgcaggctgattctgggtgtgttgtgtcctggaagaataaggagctgaaatgcggaagcggcatctttattaccgacaacgtccacacatggaccgaacagtataagttccaacctgagtccccctctaaactcgccagcgccatccagaaggctcaggaagaggggatttgtggcatccggtccgtgacaagactggagaatcttatgtggaaacagatcacgccggaactgaaccacattctcgccgagaatgaagttaagctgaccatcatgacaggagatattcgcggcatcatgcaagctgggaaacggtctctgagacctcagcccaccgagcttaagtacagctggaagacatggggaaaagccaagatgctctccaccgaaagctataaccagacgtttctgattgacggccctgagaccgcggagtgccccaatacaaaccgcgcctggaactctctggaagtggaggattacgggttcggagtctttaccacaaacatctggctcaaactgaaggaaaaacaggacgctttctgtgactccaaacttatgagcgccgctatcaaggataatcgggccgtgcatgcggacatgggctattggattgagtctgccctgaacgatacctggaaaatcgagaaggcttccttcattgaagttaaaaattgccactggcctaagagccatacactctggtctaacggcgtgctggagagcgaaatgatcattcccaaaaacctggccgggccggtctcccaacacaattacagacctggataccacacccagatcgctggcccctggcatcttgggaagctcgagatggactttgatttctgtgacggaacgacagtgattgtgaccgaagattgcggcaaccgcgggcccagcctgcggaccacaaccgcctctggaaagctgatcacggagtggtgctgtagatcctgcacactccctccgctgcggtatcgcggcgaggacggctgttggtacgggatggaaatcagaccccttaaagagaaggaagagaatctggtcaacagcctcgttaccgccggacacggccaggtggataatttttccctgggggtgctgggaatggctcttttcctcgaagagatgctgcggacaagagtcggcaccaaacatgcgattctgctcgtggccgtttcttttgtgacactgatcaccgggaacatgagcttcaaggaccttggacgcgtcgtggttatggtgggcgctacgatggccgatgacattggcatgggggtcacctatctggccctcctggctgcctttaaagtgcggcctacattcgcggctggactgcttctgagaaagctcacctccaaggagctgatgatgacaaccatcggcattgttctcctgtctcaaagcacgatccccgaaacagtgcttgagctgaccgatgccctcgccctggggatgatggtcctgaaaatcgtgcgcaatatggaaaagtaccagcttgctgtgacaattatggccatcctgtgcgtccctaacgcggttattctccagaatgcttggaaagtgtcctgtaccatcctggccgtggtctctgtgagccccctcctgcttacctccagccagcaaaagacagactggattcctctggccctcacgatcaaaggactgtctcccaccgctatctttctgacaaccctttccagaagcaacaagaaacggtcttggccgctgaatgaggccattatggctgttggcatggtgtccatcctcgccagctctctgctcaagaacgacattcctatgacagggcccctggtcgcgggaggccttctgaccgtgtgctatgttctgacgggccgctccgccgatctcgaactggagagagctacagacgtgaagtgggaggatcaggccgaaatcagcgggtccagccctattctttctatcaccattagcgaggacggatccatgtctatcaaaaatgaagaggaggaacagaccctgacaatcctcattcggaccggcctgctcgtcatcagcgggctgttccccatttccatcccgattacagctgccgcctggtacctttgggaggtgaagaaacagcgcgctggagtcctgtgggatgtgccttctccccctcccatgggcaaggcggaactggaggacggggcctatagaatcaaacaaaagggaatcctcggctacagccagattggcgctggggtttacaaggaaggaacgtttcacaccatgtggcatgtgacacggggcgccgtcctgatgcacaaagggaagcgcatcgagccctcctgggccgatgtgaaaaaggaccttatttcttatggaggcgggtggaaactggagggagaatggaaggagggcgaagaggttcaggtgctcgctctggaacctggcaagaacccgagagccgtccagaccaaacccggactcttcaagacaaataccggaacgatcggcgcggtgagcctggatttttcccctgggaccagcggatctcccattatcgacaaaaagggcaaagtggttgggctttacggaaacggcgtcgtgacacggtccggcgcttatgtgagcgccatcgcccaaaccgagaagtctattgaggataaccctgaaatcgaggacgatattttccgcaagagacggctgacaatcatggacctgcaccccggggctggaaaaaccaagagatacctccctgccattgtccgcgaagcgatcaaacggggcctgagaacacttattctggctccgacgcgcgtggttgccgccgagatggaagaggctctccgggggctgcccatcagatatcagacccctgccatccgcgctgagcatacaggacgggaaattgtggacctcatgtgtcacgccaccttcaccatgagactgctttcccccgtccgcgtgcctaattacaacctgatcattatggatgaggcgcattttacagaccccgccagcatcgctgcccggggctatatttccacgagagttgaaatgggggaggctgccggcatcttcatgaccgccacaccgcctggatctcgggatccctttccccagagcaatgctcctatcattgacgaggaacgcgagatccccgaaagatcctggaacagcggccacgagtgggtgaccgatttcaaggggaaaacagtctggtttgtgccttctattaaggcgggaaatgacatcgccgcttgcctgcggaagaacggcaaaaaggttattcaactctcccgcaaaaccttcgatagcgaatacgtgaagacgagaacaaatgactgggattttgtcgtgaccaccgacatctctgagatgggggccaacttcaaagccgagcgggtgatcgatccgagacgctgtatgaagcccgtcattctgacagacggagaagaacgggttatccttgctggccctatgcccgtgacccatagctccgccgcgcagagacgcgggcggattggcagaaatcctaaaaacgaaaatgaccagtacatctatatgggagagcccctggaaaacgatgaggactgcgctcactggaaggaggccaagatgctcctggataatattaacacaccggaaggcatcattccttctatgtttgagcccgaacgcgagaaagtggacgccatcgatggggaataccggctgagaggagaggctcgcaagaccttcgtcgacctcatgagacggggcgatcttcctgtgtggctggcctataaagttgcggccgaggggatcaattacgctgaccgcagatggtgttttgatggaattaagaacaaccagatcctggaagagaatgtggaagtcgagatttggacgaaagagggcgaacggaagaagctcaaaccccgctggctggacgccagaatctatagcgatcctcttgctctgaaggagttcaaagagttcgccgctgggcggaagtccctcacactgaacctgattaccgagatgggcagactccccacatttatgacccagaagacgcgcgacgcccttgataatctggcggtgctgcacaccgccgaagctggaggccgggcctacaaccatgctctctctgagctgccggagacacttgaaaccctgctcctgctgacactccttgccaccgttacagggggaatcttcctgtttctgatgagcggcagagggatcggaaagatgaccctcggcatgtgctgcattatcacggcctccattctgctttggtatgctcagatccagcctcactggattgcggccagcatcatcctggagttctttctcattgtgctgctgatccccgaacccgagaagcagcgcacacctcaagacaatcagctcacctacgtcgtgattgctatccttaccgtcgtggccgccacaatggctaacgaaatgggcttcctggagaaaaccaagaaagacctggggctcggaggcattgccacacagcagccggagtctaatatcctggatattgaccttcggcccgcgtccgcctggacgctgtacgctgttgccaccacatttgtgacccctatgctcagacatagcatcgaaaactcctctgtgaatgtcagcctgacagctatcgccaaccaagcgaccgttctgatggggctcggaaagggctggcccctttccaaaatggatattggggtgcctctgctggccatcggatgttattctcaggtgaatcccattacgctcaccgctgccctgcttctgctcgtcgctcactacgccatcattggccctggcctgcaggctaaggccacacgggaggcgcagaagcgcgccgctgccgggatcatgaaaaacccgaccgtggacggaatcacagttattgatctggaccccatcccttatgatcccaagttcgaaaaacaactcggccaggtgatgcttctgattctgtgcgtcacccaggtgctcatgatgagaacgacatgggctctgtgtgaggcccttaccctggccacagggcctatcagcaccctctgggaaggaaatcccggccggttttggaacaccacaattgcggtctccatggctaatatcttccgcgggagctacctggccggagctggcctgctcttttctatcatgaagaacacgaccaatacaagacggggcaccgggaacattggagagacacttggcgagaaatggaagtcccgcctgaacgccctggggaaaagcgagttccaaatctataagaagtctggcattcaggaggtggacagaaccctcgccaaagaaggcatcaagagaggggaaacggatcaccatgctgtttcccgcggaagcgccaaactgagatggtttgtggagcggaatatggtcacaccggaaggcaaggtggttgaccttggctgcgggagaggaggctggtcttactattgtgggggactgaaaaacgtgcgcgaggtcaagggcctcaccaaaggcgggcctgggcacgaagaacccattcccatgagcacctacggctggaatctggtgcggctgcagtccggggtggatgttttcttcatccctcccgaaaaatgcgacacactcctttgtgatatcggagagtctagccctaacccgaccgtcgaggcgggcagaacactgcgcgtgctgaatctcgtggaaaactggctgaataacaatacgcagttttgcattaaggtccttaacccctacatgccttccgttatcgagaaaatggaagccctgcaacggaagtatgggggagctctcgtgagaaatcccctgagccgcaactccacccatgagatgtactgggtgtctaatgccagcggcaacattgtctcctctgtgaatatgatcagccggatgctgattaacagattcacaatgcgccacaaaaaggctacctatgaacctgacgttgacctcgggtccggaacacggaacatcggcattgagtctgagaagcccaatcttgatatcatcggcaaaagaattgaaaagatcaaacaggagcatgaaaccagctggcactacgaccaggatcacccgtataagacgtgggcctaccatgggtcctatgagaccaaacagacaggaagcgcgtcttccatggtgaacggcgtcgtgcgcctgctgaccaagccttgggacgttctccccacagtgacccaaatggccatgacagataccacgccttttgggcagcagcgggtcttcaaggaaaaagtggacacaagaacccaggagcccaaggagggaaccaaaaagctgatgaaaattacagctgaatggctttggaaggagctgggcaaaaagaagacgcctcgcatgtgtaccagagaagagtttacacggaaagtgcgcagcaatgccgctctcggggccatcttcaccgatgagaacaagtggaaatctgctagagaagccgtcgaggactcccggttttgggaactggttgataaggagagaaatctgcacctcgaaggaaaatgcgagacatgtgtgtacaacatgatgggcaagcgggagaagaaactgggcgagttcgggaaggcgaaaggaagccgcgccatttggtacatgtggcttggcgctagatttctggagttcgaagccctcgggtttctgaatgaggaccattggttctctcgggaaaactcccttagcggagtggagggcgaggggctgcacaagctcggctatatcctgcgcgatgtctccaaaaaggaaggaggcgctatgtacgccgacgacaccgccgggtgggatacaagaatcaccctggaggacctcaagaatgaagagatggtgacgaaccacatggaaggagagcataaaaagctggcggaggctatttttaaacttacctatcaaaataaggttgtgcgggtccagcgccccacaccgagaggcaccgtgatggatatcattagccggcgcgaccagagagggtctggacaagttggcacatacgggctgaacaccttcacgaatatggaagcccagctcatccggcagatggagggcgaaggagtgttcaaaaacattcagcacctgacagtcaccgaggaggtggccgttcataattggcttgctcgcgtgggcagagaacggctgagccgcatggccatctccggggatgactgcgtcgtgaagcctctcgatgacagatttgctaacgccctgacagcgctgaacgatatgggaaagatccggaaagacattcaacagtgggagccctctaagggctggaatgattggacccaggtccccttctgcagccaccattttcacgaactcatcatgaaagacgggagagtgctggttgtgccttgtcgcaaccaggatgagcttattggacgggccagaatctcccaaggcgctgggtggtctctgcgcgaaacggcctgcctcggcaagagctatgctcagatgtggtccctgatgtacttccaccggagagaccttcgcctggccgcgaatgccatttgttctgctgtcccgagccattgggtgcccacctcccggacaacctggagcatccacgccaaacatgagtggatgacaaccgaggacatgctcacagtgtggaacagagtttggattcgcgaaaatccttggatggaggataagacccccgtggaatcttgggaggaaatcccttatctgggaaagcgggaggaccagtggtgcggctccctgatcgggctcacgagcagagctacatgggccaaaaacattcaggctgccatcaatcaagtccgctctctgattggaaacgaggaatacaccgattacatgccctccatgaagcggtttagacgggaggaagaggaagcgggcgtgctttggtga

SEQ ID NO: 20042 - RNA, 9876 nt, synthetic construct
  misc_feature 1..9876: note = derived and/or modified CDS sequence (opt5) from DENV-2__EU660414__SS-prME
  source 1..9876: mol_type = other RNA
agcgccggaatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatgggttctgcggcatcccgggttcaccattatggccgctatcctcgcctacacaattggaaccacccactttcagcgcgtgctgatcttcattcttctgacagctgtcgccccttccatgacgatgagatgcatcggcatttctaaccgggattttgtggaaggggttagcggaggctcctgggtggacatcgtcctcgagcacgggagctgtgtgaccacaatggcgaagaataagcccaccctggatttcgaacttatcaaaacagaggccaagcagcctgctaccctgcgcaaatattgcattgaagccaagctcacgaacacaaccaccgagtctagatgtccgacacaaggagagccctccctgaaagaagaacaggacaagcggtttgtgtgcaagcatagcatggtcgatcgcggctggggcaatgggtgtggactgttcggcaaagggggaatcgttacctgcgctatgtttacatgcaagaaaaacatggaaggcaagattgtgcagcctgagaatctcgaatacacgatcgtggtcacaccccactctggggaggagcatgccgtgggaaacgacacaggcaaacacggccaggaaattaaggttacccctcaatccagcatcacagaggcggaactgaccgggtatggaacggtgaccatggagtgttctcccagaacaggccttgatttcaatgaaatggtcctgctccagatggagaacaaagcctggctggtgcaccggcagtggtttcttgacctgccgctcccttggctgcccggggctgataagcaggagtccaattggatccaaaaggaaaccctggttacattcaaaaaccctcatgccaagaaacaggacgtggtcgtgctcggaagccaggagggcgctatgcacaccgccctgacgggggccacagaaattcaaatgtcctctggcaatcttctgtttaccggacatctcaagtgccgcctgagaatggacaaacttcagctgaagggcatgagctactccatgtgtacagggaagttcaaagtcgtgaaggagatcgctgagacccagcacggaaccattgttatccgggtgcagtatgaaggcgatgggagcccctgcaaaattcccttcgagatcatggacctcgaaaagagatacgtcctgggacgcctgatcacagtgaaccctattgttacggagaaagattctccggtgaacatcgaagcggagcccccttttggcgactcctacattatcattggggtcgagcccggccaactcaagctgaattggttcaagaaaggaagctctatcggccagatgtttgaaaccacaatgagaggggccaagagaatggctattcttggagataccgcctgggacttcggcagcctcgggggagtgtttacatccatcggcaaagccctccatcaggtgttcggggctatctatggcgccgcgttttctggagttagctggaccatgaagattctgatcggcgtcattatcacgtggattgggatgaactcccgcagcacatctctgtccgtgagccttgtgctcgtcggaatcgtgaccctgtacctgggcgttatggtgcaggctgattctgggtgtgtcgtgtcctggaaaaataaggagctcaagtgcggaagcggcatcttcattaccgacaacgttcacacatggaccgaacaatataaatttcagcctgagtccccctctaagctggccagcgccatccagaaagctcaggaagaggggatttgtggcatccggtccgtgacaagacttgagaatctgatgtggaagcaaattacgccggaactcaaccacatcctggccgagaatgaagtcaaactgaccatcatgacaggagatattaagggcatcatgcaggctgggaaacgctctcttcggcctcagcccaccgagctcaagtacagctggaagacatggggaaaagccaagatgctgtccaccgaaagctataaccagacgttcctgattgacggccctgagaccgcggagtgccccaatacaaacagagcctggaactctctcgaagtggaggattacgggtttggagttttcaccacaaacatctggctgaaacttaaggaaaaacaagacgctttttgtgactccaagctgatgagcgccgctattaaggataatcgcgccgtgcatgcggacatgggctattggatcgagtctgccctcaacgatacctggaaaatcgagaaggcttccttcattgaagtcaaaaattgccactggcctaagagccatacactgtggtctaacggcgtgctggagagcgaaatgatcattcccaaaaaccttgccgggccggtgtcccagcacaattaccggcctggataccacacccagatcgctggcccctggcatctcgggaagctggagatggacttcgatttttgtgacggaacgacagtcattgttaccgaagattgcggcaacagagggcccagcctgcgcaccacaaccgcctctggaaagctcatcacggagtggtgctgtcggtcctgcacactgcctccgcttagatatcggggcgaggacggctgttggtacgggatggaaattcgccccctgaaagagaaggaagagaatctcgtgaacagcctggtgaccgccggacacggccaagtcgataatttctccctgggggtgcttggaatggctctctttctggaagagatgctgagaacacgggttggcaccaaacatgcgatcctcctggtggccgtctctttcgtgacacttatcaccgggaacatgagctttaaggacctgggaagagttgtggtcatggtgggcgctacgatggccgatgacattggcatgggggttacctatctcgccctgctggctgccttcaaagtgcgccctacatttgcggctggacttctgctccggaagctgacctccaaggagctcatgatgacaaccatcggcattgtcctgctttctcagagcacgatccccgaaacagtgctggagctcaccgatgccctggccctggggatgatggtgcttaaaattgtcagaaatatggaaaagtaccagctggctgttacaatcatggccatcctctgcgtgcctaacgcggtgattctgcagaatgcttggaaagtctcctgtaccatcctcgccgtggtttctgtgagccccctgcttctgacctccagccaacagaagacagactggattcctctcgccctgacgatcaaaggactgaaccccaccgctattttccttacaaccctgtctcgcacaaataagaaaagatcctggccgctcaacgaggccatcatggctgtcggcatggtgagcatcctggcctcttccctcctgaagaatgacattcctatgaccgggccccttgttgcgggaggcctgctgacggtgtgctatgtcctcacaggccggagcgccgatctggaacttgagcgcgctaccgacgtgaagtgggaggatcaggccgaaatctctgggtccagccctattctgtccatcaccattagcgaggacggatctatgagcatcaaaaacgaagaggaggaacagacactcaccattctgatcagaacaggcctcctggtcatctccgggctttttcccatttctatcccgattacggctgccgcctggtacctgtgggaggtgaagaaacaacgggctggagttctgtgggatgtgccttctccccctcccatgggcaaggcggaactcgaggacggggcctatcgcatcaaacagaagggcattctgggctactcccagatcggcgctggggtctacaaggaaggaaccttccacacaatgtggcatgtgaccagaggcgccgttcttatgcacaaagggaagcggatcgagccctcctgggccgatgtgaaaaaggacctgattagctatggaggcgggtggaaactcgagggagaatggaaggagggcgaagaggtccaggtgctggctctcgaacctggcaagaatccgcgcgccgtgcaaacaaaacccgggctgtttaagaccaacacgggaaccatcggcgcggtttcccttgatttctctcctgggacaagcggatcccccattatcgacaaaaagggcaaagtcgtggggctgtacggaaacggcgtggtcaccagaagcggcgcttatgtgtctgccattgcccagacagagaagtccatcgaggataatcctgaaatcgaggacgatatttttcggaagcgcagactgaccatcatggacctccaccccggggctggaaaaacaaagcggtacctgcctgccattgttagagaagcgatcaaacgcggccttcggacgctgattctcgctccgaccagagtggtcgccgccgagatggaagaggctctgcgcgggctccccatccggtatcagacccctgccattagagctgagcataccggacgcgaaatcgtggacctgatgtgtcacgccaccttcacaatgcggcttctgagccccgttagagtgcctaactacaatctgatcattatggatgaggcgcatttcacggaccccgcctctatcgctgcccgcggctatatttccacccgggtcgaaatgggggaggctgccggcatctttatgacagccaccccgcctggaaacagagatcccttcccccaaagcaatgctcctattatcgacgaggaacgggagatccccgaacgctcctggaactctggccacgagtgggtgacagattttaaggggaaaaccgtttggttcgtgcctagcattaaggcgggaaatgacatcgccgcttgcctcagaaagaacggcaaaaaggtcattcagctgtcccggaaaacgtttgatagcgaatacgtgaagacacgcatcaatgactgggatttcgtggtcaccaccgacatttctgagatgggggccaactttaaagccgagagagttatcgatccgcggagatgtatgaagcccgtgatccttacagacggagaggaacgcgtgattctggctggccctatgcccgtcacccattccagcgccgcgcagcggagagggcgcatcggccggaatcctaaaaacgaaaatgaccagtacatttatatgggagagcccctcgaaaacgatgaggactgcgctcactggaaggaggccaagatgctgctggataatatcaacacaccggaaggcattatcccttctatgttcgagcccgaaagagagaaagtggacgccattgatggggaataccgcctccggggagaggctagaaagacctttgttgaccttatgcgcagaggcgatctgcctgtgtggctggcctataaagtcgcggccgaggggatcaactacgctgaccggcgctggtgtttcgatggaatcaagaataaccaaattctcgaagagaatgtggaagttgagatctggacgaaagagggcgaaagaaagaagctgaaaccccggtggcttgacgcccgcatttatagcgatcctctggctctcaaggagtttaaagagttcgccgctgggagaaagtccctgacactgaacctcatcaccgagatgggccggcttcccacattcatgacccagaaaacgagagacgccctggataatctggcggtgctccacaccgccgaagctggaggccgcgcctacaaccatgctctgtctgagcttccggagacactggaaaccctcctgctgctcacacttctggccaccgtcacagggggaatttttctgttcctcatgagcggccgggggatcggaaagatgaccctgggcatgtgctgcatcattacggcctccatccttctgtggtatgctcagattcagcctcactggatcgcggcctctattatcctcgagtttttcctgatcgtgctgctcattcccgaacccgagaagcaaagaacacctcaggacaatcagcttacctacgtcgtgatcgctattctgaccgttgtggccgccacaatggctaacgaaatgggctttctggagaaaaccaagaaagacctcgggctgggaagcatcgccacacagcaaccggagtccaatattcttgatatcgacctgcgccccgcgagcgcctggacgctctacgctgtggccaccacattcgtcacccctatgctgcggcattctattgaaaactccagcgttaatgtgtccctgacagctatcgccaaccaggcgaccgtgctcatgggccttgggaagggatggcccctgtctaaaatggatatcggcgtccctctgctcgccattgggtgttatagccaggtgaatcccatcacgctgaccgctgcccttctgctcctggttgctcactacgccattatcggacctggcctgcaggctaaggccacaagagaggcgcaaaagcgggccgctgccggcattatgaaaaacccgaccgtggacgggatcacagtcatcgatctcgaccccattccttatgatcccaagtttgaaaaacagcttggacaggtgatgctgctgatcctctgcgtcacccaagtgctgatgatgcgcacgacatgggctctttgtgaggccctgaccctcgccacaggccctatttccaccctgtgggaagggtctcccggaagattctggaataccacaatcgcggttagcatggctaacatttttcggggctcctacctggccggggctggactccttttcagcatcatgaagaatacgaccaacacacgcagaggcaccggcaacatgggggagacactgggagagaaatggaagtctcggctgaatgccctcggcaaatccgaatttcagatctataaaaagagcgggattcaggaggtggaccgcaccctggccaaagaaggaatcaagagaggcgagacggatcaccatgctgtctctcgggggtccgccaaacttcgctggttcgtggagagaaacatggttacaccggaaggaaaggtggtcgacctgggctgcggcagagggggatggagctactattgtggcgggctcaaaaatgtgcgggaggtgaagggactgaccaagggcgggcctggacacgaagaacccattcccatgtctacctacggctggaacctggttcgcctccagagcggcgtcgatgtgtttttcatccctcccgaaaaatgcgacacacttctgtgtgatattggggagtcctctcctaatccgaccgtggaggcgggacggacactgagagtcctcaacctggttgaaaattggcttaacaataacacgcaattctgcatcaaggtgctgaatccctacatgcctagcgtgatcgagaaaatggaagccctccagcgcaagtatggcggggctctggtccggaaccccctgtccagaaatagcacccatgagatgtactgggtgtccaacgcctctggaaatattgttagctccgtgaacatgatctctcgcatgctcattaaccggtttacaatgagacacaaaaaggctacctatgaacctgacgtcgaccttggcagcgggacacgcaatatcggaattgagtccgagacccccaacctggatatcattggcaagcggatcgagaagatcaagcaggagcatgaaacgtcttggcactacgaccaggatcacccgtataaaacctgggcctaccatggcagctatgagacaaagcaaaccgggtccgcgagctctatggtgaatggagttgtgagactgctcacaaaaccttgggacgtcctgcccaccgtgacacagatggccatgaccgatacgacacctttcggccagcagcgcgtgtttaaggaaaaggtcgacacccggacccaagagcccaaagaggggacaaagaaacttatgaagattacggctgaatggctgtggaaagagctcggaaagaaaaagacccctagaatgtgtacacgcgaagagttcaccagaaaggttcggtccaacgccgctctgggcgccatctttacagatgagaataaatggaaaagcgctcgcgaagccgtggaggactctagattctgggaactggtggataaagagcggaacctccacctggaagggaagtgcgagacctgtgtctacaatatgatgggaaaaagagagaagaaacttggcgaatttggcaaagcgaaggggtcccgggccatttggtacatgtggctgggagctcgcttcctcgagtttgaagccctgggcttccttaacgaggaccattggtttagcagagaaaattctctgtccggggtggagggagagggcctccacaaactggggtatatcctgcgggatgttagcaagaaagaaggcggagctatgtacgccgacgacacagccggctgggatacccgcattacgctcgaggacctgaagaacgaagagatggtgaccaatcacatggaaggggagcataagaaacttgcggaggctatcttcaagctgacatatcagaacaaagtcgtgagagttcagcggcccaccccgcgcggaacagtgatggatatcatttccagacgggaccaacgcggcagcgggcaggtcggaacctacggcctcaatacgtttacaaacatggaagcccagctgatcagacagatggagggggaaggcgtgttcaagaatattcaacaccttaccgttacagaggaggtggccgtccagaactggctggctcgggtgggacgcgaaagactctctcggatggccatcagcggcgatgactgcgtcgtgaaacctctggatgaccgcttcgctaacgccctgaccgcgctcaatgatatggggaagattagaaaggacatccagcagtgggagccctccaaaggatggaacgattggacgcaagttcccttttgctctcatcacttccatgaactgatcatgaaggacggccgggtgcttgtcgtgccttgtagaaatcaggatgagctgattgggcgcgcccggatcagccagggagctggctggtccctcagagaaaccgcctgcctggggaaatcttatgctcagatgtggagccttatgtactttcaccgccgggacctgagactcgccgcgaacgccatttgttccgctgtgccgtctcactgggttcccacaagccgcaccacatggtccatccatgccaagcacgagtggatgaccacagaggacatgctgaccgtgtggaatcgggtctggattagagaaaacccttggatggaggataaaacgcccgtggaaagctgggaggaaatcccttatctgggcaagcgcgaggaccaatggtgcggatctctcattggcctgacatcccgggctacctgggccaagaatatccaggttgctatcaaccaggtgagaagccttattgggaatgaggaatacaccgattacatgccctctatgaaacgcttccggagagaggaagaggaagccggagtcctgtggtga

SEQ ID NO: 20043 - RNA, 9876 nt, synthetic construct
  misc_feature 1..9876: note = derived and/or modified CDS sequence (opt5) from DENV-2__EU660415__SS-prME
  source 1..9876: mol_type = other RNA
agcgccggaatgatcattatgctgatccccaccgtgatggctttccaccttaccacgagaaatggggaacctcatatgattgtcgggatccaggaaaagggcaaatccctgctttttaagaccgaggacggggttaatatgtgcacactgatggccatggatctcggagaactgtgtgaggacaccattacatacaaatgcccgcttctgcggcaaaatgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtgggccccggacagctcaagctgaattggttcaaaaagggcagctctattgggcaaatgtttgagaccacaatgcggggagccaaaagaatggctatccttggcgataccgcctgggacttcgggagcctgggaggcgtctttacatccatcgggaaggccctccatcaggtgttcggcgctatttatggagccgcgttttctggcgtgagctggaccatgaaaatcctgattggggttatcattacgtggatcggaatgaactcccgcagcacatctctgtccgtcagccttgtgctcgtgggcatcgtcaccctgtacctgggggtgatggttcaggctgattctggatgtgtggtctcctggaagaataaggaactcaaatgcggcagcgggattttcatcaccgacaacgtgcacacatggaccgagcagtataagtttcaacctgaatccccctctaaactggccagcgccattcagaaggctcaggaggaaggcatctgtggcattcggtccgttacaagacttgagaatctgatgtggaaacagatcacgccggagctcaaccacatcctggccgaaaatgaggtgaagctgaccattatgacaggcgatatcaaagggattatgcaagctggaaagcgctctcttcggcctcagcccaccgaactcaagtacagctggaaaacatggggcaaggccaaaatgctgtccaccgagagctataaccagacgttcctgatcgacgggcctgaaaccgcggagtgccccaatacaaacagagcctggaactctctcgaggtcgaagattacggatttggcgtgttcaccacaaacatttggctgaaacttaaagagaagcaggacgctttttgtgactccaagctgatgagcgccgctatcaaagataatcgcgccgttcatgcggacatgggctattggatcgaatctgccctcaacgatacctggaagattgagaaggcttccttcatcgaggtgaagaattgccactggcctaaaagccatacactgtggtctaacggggtcctggaaagcgagatgattatccccaagaaccttgccggaccggtgtcccaacacaattaccggctcggctaccacacccagattgctgggccttggcatctgggaaagctggaaatggacttcgatttttgtgacggcacgacagtgatcgtcaccgaggattgcgggaacagaggacccagcctccgcaccacaaccgcctctggcaaactgattacggaatggtgctgtcggtcctgcacacttccccctctgagatatcggggcgaggacgggtgttggtacggaatggagatccgcccgctcaaggaaaaagaggaaaatctggttaacagcctggtgaccgccggccacggacaggtggataatttctcccttggagtcctcggcatggctctgtttctggaggaaatgctcagaacacgggtggggaccaagcatgcgatcctgcttgttgccgtgtctttcgtcacactgattaccggaaacatgagctttaaagacctcggcagagtggttgtgatggtcggcgctacgatggccgatgacatcgggatgggagtgacctatctggccctgcttgctgccttcaaggttcgccccacatttgcggctggcctgctcctgcggaagctcacctccaaagagctgatgatgacaaccattgggatcgtgcttctgtctcaaagcacgattcctgagacagtcctcgaactgaccgatgccctggcccttggaatgatggtgctgaagatcgtgagaaatatggagaaataccagctcgctgtcacaatcatggccattctgtgcgttcccaacgcggtgatcctccagaatgcttggaaggtgtcctgtaccattctggccgtcgtgtctgttagccctcttctgctcacctccagccagcagaagaccgactggatccccctggccctgacgattaagggccttaaccctaccgctatcttcctgacaaccctctctcgcacaaataaaaagagatcctggcccctgaacgaagccatcatggctgtggggatggtcagcattctcgcctcttccctgcttaagaatgacatcccgatgaccggacctctggtggcgggcggcctgctcacggtttgctatgtgctgacagggcggagcgccgatcttgagctggaacgcgctaccgacgtcaaatgggaggatcaggccgagatttctggatccagccccatcctctccattaccatcagcgaagacggctctatgagcattaagaacgaggaagaggagcagacactgaccatcctcatcagaacagggctgcttgtgatttccggactgtttcctatctctattcccatcacggctgccgcctggtacctgtgggaagtcaaaaagcagcgggctggcgtgctctgggatgttccgagccctccccctatggggaaagcggagctggaagacggagcctatcgcattaagcaaaagggcatccttggctactcccagatcggggctggagtgtacaaagagggcaccttccacacaatgtggcatgtcaccagaggggccgtgctgatgcacaagggaaaacggattgaaccctcttgggccgatgttaagaaagacctcatcagctatggcgggggatggaagctggagggcgagtggaaggaaggcgaggaagtgcaggtcctcgctctggagcccgggaaaaatcctcgcgccgtgcagacaaagccgggactttttaaaaccaacacgggcaccattggggcggtgtccctggatttctctcccggaacaagcggctcccctatcattgacaagaaagggaaggttgtcggactgtacggcaacggcgtggtgaccagaagcggggcttatgtctctgccatcgcccaaacagaaaagggaatcgaggataatcccgagattgaagacgatatctttcggaaacgcagactcaccattatggacctgcaccctggcgctgggaagacaaaacggtaccttcccgccatcgtgagagaggcgattaagcgcggactgcggacgctcatcctggctcctaccagagttgtggccgccgaaatggaggaagctctccgcggcctgccgattcggtatcagacacccgccatcagagctgagcataccgggcgcgagatcgtcgaccttatgtgtcacgccaccttcacaatgcggctgctgtcccctgtgagagttcccaactacaatctcattatcatggatgaagcgcatttcacggaccctgccagcattgctgcccgcggctatatctctacccgggtggagatgggagaagctgccggcatttttatgacagccacacccccggggtccagagatcctttcccccagagcaacgctcccatcatcgacgaggagcgggaaattcctgagcgctcctggaactctggacacgaatgggtcacagattttaaaggcaagaccgtgtggttcgttcccagcatcaaggcggggaacgacattgccgcttgcctgcgcaagaatggaaagaaagtgatccaactttcccggaagacgtttgatagcgagtacgtcaaaacacgcaccaacgactgggatttcgtggtgaccacagacatttctgaaatgggcgccaattttaaggccgagagagtcatcgatcctcggagatgtatgaaaccggttatcctgaccgacggggaggaacgcgtgattctcgctggccccatgcctgtgacacattccagcgccgcgcagcggagaggacgcatcggccggaaccccaagaatgagaacgaccagtacatttatatgggggaacctctggagaatgatgaagactgcgctcactggaaggaggccaaaatgctgctcgataacatcaatacccccgagggaattatcccgtctatgttcgaacctgagagagaaaaggtcgacgccattgatggcgagtaccgccttagaggggaagctagaaaaacgtttgtggacctgatgcgcagaggagatctgcccgtttggctcgcctataaggtggcggccgagggcatcaactacgctgaccggcgctggtgtttcgatgggatcaaaaacaatcagattctggaggaaaacgtcgaggtggaaatctggacaaaggagggcgagagaaagaaacttaagcctcggtggctggacgcccgcatttatagcgatcccctcgctctgaaagaatttaaggagttcgccgctggaagaaaatccctgaccctcaatcttatcacagaaatgggccggctgcctaccttcatgacgcaaaagaccagagacgccctggataacctcgcggttctgcacacagccgaggctgggggacgcgcctacaatcatgctctttctgaactgcccgagaccctcgagacactgctgctccttaccctgctggccacagtgaccggcgggatttttctcttcctgatgagcggacggggcatcggcaagatgacgcttgggatgtgctgcatcattacagcctccatcctgctctggtatgctcagattcagccgcactggatcgcggcctctattatcctggaatttttcctgatcgtcctccttattcctgagcccgaaaaacagagaacaccccaagacaaccagctgacctacgtggtcatcgctattctgacagtggttgccgccaccatggctaatgagatgggatttctcgaaaagaccaagaaggacttcggcctggggagcatcgccacgcagcagcctgagtccaacattcttgatatcgacctgcgcccggcgagcgcctggaccctctacgctgtggccacaacctttgtgacacccatgctgcggcattctattgaaaattccagcgtcaacgtttccctgaccgctatcgccaatcaagcgacggtgctcatgggacttggcaaagggtggcctctgtctaagatggatatcggagtgcccctgctcgccattggctgttatagccaggtcaaccctatcaccctgacagctgcccttctgctcctggtggctcactacgccattatcggccccgggctgcaggctaaggccaccagagaagcgcagaaacgggccgctgccggaattatgaagaatcctacagttgacggcatcaccgtgatcgatctcgacccgattccctatgatcctaaattcgagaagcaacttgggcaggtcatgctgctgatcctctgcgtgacgcaggtcctgatgatgcgcacaacctgggctctttgtgaagccctgacactcgccaccggacccatttccaccctgtgggagggcaaccctgggagattttggaatacaacgatcgcggtgtctatggctaacattttccggggaagctacctggccggcgctggcctcctcttttccatcatgaaaaataccacaaacacccgcagagggacaggaaacatcggcgaaaccctgggggagaagtggaaaagccggctgaatgccctcggaaagtctgagttccaaatttataagaaatccggcatccaggaagttgaccgcacgctggccaaggaggggattaaaagaggagaaacagatcaccatgctgtgagccggggctctgccaaacttcgctggtttgtcgagagaaacatggtgacccccgagggcaaagttgtggacctggggtgcggacggggcgggtggtcctactattgtggaggcctcaagaatgtcagagaagtgaaggggctgaccaaaggaggcccgggccacgaggaacctatccccatgagcacatacgggtggaacctggtgcgcctccagtctggagttgatgtcttcttcattccccctgagaagtgcgacacccttctgtgtgatatcggcgaaagctcccccaatcctacagtggaggcggggcggacgctgagagtgctcaacctggtcgagaattggcttaacaataacacccagttttgcatcaaagttctgaatccgtacatgccctctgtgattgaaaagatggaggccctccaacgcaaatatggaggcgctctggtgcggaaccctctgagcagaaattccacacatgaaatgtactgggtcagcaacgcctccgggaatatcgtgtctagcgttaacatgatttcccgcatgctcatcaaccggttcaccatgagacacaagaaggctacatatgagcccgacgtggaccttggatctggcacccgcaatattggcatcgaaagcgagattcctaacctggatatcatcgggaaacggattgagaagatcaaacaggaacatgagacgtcctggcactacgaccaggatcacccctataagacctgggcctaccatggatcttatgaaacaaaacagaccggcagcgcgtccagcatggtcaatggggtggttagactgctcacaaagccgtgggacgtgctgcctaccgtcacacaaatggccatgaccgatacgacaccctttggacagcagcgcgtgttcaaggagaaagtggacacccggacccaggaacctaaggagggcaccaagaaacttatgaaaattacggctgagtggctgtggaaagaactcgggaaaaagaagacccccagaatgtgtacacgcgaggaatttaccagaaaagtccggtctaacgccgctctgggagccatcttcacagatgagaataagtggaaatccgctcgcgaggccgttgaagacagcagattttgggagctggtggataaggaacggaacctccacctggagggcaaatgcgaaacctgtgtgtacaatatgatgggcaagagagagaagaaacttggggagttcggaaaggcgaaaggctctcgggccatttggtacatgtggctgggggctcgctttctcgagttcgaggccctgggatttcttaacgaagaccattggttctccagagagaatagcctgtctggcgtcgaaggggagggcctccacaagctgggatatatcctgcgggatgtgtccaaaaaggagggcggggctatgtacgccgacgacacagccggatgggatacccgcatcacgctcgaagacctgaagaacgaggaaatggttaccaatcacatggagggcgaacataagaaacttgcggaggctatttttaaactgacatatcaaaacaaagtggtcagagtgcagcggcctacccccagagggacagttatggatatcattagcagacgggaccagcgcggatccggccaagtggggacctacggcctcaatacgttcacaaacatggaggcccagctgatcagacagatggaaggagagggcgtcttcaaaaatattcagcaccttaccgtgacagaagaggttgccgtgcaaaactggctggctcgggtcgggcgcgagagactcagccggatggccatctctggagatgactgcgtggtcaagccgctggatgaccgctttgctaacgccctgaccgcgctcaatgatatgggcaagatcagaaaagacattcagcagtgggaacctagcaaggggtggaacgattggacgcaggtccccttctgctcccatcactttcatgagctgatcatgaaagacggacgggttcttgtggtcccctgtagaaatcaagatgaactgattggccgcgcccggatctctcagggggctggctggagcctcagagagaccgcctgcctgggaaagtcctatgctcagatgtggtctcttatgtacttccaccgccgggacctgagactcgccgcgaacgtgatttgtagcgccgtgccttcccactgggttccgacatctcgcaccacatggagcatccatgctaaacacgaatggatgaccacagaggacatgctgaccgtgtggaatcgggtctggattagagagaacccctggatggaagataagacgcctgtggagtcctgggaagagatcccctatctgggcaagcgcgaagaccagtggtgcgggagcctcatcggactgacatctcgggccacctgggctaaaaatattcaagccgctatcaaccaggttagatcccttattggcaatgaggagtacaccgattacatgcctagcatgaagcgctttcggagagaagaggaagaggccggggtgctgtggtga

SEQ ID NO: 20044 - RNA, 9876 nt, synthetic construct
  misc_feature 1..9876: note = derived and/or modified CDS sequence (opt5) from DENV-2__EU687249__SS-prME
  source 1..9876: mol_type = other RNA
agcgccggcatgatcattatgctgatccccaccgtgatggctttccacctgacaacgagaaatggggaacctcatatgattgtcggaatccaggaaaagggcaagtccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacattctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcgggaagaggggatttgtggcatcagatccgtgacacgccttgagaatctgatgtggaaacagatcacgccggaactcaaccacattctggccgagaatgaagttaagctgaccatcatgacaggagatattaaaggcatcatgcaggctgggaagcggtctcttagacctcaacccaccgagctcaagtacagctggaaaacatggggaaaggccaaaatgctgtccaccgaaagctataaccagacgttcctgattgacggccctgagaccgcggagtgccccaatacaaaccgcgcctggaactctctcgaagtggaggattacgggtttggagtcttcaccacaaacatctggctgaaacttaaagaaaagcaggacgctttttgtgactccaagctgatgagcgccgctatcaaagataatcgggccgtgcatgcggacatgggctattggattgagtctgccctcaacgatacctggaagatcgagaaggctagcttcattgaagttaagaattgccactggcctaaaagccatacactgtggtctaacggcgtgctggagagcgaaatgatcattcccaagaaccttgccgggccggtctcccagcacaattacagacctggataccacacccaaatcgctggcccctggcatctcgggaagctggagatggacttcgatttttgtgacggaacgacagtgattgtgaccgaagattgcggcaaccgcgggcccagcctgcggaccacaaccgcctctggaaaactcatcacggagtggtgctgtagatcctgcacactgcctccgcttcggtatcgcggcgaggacggctgttggtacgggatggaaatcagacccctgaaggagaaagaagagaatctcgtcaacagcctggttaccgccggacacggccaggtggataatttctccctgggggtgcttggaatggctctctttctggaagagatgctgcggacaagagtcggcaccaagcatgcgattctcctggtggccgtttctttcatgacacttatcaccgggaacatgagctttaaagacctgggacgcgtggtcgtgatggttggcgctacgatggccgatgacattggcatgggggtgacctatctcgccctgctggctgccttcaaggtccggcctacatttgcggctggacttctgctcagaaagctgacctccaaagagctcatgatgacaaccatcggcattgtgctgctttctcagagcacgatccccgaaacagttctggagctcaccgatgccctggccctggggatgatggtgcttaagatcgtccgcaatatggaaaaataccaactggctgtgacaattatggccatcctctgcgtgcctaacgcggtcattctgcagaatgcttggaaggtttcctgtaccatcctcgccgtggtgtctgtcagccccctgcttctgacctccagccagcagaaaacagactggattcctctcgccctgacgatcaagggactgaaccccaccgctatcttccttacaaccctgtctagaacaaataaaaagcggtcctggccgctcaacgaggccattatggctgtgggcatggttagcatcctggcctcttccctcctgaagaatgacattcctatgaccgggccccttgtggcgggaggcctgctgacggtctgctatgtgctcacaggccgcagcgccgatctggaacttgagagagctaccgacgttaaatgggaggatcaagccgaaatctctgggtccagccctattctgtccatcaccattagcgaggacggatctatgagcatcaagaacgaagaggaggaacagacactcaccatcctgattcggacaggcctcctggtgatctccgggctttttcccatttctatcccgattacggctgccgcctggtacctgtgggaggtcaaaaagcagcgcgctggagtgctgtgggatgtcccttctccccctcccatgggcaaagcggaactcgaggacggggcctatagaatcaagcagaagggaatcctgggctactcccaaattggcgctggggtgtacaaagaaggaaccttccacacaatgtggcatgttacccggggcgccgtgcttatgcacaaggggaaacgcatcgagccctcctgggccgatgtcaagaaagacctgattagctatggaggcgggtggaagctcgagggagaatggaaggagggcgaagaggtgcaggttctggctctcgaacctggcaaaaatccgagagccgtgcagacaaagcccgggctgtttaaaaccaacacgggaaccatcggcgcggtctcccttgatttctctcctgggacaagcggatcccccattatcgacaagaaaggcaaggtggtggggctgtacggaaacggcgttgtcacccggagcggcgcttatgtgtctgccatcgcccagacagagaagtccattgaggataatcctgaaatcgaggacgatatttttcgcaaaagacggctgaccatcatggacctccaccccggggctggaaagacaaaaagatacctgcctgccattgtgcgcgaagcgatcaagcggggccttagaacgctgattctcgctccgacccgcgtcgtggccgccgagatggaagaggctctgcgggggctccccatcagatatcaaacccctgccatccgcgctgagcataccggacgggaaattgttgacctgatgtgtcacgccaccttcacaatgagacttctgagccccgtgcgcgtccctaactacaatctgatcattatggatgaggcgcatttcacggaccccgcctctatcgctgcccggggctatatttccaccagagtggaaatgggggaggctgccggcatctttatgacagccaccccgcctggaagccgggatcccttcccccagtccaacgctcctatcattgacgaggaacgcgagatccccgaaagatcttggaatagcggccacgagtgggttacagattttaaagggaagaccgtgtggttcgtcccttccattaaggcgggaaacgacatcgccgcttgcctccggaaaaatggcaagaaagtgattcagctgagccgcaagacgtttgattctgaatacgttaaaacaagaaccaacgactgggatttcgtggtcaccacagacatctccgagatgggggccaattttaaggccgagcgggtgatcgatccgagacgctgtatgaaacccgtgattcttaccgacggagaggaacgggtcatcctggctggccctatgcccgttacacatagctctgccgcgcaaagacgcgggcggattggcagaaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaacgcgagaaggtggacgccatcgatggggaataccggctcagaggagaggctcgcaaaacgtttgtggaccttatgagacggggcgatctgcctgtctggctggcctataaggtggcggccgaggggatcaactacgctgaccgcagatggtgtttcgatggaattaaaaacaatcagatcctcgaagagaacgttgaagtggagatttggacaaaggagggcgaacggaagaaactgaagccccgctggcttgacgccagaatctattccgatcctctggctctcaaagagtttaaggagttcgccgctgggcggaaatctctgaccctgaatctcattacagagatgggcagacttcccaccttcatgacgcagaagacccgcgacgccctggataacctggcggtcctccacacagccgaagctggaggccgggcctacaatcatgctctgagcgagcttccggagaccctggaaacactcctgctgctcacccttctggccacagtgaccgggggaatctttctgttcctcatgtccggcagagggatcggaaagatgacgctgggcatgtgctgcattatcacagcctctattcttctgtggtatgctcaaatccagcctcactggattgcggccagcatcatcctcgagtttttcctgattgttctgctcatccccgaacccgagaaacagcgcacccctcaggacaaccaacttacctacgtggtcattgctatcctgacagtggtcgccgccaccatggctaatgaaatgggctttctggagaagaccaagaaggacctcgggctgggatccattgccacgcagcagccggagagcaacatccttgatattgacctgcggcccgcgtctgcctggaccctctacgctgtggccacaaccttcgttacacctatgctgagacattccatcgaaaatagctccgtgaacgtgtctctgaccgctatcgccaatcaggcgacggtcctcatgggccttgggaaaggatggcccctgagcaagatggatattggcgttcctctgctcgccatcgggtgttattcccaagtgaaccccattaccctgacagctgcccttctgctcctggtggctcactacgccatcattggacctggcctgcaggctaaggccacccgggaggcgcagaaacgcgccgctgccggcatcatgaagaatccgacagtcgacgggatcaccgtgattgatctcgaccccatcccttatgatcccaaatttgaaaagcagcttggacaagttatgctgctgattctctgcgtgacgcaggtcctgatgatgagaacaacctgggctctttgtgaggccctgacactcgccaccggccctatctctaccctgtgggaagggaaccccggacggttctggaatacaacgattgcggtgagcatggctaacatctttcgcggctcctacctggccggggctggactccttttcagcatcatgaaaaataccacaaacaccagacggggcacaggcaacattggggagaccctgggagagaagtggaaatctcgcctgaatgccctcggcaagtccgaatttcagatctataagaaaagcgggattcaagaggtcgacagaacgctggccaaggaaggaatcaaacggggcgagacagatcaccatgctgtgtctcgcgggtccgccaaacttagatggttcgttgagcggaacatggtgaccccggaaggaagagtcgtggacctgggctgcggccgcgggggatggagctactattgtggcgggctcaaaaatgttcgggaggtgaagggactgaccaagggcgggcctggacacgaagaacccattcccatgtctacatacggctggaacctggtcagactccagagcggcgtggatgtgtttttcatccctcccgaaaaatgcgacacccttctgtgtgatatcggggagtcctctcctaatccgacagttgaggcgggacgcacgctgcgggtcctcaacctggtggaaaattggcttaacaataacacccagttctgcattaaggtgctgaatccctacatgcctagcgtcatcgagaaaatggaagccctccagagaaagtatggcggggctctggttcgcaaccccctgtcccggaatagcacacatgagatgtactgggtgtccaacgcctctggaaatattgtgagctccgtcaacatgatctctagaatgctcattaaccgctttaccatgcggcacaaaaaggctacatatgaacctgacgtggaccttggcagcgggaccagaaatatcggaattgagtccgaggttcccaacctggatatcatcggcaagcgcattgagaagatcaagcaagagcatgaaacgtcttggcactacgaccaggatcacccgtataaaacctgggcctaccatggcagctatgagacaaagcagaccgggtccgcgagctctatggtgaatggagtcgtgcggctgctcacaaaaccttgggacgttctgcccaccgtgacacagatggccatgaccgatacgacacctttcggccaacagagagtctttaaggaaaaggtggacacccgcacccaggagcccaaagaggggacaaagaaacttatgaagattacggctgaatggctgtggaaagagctcggaaagaaaaagacccctagaatgtgtacacgggaagagttcacccgcaaggtgagatccaacgccgctctgggcgccatctttacagatgagaataaatggaaaagcgctcgggaagccgtcgaggactctagattctgggaactggttgataaagagcggaacctccacctggaagggaagtgcgagacctgtgtgtacaatatgatgggaaaacgcgagaagaaacttggcgaatttggcaaagcgaaggggtccagagccatttggtacatgtggctgggagctcggttcctcgagtttgaagccctgggcttccttaacgaggaccattggtttagccgcgaaaattctctgtccggggtggagggagagggcctccacaaactggggtatatcctgagagatgtcagcaagaaagaaggcggagctatgtacgccgacgacacagccggctgggatacccggatcacgctcgaggacctgaagaacgaagagatggtgaccaatcacatggaaggggagcataagaaacttgcggaggctattttcaagctgacatatcagaacaaagttgtgcgcgtccaaagacccaccccgcggggaacagtgatggatatcatttcccgcagagaccagcggggcagcgggcaggttggaacctacggcctcaatacgtttacaaacatggaagcccaactgatccgccagatggagggggaaggcgtgttcaagaatattcagcaccttaccgtcacagaggaggtggccgttcagaactggctggctagagtgggacgggaacgcctctctagaatggccatcagcggcgatgactgcgtcgtgaaacctctggatgaccggttcgctaacgccctgaccgcgctcaatgatatggggaagatcagaaaggacattcaacagtgggagccctccaaaggatggtctgattggacgcaggtccccttttgcagccatcacttccatgaactgatcatgaaggacggccgcgtgcttgttgtgccttgtcggaaccaggatgagctgattgggagagcccgcatctcccaaggagctggctggtctctccgggaaaccgcctgcctggggaaaagctatgctcagatgtggtcccttatgtactttcacagacgcgacctgcggctcgccgcgaatgccatttgttctgctgtcccgagccactgggtgcccacatccagaaccacatggagcatccatgccaagcacgagtggatgaccacagaggacatgctgaccgtgtggaaccgcgtttggattcgggaaaatccttggatggaggataaaacgcccgtggaatcttgggaggaaatcccttatctgggcaagagagaggaccagtggtgcggatccctcatcggcctgacaagccgcgctacctgggccaagaacattcaggctgccatcaatcaagtccggtctcttattgggaacgaggaatacaccgattacatgccctccatgaaaagattccggagagaggaagaggaagcgggagtgctgtggtga

SEQ ID NO: 20045 - RNA, 9876 nt, synthetic construct
  misc_feature 1..9876: note = derived and/or modified CDS sequence (opt5) from DENV-2__EU660416__SS-prME
  source 1..9876: mol_type = other RNA
agcgctggcatgatcattatgctgatccccaccgtgatggctttccacctgacgacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgaaagacgctacgtgctgggacggctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagcgcatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccggagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattagatccgttacacgccttgagaatctgatgtggaagcagatcacgccggaactcaaccacatcctggccgagaatgaagtgaaactgaccattatgacaggagatatcaagggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcatgaaacatgcgatcctcctggttgccgtgtctttcgtcacccttattacagggaacatgagctttaaggacctgggacgcgtggttgtgatggtcggcgctaccatggccgatgacatcggcatgggggtgacgtatctcgccctgctggctgccttcaaagttcggcctacctttgcggctggacttctgctcagaaagctgacatccaaggagctcatgatgaccacaattggcatcgtgctgctttctcaaagcaccattcccgaaacggtcctggagctcacagatgccctggccctggggatgatggtgcttaaaatcgtgcgcaatatggaaaagtaccagctggctgtcaccatcatgacaattctctgcgttcctaacgccgtgatcctgcagaatgcgtggaaagtgtcctgtaccattctcgctgtcgtgtctgttagccccctgcttctgacctccagcagacagaagacagactggatccctctcgccctgacgattaaaggactgaaccccaccgccatcttccttacaaccctgtctcggacaaataagaaacgctcctggccgctcaacgaggctatcatggccgtgggcatggtcagcattctggcttcttccctcctgaagaatgacatccctatgaccgggccccttgtggccggaggcctgctgacggtttgctatgtgctcacaggcagaagcgcggatctggaacttgagcgggccaccgacgtcaagtgggaggatcaagctgaaatttctgggtccagccctatcctgtccattaccatcagcgaggacggatctatgagcattaaaaacgaagaggaggaacagacactcaccatcctgatccgcacaggcctcctggtgatttccgggctttttcccatctctattccgatcacggccgctgcctggtacctgtgggaggtcaagaaacagagagccggagtgctgtgggatgttccttctccccctcccatgggcaaggctgaactcgaggacggggcgtatcggattaaacagaagggaatcctgggctactcccaaatcggcgccggggtgtacaaggaaggaaccttccacacaatgtggcatgtcacccgcggcgctgtgcttatgcacaaagggaagagaattgagccctcctgggccgatgttaaaaaggacctgatcagctatggaggcgggtggaaactcgagggagaatggaaggagggcgaagaggtgcaggtcctggccctcgaacctggcaagaatccgcgggctgtgcagacaaaacccgggctgtttaagaccaacacgggaaccattggcgccgtgtcccttgatttctctcctgggacaagcggatcccccatcattgacaaaaagggcaaagttgtcgggctgtacggaaacggcgtggtgacccgcagcggcgcgtatgtctctgctatcgcccagacagagaagtccatcgaggataatcctgaaattgaggacgatatctttagaaagcggagactgaccattatggacctccaccccggggccggaaaaacaaagcgctacctgcctgctatcgtgcgggaagccattaaaagaggccttcgcacgctgatcctcgcgccgacccgggttgtggctgccgagatggaagaggccctgagagggctccccattcgctatcaaacccctgctatccgggccgagcataccggaagagaaatcgtcgacctgatgtgtcacgctaccttcacaatgcgccttctgagccccgtgcgggttcctaactacaatctgattatcatggatgaggcccatttcacggaccccgcgtctattgccgctagaggctatatctccacccgggtggaaatgggggaggccgctggcatttttatgacagccaccccgcctggaagccgcgatcccttcccccagtccaacgcccctatcatcgacgaggaaagagagattcccgaacggtcttggaatagcggccacgagtgggtcacagattttaaggggaaaaccgtgtggttcgttccttccatcaaggctggaaacgacattgcggcctgcctccgcaagaatggcaaaaaggtgatccagctgagcagaaaaacgtttgattctgaatacgtcaagacacggaccaacgactgggatttcgtggtgaccacagacatttccgagatgggggctaattttaaagccgagagagtcatcgatccgcgccggtgtatgaagcccgttatccttaccgacggagaagagagagtgattctggccggccctatgcccgtgacacatagctctgctgcccaacgccgggggagaatcggccgcaaccctaaaaatgaaaacgaccagtacatttatatgggagagcccctcgaaaatgatgaggactgcgcgcactggaaggaggctaagatgctgctggataacatcaataccccggaaggcattatccctagcatgttcgagcccgaacgggagaaagtcgacgccattgatggggaatacagactccgcggagaggccagaaagacgtttgtggaccttatgcggcgcggcgatctgcctgtttggctggcttataaagtggccgcggaggggatcaactacgccgacagacggtggtgtttcgatggaatcaagaacaatcagattctcgaagagaacgtcgaagtggagatctggacaaaagagggcgaacgcaagaagctgaaacccagatggcttgacgctcggatttattccgatcctctggccctcaaggagtttaaagagttcgctgccgggagaaagtctctgaccctgaatctcatcacagagatgggccgccttcccaccttcatgacgcagaaaacccgggacgctctggataacctggccgttctccacacagcggaagccggaggcagagcttacaatcatgccctgagcgagcttccggagaccctggaaacactcctgctgctcacccttctggctacagtgaccgggggaatttttctgttcctcatgtccggccgcgggatcggaaagatgacgctgggcatgtgctgcatcattacagcctctatccttctgtggtatgcccaaattcagcctcactggatcgctgcgagcattatcctcgagtttttcctgatcgtcctgctcattcccgaacccgagaagcagcggacccctcaggacaaccaacttacctacgtggtcatcgccattctgacagtggttgctgccaccatggccaatgaaatgggctttctggagaaaacaaagaaagacctcgggctgggatccatcgctacgcagcagccggagagcaacattcttgatatcgacctgagacccgcctctgcgtggaccctctacgccgtggctacaaccttcgtgacacctatgctgcggcattccattgaaaatagctccgtcaacgtttctctgaccgccatcgctaatcaggccacggtgctcatgggccttgggaagggatggcccctgagcaaaatggatatcggcgtgcctctgctcgcgattgggtgttattcccaagtcaaccccatcaccctgacagccgcccttctgctcctggtggcccactacgctattatcggacctggcctgcaggccaaggctacccgcgaggcccagaagagagcggccgctggcattatgaaaaatccgacagttgacgggatcaccgtgatcgatctcgaccccattccttatgatcccaagtttgaaaaacagcttggacaagtcatgctgctgatcctctgcgtgacgcaggtcctgatgatgcggacaacctgggccctttgtgaggctctgacactcgccaccggccctatttctaccctgtgggaagggaaccccggacgcttctggaatacaacgatcgccgtgagcatggcgaacatttttagaggctcctacctggctggggccggactccttttcagcatcatgaagaataccacaaacacccggcgcggcacaggcaacatgggggagaccctgggagagaaatggaagtctagactgaatgctctcggcaaatccgaatttcagatctataaaaagagcgggattcaagaggttgaccggacgctggccaaagaaggaatcaagcgcggcgagacagatcaccatgccgtgtctagagggtccgctaaacttcggtggttcgtcgagagaaacatggtgaccccggaaggaaaggttgtggacctgggctgcggccgcgggggatggagctactattgtggcgggctcaaaaatgtccgggaggtgaagggactgaccaagggcgggcctggacacgaagaacccattcccatgtctacatacggctggaacctggtgagactccagagcggcgttgatgtctttttcatccctcccgaaaaatgcgacacccttctgtgtgatattggggagtcctctcctaatccgacagtggaggccggacgcacgctgcgggtgctcaacctggtcgaaaattggcttaacaataacacccagttctgcatcaaggttctgaatccctacatgcctagcgtgatcgagaaaatggaagcgctccagagaaagtatggcggggccctggtgcgcaaccccctgtcccggaatagcacacatgagatgtactgggtctccaacgcttctggaaatattgtgagctccgttaacatgatctctagaatgctcattaaccgctttaccatgcggcacaaaaaggccacatatgaacctgacgtggaccttggcagcgggaccagaaatatcggaattgagtccgagatccccaacctggatattatcggcaagcgcatcgagaagattaagcaagagcatgaaacgtcttggcactacgaccaggatcacccgtataaaacctgggcttaccatggcagctatgagacaaagcagaccgggtccgccagctctatggtcaatggagtggttcggctgctcacaaaaccttgggacgtgctgcccaccgtcacacagatggcgatgaccgatacgacacctttcggccaacagagagtgtttaaggaaaaggtggacacccgcacccaggagcccaaagaggggacaaagaaacttatgaagatcacggccgaatggctgtggaaagagctcggaaagaaaaagacccctagaatgtgtacacgggaagagttcacccgcaaggtcagatccaacgctgccctgggcgctatttttacagatgagaataaatggaaaagcgcccgggaagctgttgaggactctagattctgggaactggtggataaagagcggaacctccacctggaagggaagtgcgagacctgtgtgtacaatatgatgggaaaacgcgagaagaaacttggcgaatttggcaaagccaaggggtccagagcgatctggtacatgtggctgggagcccggttcctcgagtttgaagctctgggcttccttaacgaggaccattggtttagccgcgaaaattctctgtccggggtcgagggagagggcctccacaaactggggtatattctgagagatgtgagcaagaaagaaggcggagccatgtacgctgacgacacagccggctgggatacccggatcacgctcgaggacctgaagaacgaagagatggttaccaatcacatggaaggggagcataagaaacttgccgaggcgatcttcaagctgacatatcagaacaaagtggtccgcgtgcaaagacccaccccgcggggaacagttatggatattatctcccgcagagaccagcggggcagcgggcaggtcggaacctacggcctcaatacgtttacaaacatggaagctcaactgattcgccagatggagggggaaggcgtcttcaagaatatccagcaccttaccgtgacagaggaggttgccgtgcagaactggctggccagagtcggacgggaacgcctctctagaatggctattagcggcgatgactgcgtggtcaaacctctggatgaccggttcgccaacgctctgaccgccctcaatgatatggggaagatcagaaaggacatccaacagtgggagccctccaaaggatggaacgattggacacaggtgcccttttgctctcatcacttccatgaactgattatgaaggacggccgcgttcttgtggtcccttgtcggaatcaggatgagctgatcgggagagcgcgcattagccaaggagccggctggtccctccgggaaaccgcttgcctggggaaatcttatgcccagatgtggagccttatgtactttcacagacgcgacctgcggctcgctgccaacgcgatctgttccgccgtgccgtctcactgggtgcccacaagcagaaccacatggtccattcatgctaagcacgagtggatgaccacagaggacatgctgaccgtttggaataaagtgtggatccgcgaaaacccttggatggaggataagacgcccgtcgaaagctgggaggaaattccttatctgggcaagcgggaggaccagtggtgcggatctctcatcggcctgacatccagagccacctgggctaaaaatatccaggccgctattaaccaagtgcgcagccttatcgggaatgaggaatacaccgattacatgccctctatgaagcggttcagacgggaggaagaggaagccggagttctgtggtga

SEQ ID NO: 20046 - RNA, 9876 nt, synthetic construct
  misc_feature 1..9876: note = derived and/or modified CDS sequence (opt5) from DENV-2__EU660417__SS-prME
  source 1..9876: mol_type = other RNA
agcgctggcatgatcattatgctgatccccaccgtgatggctttccacctgaccacgagaaatggggagcctcatatgattgtcggaatccaggaaaagggcaagagcctgctttttaagaccgaggacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgaaagacgctacgtgctgggacggctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagcgcatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccggagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattagatccgttacacgccttgagaatctgatgtggaagcagatcacgccggaactcaaccacatcctggccgagaatgaagtgaaactgaccattatgacaggagatatcaagggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttattaccgggaacatgagctttaaggacctgggacgcgtggttgtgatggtcggcgctacgatggccgatgacatcggcatgggggtgacctatctcgccctgctggctgccttcaaagttcggcctacatttgcggctggacttctgctcagaaagctgacctccaaggagctcatgatgacaaccattggcatcgtgctgctttctcaaagcacgattcccgaaacagtcctggagctcaccgatgccctggccctggggatgatggtgcttaaaatcgtgcgcaatatggaaaagtaccagctggctgtcacaatcatgaccattctctgcgttcctaacgccgtgatcctgcagaatgcgtggaaagtgtcctgtaccattctcgctgtcgtgtctgttagccccctgcttctgacatccagcagacagaagacggactggatccctctcgccctgaccattaaaggactgaaccccacagccatcttccttaccacactgtctcggaccaataagaaacgctcctggccgctcaacgaggctatcatggccgtgggcatggtcagcattctggcttcttccctcctgaagaatgacatccctatgacggggccccttgtggccggaggcctgctgacagtttgctatgtgctcaccggcagaagcgcggatctggaacttgagcgggccaccgacgtcaagtgggaggatcaagctgaaatttctgggtccagccctatcctgtccattacaatcagcgaggacggatctatgagcattaaaaacgaagaggaggaacagaccctcacaatcctgatccgcacgggcctcctggtgatttccgggctttttcccatctctattccgatcaccgccgctgcctggtacctgtgggaggtcaagaaacagagagccggagtgctgtgggatgttccttctccccctcccatgggcaaggctgaactcgaggacggggcgtatcggattaaacagaagggaatcctgggctactcccaaatcggcgccggggtgtacaaggaaggaacattccacaccatgtggcatgtcacacgcggcgctgtgcttatgcacaaagggaagagaattgagccctcctgggccgatgttaaaaaggacctgatcagctatggaggcgggtggaaactcgagggagaatggaaggagggcgaagaggtgcaggtcctggccctcgaacctggcaagaatccgcgggctgtgcagaccaaacccgggctgtttaagacgaacaccggaacaattggcgccgtgtcccttgatttctctcctgggaccagcggatcccccatcattgacaaaaagggcaaagttgtcgggctgtacggaaacggcgtggtgacacgcagcggcgcgtatgtctctgctatcgcccagaccgagaagtccatcgaggataatcctgaaattgaggacgatatctttagaaagcggagactgacaattatggacctccaccccggggccggaaaaacgaagcgctacctgcctgctatcgtgcgggaagccattaaaagaggccttcgcaccctgatcctcgcgccgacacgggttgtggctgccgagatggaagaggccctgagagggctccccattcgctatcaaacccctgctatccgggccgagcataccggaagagaaatcgtcgacctgatgtgtcacgctacattcacgatgcgccttctgagccccgtgcgggttcctaactacaatctgattatcatggatgaggcccatttcaccgaccccgcgtctattgccgctagaggctatatctccacacgggtggaaatgggggaggccgctggcatttttatgaccgccacaccgcctggaagccgcgatcccttcccccagtccaacgcccctatcatcgacgaggaaagagagattcccgaacggtcttggaatagcggccacgagtgggtcaccgattttaaggggaaaacggtgtggttcgttccttccatcaaggctggaaacgacattgcggcctgcctccgcaagaatggcaaaaaggtgatccagctgagcagaaaaacatttgattctgaatacgtcaagacccggaccaacgactgggatttcgtggtgacaaccgacatttccgagatgggggctaattttaaagccgagagagtcatcgatccgcgccggtgtatgaagcccgttatccttacagacggagaagagagagtgattctggccggccctatgcccgtgacccatagctctgctgcccaacgccgggggagaatcggccgcaaccctaaaaatgaaaacgaccagtacatttatatgggagagcccctcgaaaatgatgaggactgcgcgcactggaaggaggctaagatgctgctggataacatcaatacgccggaaggcattatccctagcatgttcgagcccgaacgggagaaagtcgacgccattgatggggaatacagactccgcggagaggccagaaagacatttgtggaccttatgcggcgcggcgatctgcctgtttggctggcttataaagtggccgcggaggggatcaactacgccgacagacggtggtgtttcgatggaatcaagaacaatcagattctcgaagagaacgtcgaagtggagatctggaccaaagagggcgaacgcaagaagctgaaacccagatggcttgacgctcggatttattccgatcctctggccctcaaggagtttaaagagttcgctgccgggagaaagtctctgacactgaatctcatcaccgagatgggccgccttcccacgttcatgacccagaaaacacgggacgctctggataacctggccgttctccacaccgcggaagccggaggcagagcttacaatcatgccctgagcgagcttccggagacactggaaaccctcctgctgctcacacttctggctaccgtgacagggggaatttttctgttcctcatgtccggccgcgggatcggaaagatgacactgggcatgtgctgcatcattaccgcctctatccttctgtggtatgcccaaattcagcctcactggatcgctgcgagcattatcctcgagtttttcctgatcgtcctgctcattcccgaacccgagaagcagcggacccctcaggacaaccaacttacatacgtggtcatcgccattctgaccgtggttgctgccacaatggccaatgaaatgggctttctggagaaaacgaagaaagacctcgggctgggatccatcgctacccagcagccggagagcaacattcttgatatcgacctgagacccgcctctgcgtggacactctacgccgtggctaccacattcgtgacccctatgctgcggcattccattgaaaatagctccgtcaacgtttctctgacggccatcgctaatcaggccaccgtgctcatgggccttgggaagggatggcccctgagcaaaatggatatcggcgtgcctctgctcgcgattgggtgttattcccaagtcaaccccatcacactgaccgccgcccttctgctcctggtggcccactacgctattatcggacctggcctgcaggccaaggctacacgcgaggcccagaagagagcggccgctggcattatgaaaaatccgaccgttgacgggatcacggtgatcgatctcgaccccattccttatgatcccaagtttgaaaaacagcttggacaagtcatgctgctgatcctctgcgtgacacaggtcctgatgatgcggaccacatgggccctttgtgaggctctgaccctcgccaccggccctatttctacactgtgggaagggagccccggacgcttctggaacacgaccatcgccgtgtccatggcgaatatttttagaggcagctacctggctggggccggactccttttctctatcatgaagaacacaaccaatacacggcgcggcaccggcaacatgggggagacgctgggagagaaatggaagtccagactgaacgctctcggcaaaagcgaatttcagatctataagaagtctgggattcaagaggttgaccggacactggccaaagaaggaatcaagcgcggcgagaccgatcaccatgccgtgtccagagggagcgctaaacttcggtggttcgtcgagagaaatatggtgaccccggaaggaaaggttgtggacctgggctgcggccgcgggggatggtcttactattgtggcgggctcaaaaacgtccgggaggtgaagggactgacaaagggcgggcctggacacgaagaacccattcccatgagcacctacggctggaatctggtgagactccagtccggcgttgatgtctttttcatccctcccgaaaaatgcgacacacttctgtgtgatattggggagtctagccctaacccgacggtggaggccggacgcaccctgcgggtgctcaatctggtcgaaaactggcttaataacaatacacagttctgcatcaaggttctgaacccctacatgccttccgtgatcgagaaaatggaagcgctccagagaaagtatggcggggccctggtgcgcaatcccctgagccggaactccacccatgagatgtactgggtctctaatgctagcggaaacattgtgtcctctgttaatatgatcagcagaatgctcattaaccgctttacaatgcggcacaaaaaggccacctatgaacctgacgtggaccttggctccgggacgagaaacatcggaattgagtctgagatccccaatctggatattatcggcaagcgcatcgagaagattaagcaagagcatgaaaccagctggcactacgaccaggatcacccgtataaaacatgggcttaccatggctcctatgagaccaagcagacagggagcgcctcttccatggtcaacggagtggttcggctgctcaccaaaccttgggacgtgctgcccacagtcacccagatggcgatgacggatacaacccctttcggccaacagagagtgtttaaggaaaaggtggacacccgcacacaggagcccaaagaggggacgaagaaacttatgaagatcaccgccgaatggctgtggaaagagctcggaaagaaaaagacacctagaatgtgtacccgggaagagttcacacgcaaggtcagaagcaatgctgccctgggcgctatttttaccgatgagaacaaatggaagtctgcccgggaagctgttgaggactccagattctgggaactggtggataaagagcggaatctccacctggaagggaagtgcgagacatgtgtgtacaacatgatgggaaaacgcgagaagaaacttggcgaatttggcaaagccaaggggagcagagcgatctggtacatgtggctgggagcccggttcctcgagtttgaagctctgggcttccttaatgaggaccattggttttctcgcgaaaactccctgagcggggtcgagggagagggcctccacaaactggggtatattctgagagatgtgtccaagaaagaaggcggagccatgtacgctgacgacaccgccggctgggatacgcggatcaccctcgaggacctgaagaatgaagagatggttacaaaccacatggaaggggagcataagaaacttgccgaggcgatcttcaagctgacctatcagaataaagtggtccgcgtgcaaagacccacaccgcggggaaccgttatggatattatcagccgcagagaccagcggggctctgggcaggtcggaacgtacggcctcaacacatttaccaatatggaagctcaactgattcgccagatggagggggaaggcgtcttcaagaacatccagcaccttacagtgaccgaggaggttgccgtgcagaattggctggccagagtcggacgggaacgcctcagcagaatggctatttccggcgatgactgcgtggtcaaacctctggatgaccggttcgccaacgctctgacggccctcaacgatatggggaagatcagaaaggacatccaacagtgggagccctctaaaggatggaatgattggacccaggtgcccttttgcagccatcacttccatgaactgattatgaaggacggccgcgttcttgtggtcccttgtcggaaccaggatgagctgatcgggagagcgcgcatttcccaaggagccggctggtctctccgggaaacagcttgcctggggaaaagctatgcccagatgtggtcccttatgtactttcacagacgcgacctgcggctcgctgccaatgcgatctgttctgccgtgccgagccactgggtgcccacctccagaacaacctggagcattcatgctaagcacgagtggatgacaaccgaggacatgctgacggtttggaacaaagtgtggatccgcgaaaatccttggatggaggataagacacccgtcgaatcttgggaggaaattccttatctgggcaagcgggaggaccagtggtgcggatccctcatcggcctgaccagcagagccacctgggctaaaaacatccaggccgctattaatcaagtgcgctctcttatcgggaacgaggaatacacagattacatgccctccatgaagcggttcagacgggaggaagaggaagccggagttctgtggtga

SEQ ID NO: 20047 - RNA, 9876 nt, synthetic construct
  misc_feature 1..9876: note = derived and/or modified CDS sequence (opt5) from DENV-2__EU677137__SS-prME
  source 1..9876: mol_type = other RNA
agcgccggcatgatcattatgctgatccccaccgtcatggctttccacctgaccacgcggaatggggagcctcatatgattgtcggaatccaggaaaagggcaaatccctgctttttaagaccgaggacggggttaatatgtgcacgctgatggccatggatctcggagaactgtgtgaggacaccattacatacaaatgcccgcttctgcggcaaaacgaacccgaggatatcgactgttggtgcaattctacctccacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgaccgtcaccgaagattgcggcagcagagggccctctctgcgcacaaccacggcctccggaaagctcatcacagagtggtgctgtcggagctgcaccctgcctccgcttagatatcggggcgaggacggctgttggtacgggatggaaattcgccccctgaaagagaaggaagagaacctcgttaattccctggtgacagccggacacggccaagtggataacttctctctgggggtccttggaatggctctctttctggaagagatgctgagaacccgggtgggcacaaaacatgcgatcctcctggttgccgtgagcttcgtcacccttatcacggggaatatgtcctttaaggacctgggaagagtggttgtgatggtcggcgctaccatggccgatgacattggcatgggggtgacatatctcgccctgctggctgccttcaaagttcgccctacctttgcggctggacttctgctccggaagctgacatctaaggagctcatgatgaccacgatcggcattgtgctgcttagccagtccacaatccccgaaaccgtcctggagctcacagatgccctggccctggggatgatggtgcttaaaattgtgagaaacatggaaaagtaccagctggctgtcaccatcatggccatcctctgcgttcctaatgcggtgattctgcagaacgcttggaaagtgtcttgtaccatcctcgccgtcgtgagcgttagccccctgcttctgacaagctctcaacagaagacggactggattcctctcgccctgaccgtgaaaggactgaatcccacagctatcttccttaccacactgtcccgcaccaacaagaaaagaagctggccgctcaatgaggccattatggctgtcggcatggtgtctatcctggcctccagcctcctgaagaacgacatccctatgacggggccccttgttgcgggaggcctgctgacagtgtgctatgtcctcaccggccggtctgccgatctggaacttgagcgcgctaccgacgtgaagtgggaggatcaggccgaaatttccgggagctcccctatcctgagcattacaatctctgaggacggaagcatgtccattaaaaatgaagaggaggaacagaccctcacaatcctgattagaacgggcctcctggtcatctctgggctttttcccatcagcattccgatcaccgctgccgcctggtacctgtgggaggtgaagaaacaacgggctggagttctgtgggatgtgccttctccccctcccatgggcaaggcggaactcgaggacggggcctatcgcattaaacagaagggaatcctgggctacagccagattggcgctggggtctacaaggaaggaacattccacaccatgtggcatgtgacaagaggcgccgttcttatgcacaaagggaagcggatcgagcccagctgggccgatgtgaaaaaggacctgatctcctatggaggcgggtggaaactcgagggagaatggaaggagggcgaagaggtccaggtgctggctctcgaacctggcaagaacccgcgcgccgtgcaaaccaaacccgggctgtttaagacgaataccggaacaattggcgcggtttctcttgatttcagccctgggacctccggaagccccatcattgacaaaaagggcaaagtcgtggggctgtacggaaacggcgtggtcacaagatctggcgcttatgtgtccgccatcgcccagaccgaaaagtccattgaggataaccctgaaatcgaggacgatatctttcggaagcgcagactgacaattatggacctccaccccggggctggaaaaacgaagcggtacctgcctgccatcgttagagaagcgattaaacgcggccttcggaccctgatcctcgctccgacaagagtggtcgccgccgagatggaagaggctctgcgcgggctccccattcggtatcagacccctgccatcagagctgagcataccggacgcgaaattgtggacctgatgtgtcacgccacattcacgatgcggcttctgtctcccgttagagtgcctaattacaacctgatcatcatggatgaggcgcatttcaccgaccccgcctccattgctgcccgcggctatatcagcacacgggtcgaaatgggggaggctgccggcatttttatgaccgccacaccgcctggatccagagatcccttcccccaatctaatgctcctatcattgacgaggaacgggagatccccgaacgcagctggaactccggccacgagtgggtgaccgattttaaggggaaaacggtttggttcgtgcctagcatcaaggcgggaaatgacattgccgcttgcctcagaaagaacggcaaaaaggtcatccagctgtctcggaaaacatttgattccgaatacgtgaagacccgcaccaatgactgggatttcgtggtcacaaccgacattagcgagatgggggccaactttaaagccgagagagttatcgatccgcggagatgtatgaagcccgtgattcttacagacggagaggaacgcgtgatcctggctggccctatgcccgtcacccattctagcgccgcgcagcggagagggcgcatcggccggaatcctaaaaacgaaaatgaccagtacatttatatgggagagcccctcgaaaacgatgaggactgcgctcactggaaggaggccaagatgctgctggataatatcaacacgccggaaggcattatcccttccatgttcgagcccgaaagagagaaagtggacgccattgatggggaataccgcctccggggagaggctagaaagacatttgttgaccttatgcgcagaggcgatctgcctgtgtggctggcctataaagtcgcggccgaggggatcaattacgctgaccggcgctggtgtttcgatggaattaagaacaaccaaatcctcgaagagaatgtggaagttgagatctggaccaaagagggcgaaagaaagaagctgaaaccccggtggcttgacgcccgcatttattctgatcctctggctctcaaggagtttaaagagttcgccgctgggagaaagagcctgacactgaacctcatcaccgagatgggccggcttcccacgttcatgacccagaaaacaagagacgccctggataatctggcggtgctccacaccgccgaagctggaggccgcgcctacaaccatgctctgtccgagcttccggagacactggaaaccctcctgctgctcacacttctggccaccgtcacagggggaatttttctgttcctcatgtctggccgggggatcggaaagatgacactgggcatgtgctgcattatcaccgccagcatccttctgtggtatgctcagattcagcctcactggatcgcggcctccattatcctcgagtttttcctgattgtgctgctcatccccgaacccgagaagcaaagaacccctcaggacaatcagcttacatacgtcgtgatcgctattctgaccgttgtggccgccacaatggctaacgaaatgggctttctggagaaaacgaagaaagacctcgggctgggaagcatcgccacccagcaaccggagtctaatattcttgatatcgacctgcgccccgcgtccgcctggacactctacgctgtggccaccacattcgtcacccctatgctgcggcatagcattgaaaactcctctgttaatgtgagcctgacggctatcgccaaccaggcgaccgtgctcatgggccttgggaagggatggcccctgtccaaaatggatattggcgtccctctgctcgccatcgggtgttattctcaggtgaatcccatcacactgaccgctgcccttctgctcctggttgctcactacgccattatcggacctggcctgcaggctaaggccacaagagaggcgcaaaagcgggccgctgccggcattatgaaaaacccgaccgtggacgggatcacggtcattgatctcgaccccatcccttatgatcccaagtttgaaaaacagcttggacaggtgatgctgctgatcctctgcgtcacacaagtgctgatgatgcgcaccacatgggctctttgtgaggccctgaccctcgccaccggccctattagcacactgtgggaagggaatcccggaagattctggaacacgaccatcgcggtttccatggctaatatttttcggggcagctacctggccggggctggactccttttctctatcatgaagaacacaaccaatacacgcagaggcaccggcaacatgggggagacgctgggagagaaatggaagtcccggctgaacgccctcggcaaaagcgaatttcagatttataagaagtctgggatccaggaggtggaccgcacactggccaaagaaggaatcaagagaggcgagaccgatcaccatgctgtctcccgggggagcgccaaacttcgctggttcgtggagagaaatatggttaccccggaaggaaaggtggtcgacctgggctgcggcagagggggatggtcttactattgtggcgggctcaaaaacgtgcgggaggtgaagggactgacaaagggcgggcctggacacgaggaacccattcccatgagcacctacggctggaatctggttcgcctccagtccggcgtcgatgtgtttttcatccctcccgaaaaatgcgacacacttctgtgtgatattggggagtctagccctaacccgacggtggaggcgggacggaccctgagagtcctcaatctggttgaaaactggcttaataacaatacacaattctgcatcaaggtgctgaacccctacatgccttccgtgattgagaaaatggaagccatgcagcgcaagtatggcggggctctcgtccggaatcccctgagcagaaactccacccatgagatgtactgggtgtctaatgccagcggaaacatcgtttcctctgtgaatatgatcagccgcatgctgattaaccggtttacaatgagacacaaaaaggctacctatgaacctgacgtcgacctcggctccgggacgcgcaacatcggaattgagtctgagatccccaatcttgatattatcggcaagcggattgagaagatcaagcaggagcatgaaaccagctggcactacgaccaggatcacccgtataaaacatgggcctaccatggctcctatgagaccaagcaaacagggagcgcgtcttccatggtgaacggagttgtgagactgctgaccaaaccttgggacgtcctccccacagtgacccagatggccatgacggatacaacccctttcggccagcagcgcgtgtttaaggaaaaggtcgacacccggacacaagagcccaaagaggggacgaagaaactgatgaagatcaccgctgaatggctttggaaagagctgggaaagaaaaagacacctagaatgtgtacccgcgaagagttcacaagaaaggttcggagcaatgccgctctcggcgccatttttaccgatgagaacaaatggaagtctgctcgcgaagccgtggaggactccagattctgggaactggtggataaagagcggaatctgcacctcgaagggaagtgcgagacatgtgtctacaacatgatgggaaaaagagagaagaagctgggcgaatttggcaaagcgaaggggagccgggccatctggtacatgtggcttggagctcgcttcctggagtttgaagccctcggcttcctgaatgaggaccattggttttctagagaaaactcccttagcggggtggagggagagggcctgcacaaactcgggtatattctgcgggatgtttccaagaaagaaggcggagctatgtacgccgacgacaccgccggctgggatacgcgcatcaccctggaggacctcaagaatgaagagatggtgacaaaccacatggaaggggagcataagaaactggcggaggctattttcaaacttacctatcagaataaagtcgtgagagttcagcggcccacaccgcgcggaaccgtgatggatatcatcagcagacgggaccaacgcggctctgggcaggtcggaacgtacggcctgaacacatttaccaatatggaagcccagctcattagacagatggagggggaaggcgtgttcaagaacatccaacacctgacagttaccgaggaggtggccgtccagaattggcttgctcgggtgggacgcgaaagactgagccggatggccatttccggcgatgactgcgtcgtgaaacctctcgatgaccgcttcgctaacgccctgacggcgctgaacgatatggggaagatcagaaaggacattcagcagtgggagccctctaaaggatggaatgattggacccaagttcccttttgcagccatcacttccatgaactcatcatgaaggacggccgggtgctggtcgtgccttgtagaaaccaggatgagcttatcgggcgcgcccggatttcccagggagctggctggtctctgagagaaacagcctgcctcgggaaaagctatgctcagatgtggtccctgatgtactttcaccgccgggaccttagactggccgcgaatgccatctgttctgctgtgccgagccactgggttcccacctcccgcacaacctggagcattcatgccaagcacgagtggatgacaaccgaggacatgctcacggtgtggaaccgggtctggatcagagaaaatccttggatggaggataaaacacccgtggaatcttgggaggaaattccttatctgggcaagcgcgaggaccaatggtgcggatccctgatcggcctcaccagccgggctacctgggccaagaacattcaggctgccatcaatcaggttagatctctgatcgggaacgaggaatacacagattacatgccctccatgaaacgcttccggagagaggaagaggaagcgggagtgctttggtga

SEQ ID NO: 20048 - RNA, 9876 nt, synthetic construct
  misc_feature 1..9876: note = derived and/or modified CDS sequence (opt5) from DENV-2__EU677138__SS-prME
  source 1..9876: mol_type = other RNA
agcgccggaatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcggcggggtctttacatccatcgggaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcagagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccaacagaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacaacgggctggagtgctgtgggatgttccttctccccctcccatgggccgcgcggaactcgaggacggggcctatagaattaagcagaaaggaatcctgggctactcccagatcggcgctggggtgtacaaggaaggaaccttccacacaatgtggcatgtcacccggggcgccgtgcttatgcacaaggggaaacgcattgagccctcctgggccgatgttaagaaagacctgatcagctatggaggcgggtggaagctcgagggagaatggaaagagggcgaagaggtgcaggtcctggctctcgaacctggcaagaatccgagagccgtgcaaacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccggagcggcgcttatgtctctgccatcgcccagacagagaaatccatcgaggataatcctgaaattgaggacgatatctttcgcaagagacggctgaccattatggacctccaccccggggctggaaagacaaaaagatacctgcctgccatcgtgcgcgaagcgattaagcggggccttagaacgctgatcctcgctccgacccgcgttgtggccgccgagatggaagaggctctgcgggggctccccattagatatcagacccctgccatccgcgctgagcataccggacgggaaatcgtcgacctgatgtgtcacgccaccttcacaatgagacttctgagccccgtgcgcgttcctaactacaatctgattatcatggatgaggcgcatttcacggaccccgcctctattgctgcccggggctatatctccaccagagtggaaatgggggaggctgccggcatttttatgacagccaccccgcctggaagccgggatcccttcccccaatccaacgctcctatcatcgacgaggaacgcgagattcccgaaagatcttggaatagcggccacgagtgggtcacagattttaaagggaagaccgtgtggttcgttccttccatcaaagcgggaaacgacattgccgcttgcctccggaagaatggcaagaaagtgatccagctgagccgcaagacgtttgattctgaatacgtcaaaacaagaaccaacgactgggatttcgtggtgaccacagacatttccgagatgggggccaattttaaggccgagcgggtcatcgatccgagacgctgtatgaaacccgttatccttaccgacggagaggaacgggtgattctggctggccctatgcccgtgacacatagctctgccgcgcagagacgcgggcggatcggcagaaaccctaagaatgaaaacgaccagtacatttatatgggagagcccctcgaaaatgatgaggactgcgctcactggaaagaggccaagatgctgctggataacatcaataccccggaaggcattatccctagcatgttcgagcccgaacgcgagaaggtcgacgccattgatggggaataccggctcagaggagaggctcgcaaaacgtttgtggaccttatgagacggggcgatctgcctgtttggctggcctataaggtggcggccgaggggatcaactacgctgaccgcagatggtgtttcgatggaatcaaaaacaatcaaattctcgaagagaacgtcgaagtggagatctggacaaaggagggcgaacggaaaaagctgaagccccgctggcttgacgccagaatttattccgatcctctggctctcaaagagtttaaggagttcgccgctgggcggaaatctctgaccctgaatctcatcacagagatgggcagacttcccaccttcatgacgcagaagacccgcgacgccctggataacctggcggttctccacacagccgaagctggaggccgggcctacaatcatgctctgagcgagcttccggagaccctggaaacactcctgctgctcacccttctggccacagtgaccgggggaatttttctgttcctcatgtccggcagagggatcggaaaaatgacgctgggcatgtgctgcatcattacagcctctatccttctgtggtatgctcagattcagcctcactggatcgcggccagcattatcctcgagtttttcctgatcgtcctgctcattcccgaacccgagaagcaacgcacccctcaggacaaccagcttacctacgtggtcatcgctattctgacagtggttgccgccaccatggctaatgaaatgggctttctggagaagaccaagaaggacctcgggctgggatccatcgccacgcagcaaccggagagcaacattcttgatatcgacctgcggcccgcgtctgcctggaccctctacgctgtggccacaaccttcgtgacacctatgctgagacattccattgaaaatagctccgtcaacgtttctctgaccgctatcgccaatcaggcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaagccacccgggaggcgcaaaagcgcgccgctgccggcattatgaagaatccgacagttgacgggatcaccgtgatcgatctcgaccccattccttatgatcccaaatttgaaaagcagcttggacaggtcatgctgctgatcctctgcgtgacgcaagtcctgatgatgagaacaacctgggctctttgtgaggccctgacactcgccaccggccctatttctaccctgtgggaagggaaccccggacggttctggaatacaacgatcgcggtgagcatggctaacatttttcgcggctcctacctggccggggctggactccttttcagcatcatgaaaaataccacaaacaccagacggggcacaggcaacatgggggagaccctgggagagaagtggaaatctcgcctgaatgccctcggcaagtccgaatttcagatctataaaaagagcgggattcaggaggttgacagaacgctggccaaggaaggaatcaaacggggcgagacagatcaccatgctgtgtctcgcgggtccgccaaacttagatggttcgtcgagcggaacatggtgaccccggaaggaaaagttgtggacctgggctgcggcagagggggatggagctactattgtggcgggctcaagaatgtccgcgaggtgaaaggactgaccaagggcgggcctggacacgaggaacccattcccatgtctacatacggctggaacctggtgcggctccagagcggcgttgatgtctttttcatccctcccgaaaagtgcgacacccttctgtgtgatattggggagtcctctcctaatccgacagtggaggcgggaagaacgctgcgcgtgctcaacctggtcgaaaattggcttaacaataacacccaattctgcatcaaagttctgaatccctacatgcctagcgtgatcgagaagatggaagccctccagcggaaatatggcggggctctggtgagaaaccccctgtcccgcaatagcacacatgagatgtactgggtctccaacgcctctggaaatattgtgagctccgttaacatgatctctcggatgctcattaacagatttaccatgcgccacaagaaagctacatatgaacctgacgtggaccttggcagcgggacccggaatatcggaattgagtccgagacgcccaacctggatatcattggcaagagaatcgaaaagatcaaacaggagcatgaaacctcttggcactacgaccaggatcacccgtataagacatgggcctaccatggcagctatgagaccaaacaaacagggtccgcgagctctatggtcaatggagtggttcgcctgctcaccaagccttgggacgtgctgcccacagtcacccagatggccatgacggatacaacccctttcggccagcagcgggtgtttaaagaaaaggtggacaccagaacacaagagcccaaggaggggacgaagaaacttatgaaaattaccgctgaatggctgtggaaagagctcggcaagaagaaaacacctcgcatgtgtaccagagaagagttcacacggaaggtccgctccaacgccgctctgggcgccatctttaccgatgagaataagtggaaaagcgctagagaagccgttgaggactctcggttctgggaactggtggataaggagagaaacctccacctggaagggaaatgcgagacatgtgtgtacaatatgatgggaaagcgggagaagaaacttggcgaatttggcaaagcgaaagggtcccgcgccatttggtacatgtggctgggagctagattcctcgagtttgaagccctgggcttccttaacgaggaccattggtttagccgggaaaattctctgtccggggtcgagggagagggcctccacaagctggggtatatcctgcgcgatgtgagcaaaaaggaaggcggagctatgtacgccgacgacaccgccggctgggatacgagaattaccctcgaggacctgaaaaacgaagagatggttacaaatcacatggaaggggagcataagaaacttgcggaggctatcttcaaactgacctatcagaacaaggtggtccgggtgcagcgccccacaccgagaggaaccgttatggatatcatttcccggcgcgaccaaagaggcagcggacaggtgggaacgtacggcctcaatacatttaccaacatggaagcccagctgatccggcagatggagggggaaggcgtcttcaaaaatattcaacaccttacagccaccgaggaggtggctgttcagaactggctggcccgcgtgggaagagaacggctctctcgcatggctatcagcggcgatgactgcgtcgtgaagcctctggatgacagattcgccaacgcgctgacggccctcaatgatatggggaaaattcggaaggacatccagcagtgggagccctccaagggatggaacgattggacccaagtccccttttgctctcatcacttccatgaactgatcatgaaagacggcagagtgcttgttgtgccttgtcgcaatcaggatgagctgattgggcgggctagaatcagccagggagccggctggtccctccgcgaaacagcttgcctggggaagtcttatgcccagatgtggagccttatgtactttcaccggagagacctgcgcctcgcggccaacgctatttgttccgccgtcccgtctcactgggtgcccaccagccggacaacctggtccatccatgctaaacacgagtggatgacaaccgaggacatgctgacggtgtggaatagagtttggattcgcgaaaacccttggatggaggataagacacccgtggaaagctgggaggaaatcccttatctgggcaaacgggaggaccaatggtgcggatctctcattggcctgacctccagagccacctgggctaagaatatccaggtcgccatcaaccaggtgcgcagccttattgggaatgaggaatacacagattacatgccctctatgaagcggttcagacgggaggaagaggaagcgggagttctgtggtga

SEQ ID NO: 20049 - RNA, 9876 nt, synthetic construct
  misc_feature 1..9876: note = derived and/or modified CDS sequence (opt5) from DENV-2__EU677149__SS-prME
  source 1..9876: mol_type = other RNA
agcgctggcatgatcattatgctgatccccaccgtgatggctttccacctgaccacgagaaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgaaagacgctacgtgctgggacggctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagcgcatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccggagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattagatccgttacacgccttgagaatctgatgtggaagcagatcacgccggaactcaaccacatcctggccgagaatgaagtgaaactgaccattatgacaggagatatcaagggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttattaccgggaacatgagctttaaggacctgggacgcgtggttgtgatggtcggcgctacgatggccgatgacatcggcatgggggtgacctatctcgccctgctggctgccttcaaagttcggcctacatttgcggctggacttctgctcagaaagctgacctccaaggagctcatgatgacaaccattggcatcgtgctgctttctcaaagcacgattcccgaaacagtcctggagctcaccgatgccctggccctggggatgatggtgcttaaaatcgtgcgcaatatggaaaagtaccagctggctgtcacaatcatgaccattctctgcgttcctaacgccgtgatcctgcagaatgcgtggaaagtgtcctgtaccattctcgctgtcgtgtctgttagccccctgcttctgacatccagcagacagaagacggactggatccctctcgccctgaccattaaaggactgaaccccacagccatcttccttaccacactgtctcggaccaataagaaacgctcctggccgctcaacgaggctatcatggccgtgggcatggtcagcattctggcttcttccctcctgaagaatgacatccctatgacggggccccttgtggccggaggcctgctgacagtttgctatgtgctcaccggcagaagcgcggatctggaacttgagcgggccaccgacgtcaagtgggaggatcaagctgaaatttctgggtccagccctatcctgtccattacaatcagcgaggacggatctatgagcattaaaaacgaagaggaggaacagaccctcacaatcctgatccgcacgggcctcctggtgatttccgggctttttcccatctctattccgatcaccgccgctgcctggtacctgtgggaggtcaagaaacagagagccggagtgctgtgggatgttccttctccccctcccatgggcaaggctgaactcgaggacggggcgtatcggattaaacagaagggaatcctgggctactcccaaatcggcgccggggtgtacaaggaaggaacattccacaccatgtggcatgtcacacgcggcgctgtgcttatgcacaaagggaagagaattgagccctcctgggccgatgttaaaaaggacctgatcagctatggaggcgggtggaaactcgagggagaatggaaggagggcgaagaggtgcaggtcctggccctcgaacctggcaagaatccgcgggctgtgcagaccaaacccgggctgtttaagacgaacaccggaacaattggcgccgtgtcccttgatttctctcctgggaccagcggatcccccatcattgacaaaaagggcaaagttgtcgggctgtacggaaacggcgtggtgacacgcagcggcgcgtatgtctctgctatcgcccagaccgagaagtccatcgaggataatcctgaaattgaggacgatatctttagaaagcggagactgacaattatggacctccaccccggggccggaaaaacgaagcgctacctgcctgctatcgtgcgggaagccattaaaagaggccttcgcaccctgatcctcgcgccgacacgggttgtggctgccgagatggaagaggccctgagagggctccccattcgctatcaaacccctgctatccgggccgagcataccggaagagaaatcgtcgacctgatgtgtcacgctacattcacgatgcgccttctgagccccgtgcgggttcctaactacaatctgattatcatggatgaggcccatttcaccgaccccgcgtctattgccgctagaggctatatctccacacgggtggaaatgggggaggccgctggcatttttatgaccgccacaccgcctggaagccgcgatcccttcccccagtccaacgcccctatcatcgacgaggaaagagagattcccgaacggtcttggaatagcggccacgagtgggtcaccgattttaaggggaaaacggtgtggttcgttccttccatcaaggctggaaacgacattgcggcctgcctccgcaagaatggcaaaaaggtgatccagctgagcagaaaaacatttgattctgaatacgtcaagacccggaccaacgactgggatttcgtggtgacaaccgacatttccgagatgggggctaattttaaagccgagagagtcatcgatccgcgccggtgtatgaagcccgttatccttacagacggagaagagagagtgattctggccggccctatgcccgtgacccatagctctgctgcccaacgccgggggagaatcggccgcaaccctaaaaatgaaaacgaccagtacatttatatgggagagcccctcgaaaatgatgaggactgcgcgcactggaaggaggctaagatgctgctggataacatcaatacgccggaaggcattatccctagcatgttcgagcccgaacgggagaaagtcgacgccattgatggggaatacagactccgcggagaggccagaaagacatttgtggaccttatgcggcgcggcgatctgcctgtttggctggcttataaagtggccgcggaggggatcaactacgccgacagacggtggtgtttcgatggaatcaagaacaatcagattctcgaagagaacgtcgaagtggagatctggaccaaagagggcgaacgcaagaagctgaaacccagatggcttgacgctcggatttattccgatcctctggccctcaaggagtttaaagagttcgctgccgggagaaagtctctgacactgaatctcatcaccgagatgggccgccttcccacgttcatgacccagaaaacacgggacgctctggataacctggccgttctccacaccgcggaagccggaggcagagcttacaatcatgccctgagcgagcttccggagacactggaaaccctcctgctgctcacacttctggctaccgtgacagggggaatttttctgttcctcatgtccggccgcgggatcggaaagatgacactgggcatgtgctgcatcattaccgcctctatccttctgtggtatgcccaaattcagcctcactggatcgctgcgagcattatcctcgagtttttcctgatcgtcctgctcattcccgaacccgagaagcagcggacccctcaggacaaccaacttacatacgtggtcatcgccattctgaccgtggttgctgccacaatggccaatgaaatgggctttctggagaaaacgaagaaagacctcgggctgggatccatcgctacccagcagccggagagcaacattcttgatatcgacctgagacccgcctctgcgtggacactctacgccgtggctaccacattcgtgacccctatgctgcggcattccattgaaaatagctccgtcaacgtttctctgacggccatcgctaatcaggccaccgtgctcatgggccttgggaagggatggcccctgagcaaaatggatatcggcgtgcctctgctcgcgattgggtgttattcccaagtcaaccccatcacactgaccgccgcccttctgctcctggtggcccactacgctattatcggacctggcctgcaggccaaggctacacgcgaggcccagaagagagcggccgctggcattatgaaaaatccgaccgttgacgggatcacggtgatcgatctcgaccccattccttatgatcccaagtttgaaaaacagcttggacaagtcatgctgctgatcctctgcgtgacacaggtcctgatgatgcggaccacatgggccctttgtgaggctctgaccctcgccaccggccctatttctacactgtgggaagggaaccccggacgcttctggaatacgaccatcgccgtgagcatggcgaacatttttagaggctcctacctggctggggccggactccttttcagcatcatgaagaatacaaccaacacacggcgcggcaccggcaacatgggggagacgctgggagagaaatggaagtctagactgaatgctctcggcaaatccgaatttcagatctataaaaagagcgggattcaagaggttgaccggacactggccaaagaaggaatcaagcgcggcgagaccgatcaccatgccgtgtctagagggtccgctaaacttcggtggttcgtcgagagaaacatggtgaccccggaaggaaaggttgtggacctgggctgcggccgcgggggatggagctactattgtggcgggctcaaaaatgtccgggaggtgaagggactgacaaagggcgggcctggacacgaagaacccattcccatgtctacctacggctggaacctggtgagactccagagcggcgttgatgtctttttcatccctcccgaaaaatgcgacacacttctgtgtgatattggggagtcctctcctaatccgacggtggaggccggacgcaccctgcgggtgctcaacctggtcgaaaattggcttaacaataacacacagttctgcatcaaggttctgaatccctacatgcctagcgtgatcgagaaaatggaagcgctccagagaaagtatggcggggccctggtgcgcaaccccctgtcccggaatagcacccatgagatgtactgggtctccaacgcttctggaaatattgtgagctccgttaacatgatctctagaatgctcattaaccgctttacaatgcggcacaaaaaggccacctatgaacctgacgtggaccttggcagcgggacgagaaatatcggaattgagtccgagatccccaacctggatattatcggcaagcgcatcgagaagattaagcaagagcatgaaacctcttggcactacgaccaggatcacccgtataaaacatgggcttaccatggcagctatgagaccaagcagacagggtccgccagctctatggtcaatggagtggttcggctgctcaccaaaccttgggacgtgctgcccacagtcacccagatggcgatgacggatacaacccctttcggccaacagagagtgtttaaggaaaaggtggacacccgcacacaggagcccaaagaggggacgaagaaacttatgaagatcaccgccgaatggctgtggaaagagctcggaaagaaaaagacacctagaatgtgtacccgggaagagttcacacgcaaggtcagatccaacgctgccctgggcgctatttttaccgatgagaataaatggaaaagcgcccgggaagctgttgaggactctagattctgggaactggtggataaagagcggaacctccacctggaagggaagtgcgagacatgtgtgtacaatatgatgggaaaacgcgagaagaaacttggcgaatttggcaaagccaaggggtccagagcgatctggtacatgtggctgggagcccggttcctcgagtttgaagctctgggcttccttaacgaggaccattggtttagccgcgaaaattctctgtccggggtcgagggagagggcctccacaaactggggtatattctgagagatgtgagcaagaaagaaggcggagccatgtacgctgacgacaccgccggctgggatacgcggatcaccctcgaggacctgaagaacgaagagatggttacaaatcacatggaaggggagcataagaaacttgccgaggcgatcttcaagctgacctatcagaacaaagtggtccgcgtgcaaagacccacaccgcggggaaccgttatggatattatctcccgcagagaccagcggggcagcgggcaggtcggaacgtacggcctcaatacatttaccaacatggaagctcaactgattcgccagatggagggggaaggcgtcttcaagaatatccagcaccttacagtgaccgaggaggttgccgtgcagaactggctggccagagtcggacgggaacgcctctctagaatggctattagcggcgatgactgcgtggtcaaacctctggatgaccggttcgccaacgctctgacggccctcaatgatatggggaagatcagaaaggacatccaacagtgggagccctccaaaggatggaacgattggacccaggtgcccttttgctctcatcacttccatgaactgattatgaaggacggccgcgttcttgtggtcccttgtcggaatcaggatgagctgatcgggagagcgcgcattagccaaggagccggctggtccctccgggaaacagcttgcctggggaaatcttatgcccagatgtggagccttatgtactttcacagacgcgacctgcggctcgctgccaacgcgatctgttccgccgtgccgtctcactgggtgcccaccagcagaacaacctggtccattcatgctaagcacgagtggatgacaaccgaggacatgctgacggtttggaataaagtgtggatccgcgaaaacccttggatggaggataagacacccgtcgaaagctgggaggaaattccttatctgggcaagcgggaggaccagtggtgcggatctctcatcggcctgacctccagagccacctgggctaaaaatatccaggccgctattaaccaagtgcgcagccttatcgggaatgaggaatacacagattacatgccctctatgaagcggttcagacgggaggaagaggaagccggagttctgtggtga

SEQ ID NO: 20050 - RNA, 9876 nt, synthetic construct
  misc_feature 1..9876: note = derived and/or modified CDS sequence (opt5) from DENV-2__FJ024452__SS-prME
  source 1..9876: mol_type = other RNA
agcgccggcatgatcattatgctgatccccacagtgatggctttccacctcacaacgcggaatggggagcctcatatgattgtcgggatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccgggggacacagaagagagaagcggtccgtggcgctcgttcctcatgtgggcatgggcctggaaacacgcaccgagacgtggatgtctagcgaaggggcttggaaacacgcccagagaatcgagacatggattctgcggcatcccggattcaccatcatggccgctattctcgcctacacaatcggcaccacccactttcagcgcgttctgattttcatccttctgacagctgtggccccttccatgacgatgagatgcattgggatctctaaccgggattttgtcgagggagtgagcggcgggtcctgggttgacatcgtgctcgaacacggaagctgtgtcaccacaatggcgaagaataagcccaccctggatttcgagcttattaaaacagaagccaagcagcctgctaccctgcgcaaatattgcatcgaggccaagctcacgaacacaaccaccgaatctagatgtccgacacaaggcgagccctccctgaaagaggaacaggacaagcggtttatttgcaagcatagcatggtggatcgcggctgggggaatggatgtggcctgttcgggaaaggaggcatcgtgacctgcgctatgtttacatgcaagaaaaacatggaggggaagattgtccagcctgaaaatctcgagtacacgatcgttgtgacaccccactctggagaagaacatgccgtgggcaacgacacaggcaaacacgggaaggagatcaaagtcacccctcagtccagcattacagaagcggagctgaccggatatggcacggtgaccatggaatgttctcccagaacagggcttgatttcaatgagatggttctgctccaaatggaaaacaaggcctggctggtgcaccggcagtggtttcttgacctgccgctcccttggctgcccggagctgataagcaggagtccaattggatccagaaagagaccctggtcacattcaagaaccctcatgccaaaaagcaagacgtggttgtgctcggcagccaggaaggggctatgcacaccgccctgacgggcgccacagagattcagatgtcctctggaaatcttctgtttaccggccatctcaaatgccgcctgagaatggacaaacttcaactgaaggggatgagctactccatgtgtacaggaaaattcaaggtcgtgaaagaaatcgctgagacccagcacggcaccattgtcatccgggtgcagtatgagggggatggaagcccctgcaagatccccttcgaaattatggacctcgagaaaagatacgttctgggccgcctgatcacagtgaaccctattgtcacggaaaaggattctccggtgaacatcgaggcggaacccccttttggggactcctacattatcattggcgttgagcccggacagctcaagctgaattggttcaaaaagggcagctctatcgggcaaatgtttgagaccacaatgcggggagccaaaagaatggctatccttggcgataccgcctgggacttcgggagcctgggaggcgtgtttacatccattgggaaggccctccatcaggtcttcggcgctatctatggagccgcgttttctggcgtgagctggaccatgaaaattctgatcggggtgattatcacgtggatcggaatgaactcccgcagcacatctctgtccgttagccttgtcctcgtgggcattgtgaccctgtacctgggggtcatggtgcaggctgattctggatgtgttgtgtcctggaagaataaggaactcaaatgcggcagcgggatcttcattaccgacaacgtccacacatggaccgagcagtataagtttcaacctgaatccccctctaaactggccagcgccatccagaaggctcaggaggaaggcatttgtggaatccggtccgtgacaagacttgagaatctgatgtggaaacagatcacgccggagctcaaccacattctggccgaaaatgaggttaagctgaccatcatgacaggcgatattaaagggatcatgcaagctggaaagcgctctcttcggcctcagcccaccgaactcaagtacagctggaaaacatggggcaaggccaaaatgctgtccaccgagagctataaccagacgttcctgattgacgggcctgaaaccgcggagtgccccaatacaaacagagcctggaactctctcgaggtggaagattacggatttggcgtcttcaccacaaacatctggctgaaacttaaagagaagcaggacgctttttgtgactccaagctgatgagcgccgctatcaaagataatcgcgccgtgcatgcggacatgggctattggattgaatctgccctcaacgatacctggaagatcgagaaggctagcttcattgaggttaagaattgccactggcctaaaagccatacactgtggtctaacggggtgctggaaagcgagatgatcattcccaagaaccttgccggaccggtctcccaacacaattaccggcctggctaccacacccagatcgctgggccctggcatctcggaaagctggaaatggacttcgatttttgtgacggcacgacagtgattgtgaccgaggattgcgggaacagaggacccagcctgcgcaccacaaccgcctctggcaaactcatcacggaatggtgctgtcggtcctgcacactgcctccgcttagatatcggggcgaggacgggtgttggtacggaatggagatccgccccctgaaggaaaaagaggaaaatctcgtcaacagcctggttaccgccggccacgggcaagtggataatttctccctgggagtgcttggcatggctctctttctggaggaaatgctgagaacacgggtcgggaccaagcatgcgattctcctggtggccgtttctttcgtgacacttatcaccggaaacatgagctttaaagacctgggcagagtcgtggttatggtgggcgctacgatggccgatgacattgggatgggagtcacctatctcgccctgctggctgccttcaaggtgcgccctacatttgcggctggccttctgctccggaagctgacctccaaagagctcatgatgacaaccatcgggattgttctgctttctcaaagcacgatccccgagacagtgctggaactcaccgatgccctggccctgggaatgatggtccttaagatcgtgagaaatatggagaaataccagctggctgtgacaattatggccatcctctgcgtccctaacgcggttattctgcagaatgcttggaaggtgtcctgtaccatcctcgccgtggtctctgtgagccccctgcttctgacctccagccagcagaagaccgactggattcctctcgccctgacgatcaagggcctgaaccccaccgctatcttccttacaaccctgtctcgcacaaataaaaagagatcctggccgctcaacgaagccattatggctgttgggatggtgagcatcctggcctcttccctcctgaagaatgacattcctatgaccggaccccttgtcgcgggcggcctgctgacggtgtgctatgttctcacagggcggagcgccgatctggagcttgaacgcgctaccgacgtgaaatgggaggatcaggccgagatctctggatccagccctattctgtccatcaccattagcgaagacggctctatgagcatcaagaacgaggaagaggagcagacactcaccatcctgattagaacagggctcctggtcatctccggactttttcccatttctatcccgattacggctgccgcctggtacctgtgggaagtgaaaaagcagcgggctggcgtcctgtgggatgtgccttctccccctcccatggggaaagcggagctcgaagacggagcctatcgcatcaagcaaaagggcatcctgggctactcccagattggggctggagtttacaaagagggcaccttccacacaatgtggcatgtgaccagaggggccgtccttatgcacaagggaaaacggatcgaaccctcctgggccgatgtgaagaaagacctgattagctatggcgggggatggaagctcgagggcgagtggaaggaaggcgaggaagttcaggtgctggctctcgagcctgggaaaaatccgcgcgccgtccagacaaagcccggactgtttaaaaccaacacgggcaccatcggggcggtgtcccttgatttctctcctggaacaagcggctcccccattatcgacaagaaagggaaggtggttggactgtacggcaacggcgtcgtgaccagaagcggggcttatgtgtctgccatcgcccaaacaggaaagtccattgaagataatcctgagatcgaggacgatatttttcggaaacgcagactgaccatcatggacctccaccccggcgctgggaagacaaaacggtacctgcctgccattgtcagagaagcgatcaagcgcggacttcggacgctgattctcgctccgaccagagtggttgccgccgagatggaagaggctctgcgcggcctccccatccggtatcagacccctgccatcagagctgaacataccgggcgcgagattgtggacctgatgtgtcacgccaccttcacaatgcggcttctgagccccgtcagagtgcctaactacaatctgatcattatggatgaggcgcatttcacggaccccgcctctatcgctgcccgcggctatatttccacccgggttgaaatgggagaggctgccggcatctttatgacagccaccccgcctgggagcagagatcccttcccccagtccaacgctcctatcattgacgaggaacgggagatccccgaacgctcttggaatagcggacacgagtgggtgacagattttaaaggcaagaccgtctggttcgtgccttccattaaggcggggaacgacatcgccgcttgcctccgcaagaatggaaagaaagttattcaactgagccggaagacgtttgattctgaatacgtgaaaacacgcatcaacgactgggatttcgtcgtgaccaccgacatctccgagatgggcgccaattttaaggccgaaagagtgattgatccgcggagatgtatgaaacccgtcatccttacagacggggaggagcgcgttattctggctggccctatgcccgtgacccatagctctgccgcgcagcggagaggacgcatcggccggaaccctaagaatgaaaacgaccagtacatttatatgggggagcccctcgaaaatgatgaggactgcgctcactggaaggaagccaaaatgctgctggataacatcaatacaccggagggaattatccctagcatgttcgagcccgaaagagagaaggtggacgccatcgatggcgaataccgcctcagaggggaagctagaaaaacctttgtcgaccttatgcgcagaggagatctgcctgtgtggctggcctataaggttgcggccgaaggcattaactacgctgaccggcgctggtgtttcgatgggatcaaaaacaatcagattctcgaggagaacgtggaagtcgagatctggacgaaggaaggcgagagaaagaaactgaagccccggtggcttgacgcccgcatttattccgatcctctggctctcaaagagtttaaggagttcgccgctggaagaaaatctctgacactgaatctcatcaccgagatgggccggcttcccacattcatgacccaaaagacgagagacgccctggataacctggcggtgctccacaccgccgaagctgggggacgcgcctacaatcatgctctgagcgagcttccggaaacactggagaccctcctgctgctcacacttctggccaccgttacaggcgggatctttctgttcctcatgtccggacggggcattggcaagatgaccctggggatgtgctgcatcattacggcctctatccttctgtggtatgctcagattcagcctcactggatcgcggccagcatcattctcgagtttttcctgatcgtgctgctcattcccgaacccgagaaacagagaacacctcaagacaaccagcttacctacgtcgtgatcgctattctgaccgtcgtggccgccacaatggctaatgaaatgggatttctggagaagaccaaaaaggacctcggcctggggtccatcgccacacagcagccggaaagcaacattcttgatatcgacctgcgccccgcgtctgcctggacgctctacgctgttgccaccacattcgtgacccctatgctgcggcattccatcgagaatagctccgtgaacgtctctctgacagctattgccaatcaagcgaccgttctcatgggacttggcaaagggtggcccctgagcaagatggatatcggagtgcctctgctcgccattggctgttattcccaggtgaaccccatcacgctgaccgctgcccttctgctcctggtcgctcactacgccattatcggccctgggctgcaggctaaggccacaagagaggcgcagaaacgggccgctgccggaatcatgaagaatccgaccgtggacggcattacagttatcgatctcgaccccattccttatgatcccaaatttgaaaagcaacttggacaggtgatgctgctgatcctctgcgtcacccaggtgctgatgatgcgcacgacatgggctctttgtgaggccctgaccctcgccacaggacctatttctaccctgtgggaaggcaaccccgggagattctggaataccacaatcgcggtcagcatggctaacatctttcggggatcctacctggccggcgctggcctccttttcagcattatgaaaaatacgaccaacacacgcagagggaccggaaacatcggcgagacactgggggaaaagtggaaatctcggctgaatgccctcggaaagtccgagtttcaaatttataagaaaagcggcatccaggaggtggaccgcaccctggccaaggaagggattaaaagaggagagacggatcaccatgctgtttctcggggctccgccaaacttcgctggttcgtggaaagaaacatggtcacaccggagggcaaagtggttgacctggggtgcggacggggcgggtggagctactattgtggaggcctcaagaatgtgagagaggtcaaggggctgaccaaaggaggccctggccacgaggagcccatccccatgtctacctacgggtggaacctggtgcgcctccagagcggagtggatgtctttttcatccctcccgaaaagtgcgacacacttctgtgtgatattggcgagtcctctcctaatccgaccgtcgaagcggggcggacactgagagtgctcaacctggtggagaattggcttaacaataacacgcagttctgcatcaaagtcctgaatccctacatgcctagcgttattgagaagatggaagccctccaacgcaaatatggaggcgctctggtgcggaaccccctgtccagaaatagcacccatgagatgtactgggtgtccaacgcctctgggaatatcgtcagctccgtgaacatgatttctcgcatgctcatcaaccggtttacaatgagacacaagaaggctacctatgaacctgacgttgaccttggaagcggcacacgcaatattggcatcgagtccgaaatccccaacctggatattatcgggaaacggattgagaagatcaaacaggagcatgaaacctcttggcactacgaccaggatcacccgtataagacgtgggcctaccatggaagctatgagaccaaacagacaggctccgcgagctctatggtgaatggggtcgtgagactgctcaccaagccttgggacgttctgcccacagtgacccaaatggccatgacagataccacgcctttcggacagcagcgcgtctttaaggaaaaagtggacacacggacccaggagcccaaggaaggcaccaagaaacttatgaaaattacagctgagtggctgtggaaagagctcgggaaaaagaagacgcctagaatgtgtacccgcgaagagttcacaagaaaagtgcggtccaacgccgctctgggagccatctttaccgatgaaaataagtggaaaagcgctcgcgaggccgtcgaggactctagattctgggaactgatcgataaggagcggaacctccacctggaaggcaaatgcgagacatgtgtttacaatatgatgggcaagagagaaaagaaacttggggagtttggaaaggcgaaaggctcccgggccatttggtacatgtggctgggggctcgcttcctcgagtttgaagccctgggattccttaacgaggaccattggtttagcagagaaaattctctgtccggcgtggagggggaaggcctccacaagctgggatatatcctgcgggatgtgagcaaaaaggagggcggggctatgtacgccgacgacaccgccggatgggatacacgcattaccctcgaggacctgaagaacgaagagatggtcacgaatcacatggaaggcgagcataagaaacttgcggaagctatcttcaaactgacctatcaaaacaaagtggttagagtgcagcggcccacaccgcgcgggaccgtcatggatattatctccagacgggaccagcgcggaagcggccaagtggggacatacggcctcaatacctttacgaacatggaggcccagctgatcagacagatggagggagaaggcgttttcaaaaatattcagcaccttacagtgaccgaggaagtcgccgtgcaaaactggctggctcgggttgggcgcgagagactctctcggatggccatcagcggagatgactgcgtggtcaagcctctggatgaccgcttcgctaacgccctgacagcgctcaatgatatgggcaaggtgagaaaagacattcagcagtgggagccctccaaggggtggaacgattggacccaggtccccttttgctctcatcacttccatgaactgatcatgaaagacggacgggtgcttgttgtgccttgtagaaatcaagatgagctgattgcccgcgctcggatcagccagggcgccgggtggtccctcagagaaacggcttgcctgggcaagtcttatgcccagatgtggagccttatgtactttcaccgccgggacctgagactcgcggccaacgctatttgttccgccgtcccgtctcactgggtgcccaccagccgcacaacctggtccatccatgctaaacacgagtggatgacaaccgaagacatgctgacagtgtggaatcgggtttggatcagagagaacccttggatggaggataagacccccgtggaaagctgggaggaaattccttatctgggaaagcgcgaggaccagtggtgcggctctctcatcgggctgacgtcccgggccacatgggctaaaaatattcaagccgcgatcaaccaggtcagaagccttattggaaatgaagagtacaccgattacatgccctctatgaagcgcttccggagagaggaagaggaagccggcgtgctgtggtga

SEQ ID NO: 20051 - RNA, 9876 nt, synthetic construct
  misc_feature 1..9876: note = derived and/or modified CDS sequence (opt5) from DENV-2__FJ205877__SS-prME
  source 1..9876: mol_type = other RNA
agcgccggcatgatcattatgctgatccccaccgtgatggctttccacctcaccacgagaaatggggagcctcatatgattgtcggaatccaggaaaagggcaagagcctgcttttcaagaccgaggacggggttaatatgtgcaccctgatggccatggatctcggagaactgtgtgaggacaccattacctacaagtgcccccttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgaaagacgctacgtgctgggacggctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagcgcatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccggagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattagatccgttacacgccttgagaatctgatgtggaagcagatcacgccggaactcaaccacatcctggccgagaatgaagtgaaactgaccattatgacaggagatatcaagggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttattaccgggaacatgagctttaaggacctgggacgcgtggttgtgatggtcggcgctacgatggccgatgacatcggcatgggggtgacctatctcgccctgctggctgccttcaaagttcggcctacatttgcggctggacttctgctcagaaagctgacctccaaggagctcatgatgacaaccattggcatcgtgctgctttctcaaagcacgattcccgaaacagtcctggagctcaccgatgccctggccctggggatgatggtgcttaaaatcgtgcgcaatatggaaaagtaccagctggctgtcacaatcatgaccattctctgcgttcctaacgccgtgatcctgcagaatgcgtggaaagtgtcctgtaccattctcgctgtcgtgtctgttagccccctgcttctgacatccagcagacagaagacggactggatccctctcgccctgaccattaaaggactgaaccccacagccatcttccttaccacactgtctcggaccaataagaaacgctcctggccgctcaacgaggctatcatggccgtgggcatggtcagcattctggcttcttccctcctgaagaatgacatccctatgacggggccccttgtggccggaggcctgctgacagtttgctatgtgctcaccggcagaagcgcggatctggaacttgagcgggccaccgacgtcaagtgggaggatcaagctgaaatttctgggtccagccctatcctgtccattacaatcagcgaggacggatctatgagcattaaaaacgaagaggaggaacagaccctcacaatcctgatccgcacgggcctcctggtgatttccgggctttttcccatctctattccgatcaccgccgctgcctggtacctgtgggaggtcaagaaacagagagccggagtgctgtgggatgttccttctccccctcccatgggcaaggctgaactcgaggacggggcgtatcggattaaacagaagggaatcctgggctactcccaaatcggcgccggggtgtacaaggaaggaacattccacaccatgtggcatgtcacacgcggcgctgtgcttatgcacaaagggaagagaattgagccctcctgggccgatgttaaaaaggacctgatcagctatggaggcgggtggaaactcgagggagaatggaaggagggcgaagaggtgcaggtcctggccctcgaacctggcaagaatccgcgggctgtgcagaccaaacccgggctgtttaagacgaacaccggaacaattggcgccgtgtcccttgatttctctcctgggaccagcggatcccccatcattgacaaaaagggcaaagttgtcgggctgtacggaaacggcgtggtgacacgcagcggcgcgtatgtctctgctatcgcccagaccgagaagtccatcgaggataatcctgaaattgaggacgatatctttagaaagcggagactgacaattatggacctccaccccggggccggaaaaacgaagcgctacctgcctgctatcgtgcgggaagccattaaaagaggccttcgcaccctgatcctcgcgccgacacgggttgtggctgccgagatggaagaggccctgagagggctccccattcgctatcaaacccctgctatccgggccgagcataccggaagagaaatcgtcgacctgatgtgtcacgctacattcacgatgcgccttctgagccccgtgcgggttcctaactacaatctgattatcatggatgaggcccatttcaccgaccccgcgtctattgccgctagaggctatatctccacacgggtggaaatgggggaggccgctggcatttttatgaccgccacaccgcctggaagccgcgatcccttcccccagtccaacgcccctatcatcgacgaggaaagagagattcccgaacggtcttggaatagcggccacgagtgggtcaccgattttaaggggaaaacggtgtggttcgttccttccatcaaggctggaaacgacattgcggcctgcctccgcaagaatggcaaaaaggtgatccagctgagcagaaaaacatttgattctgaatacgtcaagacccggaccaacgactgggatttcgtggtgacaaccgacatttccgagatgggggctaattttaaagccgagagagtcatcgatccgcgccggtgtatgaagcccgttatccttacagacggagaagagagagtgattctggccggccctatgcccgtgacccatagctctgctgcccaacgccgggggagaatcggccgcaaccctaaaaatgaaaacgaccagtacatttatatgggagagcccctcgaaaatgatgaggactgcgcgcactggaaggaggctaagatgctgctggataacatcaatacgccggaaggcattatccctagcatgttcgagcccgaacgggagaaagtcgacgccattgatggggaatacagactccgcggagaggccagaaagacatttgtggaccttatgcggcgcggcgatctgcctgtttggctggcttataaagtggccgcggaggggatcaactaccccgacagacggtggtgtttcgatggaatcaagaacaatcagattctcgaagagaacgtcgaagtggagatctggcctaaagagggcgaacgcaagaagctgaaacccagatggcttgacccgcggatttattccgagcctagagccctgaaggaatttaaagagtttccgcccgggcgcaagtctctcaccctgaatctgatcacagaaatgggccggctccctaccttcatgacgcagaaaaccagagatgctcttgacaacctggccggactgcacacagctgaggccggcgggcgcgctgataatcatgccctcagcgagctggcggaaacccttgagacactgctcctgctgaccctccttgccacaggaaccggcgggatttttctgttcctgatgtccggacggggcatcggcaagatgacgctcgggatgtgctgcatcattacagcttctatcctgctttgggacgcccaaattcagccgcactggatcgctgccagcattatcctggaatttttcctcatcgttctgctgattcccgagcctgaaaagcagagaacaccccaggacaaccaactcacctacgtggtcatcgccattcttacagtggtcggagctaccatgcctaatgagatgggctttctggagaaaacaaagaaagatctggggctcggatccatcgcgacgcagcagcccgaaagcaacattctggacatcgatcttcggcctgcctctgcttggaccctgtatgccgtggccacaaccttcgttacaccgatgctccgccattccattgagaatagctccgtgaacgtgtctctgaccgctatcgccaatcaggcgacggtcctgatgggcctcgggaagggatgggcccttgctaaaatggacatcggcgttcccctgctgggcattgggtgttacagccaagtgaaccctatcaccctcacaggagccctgcttctgctcggcgggcactacgctattatcggacccggcctgcaggccaaggcgaccagagaagcccagaagcgggctgcccctgggattatgaaaaatcccacagtggatggaatcaccgtcatcgacctggatccgattccttatgaccccaagtttgagaaacagctcggccaagtgatgcttctgatcctgtgcgttacgcaggtcctcatgatgcgcacaacctgggctctgtgtgaagcccttacactggctaccggccccatttccaccctctgggaggggaaccctggaagattctggaatacaacgatcgccgtctctatggcgaacatttttcggggcagctacctggccggggctggactgctgttctccatcatgaagaataccacaaacacccgcagaggcacagggaacatgggagagacccttggcgaaaaatggaaaagccggctgaatgccctgggcaaatctgagtttcagatctataagaagtccgggattcaagaagtggatcgcacgctcgctaaagagggaatcaagagaggcgagacagaccaccatgccgtcagccgggggtctgccaaactgagatggttcgtggaacgcaacatggttacccccgagggaaaggtggtcgatcttggctgcgcgagagggggatggtcctactattgtggcggcctgaaaaatgtgcgggaagttaaggggctcaccaagggaggccctgggcacgaggaaccgattcccatgagcacatacggatggaacctggtgcgcctgcagtctggcgtcgacgtgtttttcatccctcccgagaaatgcgataccctcctttgtgacattggggagagctcccctaatcccacagtggaagctggacggacgctgagagttctgaacctcgtcgagaattggctgaacaataacacccagttctgcatcaaggtgcttaatccgtatatgccttctgtgatcgagaagatggaggccctgcagcgcaagtacggcggcgctctcgtccggaaccccctgagcagaaattccacacatgaaatgtactgggttagcaacgcctccgggaatattgtgtctagcgtgaacatgatctcccgcatgctgattaaccggtttaccatgagacacaaaaaggccacatatgagcctgacgtcgatctcggatctggcacccgcaatatcgggattgagagcgaaatccccaaccttgacattatcggaaagcggatcgagaaaattaagcaagaacatgagacgtcctggcactacgatcaggaccacccttataaaacctgggcttaccatggctcttatgaaacaaagcagaccgggagcgcctccagcatggtgaatggagttgtgagactgctgacaaaaccctgggatgtcctcccgaccgtgacacagatggcgatgaccgacacgacacctttcggccaacagcgcgtttttaaggagaaggtggataccagaacccaggaccccaaagagggcacaaagaaactgatgaagatcacggccgaatggctttggaaagagctggggaagaaaaagacaccccggatgtgtacacgcgaagagttcaccagaaaggtccggtctaacgctgccctcggagctatttttacagatgagaataaatggaagtccgccagagaagcggtggaggacagccggttctgggaactggtggataaagagcgcaacctgcacctcgaaggcaagtgcgagacctgtgtctacaatatgatggggaaaagagagaagaagctgggagaatttggcaaagccaaggcttctcgggccatctggtatatgtggcttggggctcgcttcctggagtttgaagccctcggcttcctgaacgaggaccattggttttccagagaaaatagcctttctggagttgagggcgaggggctgcacaaactcggatacattctgcgggacgtgtccaagaaagaaggcggggctatgtacgccgatgacacagcgggatgggatacccgcatcacgctggaggacctcaagaacgaagagatggtgaccaatcacatggaaggcgagcataagaaactggccgaggctatcttcaaacttacatatcagaacaaagtcgtgagagttcaacggcctaccccgcgcgggacagtgatggatattatcagcagacgggaccagcgcggctccggacaggtcgccacctacggcctgaatacgtttacaaacatggaagctcaactcattagacagatggagggggaaggagtgttcaagaatatccagcacctgaccgttacagaggaggtggccgtccagaactggcttgcccgggtgggccgcgaaagactgccccggatggcgattagcggggatgactgcgttgtgaaacctctcgatgctagattcgccaacgccctgaccgctctgaatgccatgggaaagatccgcaaggacatccaacagtgggagccctctaaaggctggaacgattggacgcaggtccctttttgcagccatcacttccatgaactcattatgaaggacgggcgggtgctggtcgtgccctgtagaaatcaggatgagcttatcggccgcgctcggatttcccaaggagccggctggtctctgagagaaaccgcgtgcctcgggaaaagctatgcccagatgtggtccctgatgtactttcaccgccgggaccttagactggctgccaacgctatctgttctgccgttcctagccactgggtgcccacatcccgcaccacatggtctattcatgcgaagcacgagtggatgaccacagaggacatgctcaccgtctggaataaagtgtggatccgggaaaacccgtggatggaggataagacgcctgtggaaagctgggaggaaattccctatctgggaaagagagaggaccagtggtgcggctccctgatcgggctcacaagccgcgccacctgggctaaaaatatccaggccgctattaaccaagttcggtctctgatcggaaatgaggaatacaccgattatatgccttccatgaagagattccggagagaggaagaggaagccggcgtgctttggtga

SEQ ID NO: 20052 - RNA, 9876 nt, synthetic construct
  misc_feature 1..9876: note = derived and/or modified CDS sequence (opt5) from DENV-2__FJ024454__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaagtccctgctttttaagaccgaggacggggttaatatgtgcaccctgatggccatggatctcggagaactgtgtgaggacaccattacatacaagtgcccccttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggacccgttacgatggagtgttctccgagaaccggccttgatttcaatgaaatggtgctgctccagatggagaacaaagcctggctggtccaccggcagtggtttcttgacctgcctctcccctggctgcctggggctgataagcaggagtccaattggattcaaaaggaaacactggtgaccttcaaaaacccccatgccaagaaacaggacgttgtggtcctcggaagccaggagggcgctatgcacacagccctgaccggggccacggaaatccaaatgtcctctggcaatcttctgtttacaggacatctcaagtgccgcctgagaatggacaaacttcagctgaagggcatgagctactccatgtgtaccgggaagttcaaagtggtcaaggagattgctgagacacagcacggaaccatcgtgattcgggttcagtatgaaggcgatgggagcccctgcaaaatccctttcgagatcatggacctcgaaaagagatacgtgctgggacgcctgattaccgtcaacccgatcgtgacagagaaagattctcccgttaacattgaagcggagcctccctttggcgactcctacatcattatcggggtggagcctggccaactcaagctgaattggttcaagaaaggaagctctattggccagatgtttgaaacgaccatgagaggggccaagagaatggctatccttggagatacagcctgggacttcggcagcctcgggggagtctttacctccatcggcaaagccctccatcaggtgttcggggctatttatggcgccgcgttttctggagtgagctggacaatgaagatcctgattggcgttatcattacctggatcgggatgaactcccgcagcacgtctctgtccgtcagccttgtgctcgtgggaatcgtcacactgtacctgggcgtgatggttcaggctgattctgggtgtgtggtctcctggaaaaataaggagctcaagtgcggaagcggcattttcatcaccgacaacgtgcacacctggacagaacaatataaatttcagcccgagtccccgtctaagctggccagcgccattcagaaagctcaggaagaggggatctgtggcattcggtccgttaccagacttgagaatctgatgtggaagcaaatcacacctgaactcaaccacatcctggccgagaatgaagtgaaactgacgattatgaccggagatatcaagggcattatgcaggctgggaaacgctctcttcggccccagcctacagagctcaagtacagctggaagacctggggaaaagccaagatgctgtccacagaaagctataaccagaccttcctgatcgacggccccgagacggcggagtgccctaataccaacagagcctggaactctctcgaagtcgaggattacgggtttggagtgttcacaaccaacatttggctgaaacttaaggaaaaacaagacgctttttgtgactccaagctgatgagcgccgctatcaaggataatcgcgccgttcatgcggacatgggctattggatcgagtctgccctcaacgatacatggaaaattgagaaggcttccttcatcgaagtgaaaaattgccactggcccaagagccataccctgtggtctaacggcgtcctggagagcgaaatgattatcccgaaaaaccttgccgggcctgtgtcccagcacaattaccggcccggataccacacacagattgctggcccctggcatctcgggaagctggagatggacttcgatttttgtgacggaaccacggtgatcgtcacagaagattgcggcaacagagggcctagcctgcgcaccaccacagcctctggaaagctcattaccgagtggtgctgtcggtcctgcacgctgccgccccttagatatcggggcgaggacggctgttggtacgggatggaaatccgccctctgaaagagaaggaagagaatctcgttaacagcctggtgacagccggacacggccaagtggataatttctccctgggggtccttggaatggctctctttctggaagagatgctgagaacccgggtgggcacaaaacatgcgatcctcctggttgccgtgtctttcgtcacccttattacagggaacatgagctttaaggacctgggaagagtggttgtgatggtcggcgctaccatggccgatgacatcggcatgggggtgacgtatctcgccctgctggctgccttcaaagttcgccccacctttgcggctggacttctgctccggaagctgacatccaaggagctcatgatgaccacaattggcatcgtgctgctttctcagagcaccattcctgaaacggtcctggagctcacagatgccctggccctggggatgatggtgcttaaaatcgtgagaaatatggaaaagtaccagctggctgtcaccatcatggccattctctgcgttcccaacgcggtgatcctgcagaatgcttggaaagtgtcctgtacaattctcgccgtcgtgtctgttagccctctgcttctgacctccagccaacagaagaccgactggatccccctcgccctgacaattaaaggactgaacccgacggctatcttccttaccacactgtctcgcaccaataagaaaagatcctggcctctcaacgaggccatcatggctgtgggcatggtcagcattctggcctcttccctcctgaagaatgacatccccatgacagggcctcttgtggcgggaggcctgctgaccgtttgctatgtgctcacgggccggagcgccgatctggaacttgagcgcgctacagacgtcaagtgggaggatcaggccgaaatttctgggtccagccccatcctgtccattaccatcagcgaggacggatctatgagcattaaaaacgaagaggaggaacagaccctcacaatcctgatcagaaccggcctcctggtgatttccgggctttttccgatctctattcctatcacagctgccgcctggtacctgtgggaggtcaagaaacaacgggctggagtgctgtgggatgttcccagccctccgcccatgggcaaggcggaactcgaggacggggcctatcgcattaaacagaagggaatcctgggctactcccagatcggcgctggggtgtacaaggaaggaacgttccacaccatgtggcatgtcacaagaggcgccgtgcttatgcacaaagggaagcggattgagccttcttgggccgatgttaaaaaggacctgatcagctatggaggcgggtggaaactcgagggagaatggaaggagggcgaagaggtgcaggtcctggctctcgaaccgggcaagaatccccgcgccgtgcaaaccaaacctgggctgtttaagacaaacaccggaacgattggcgcggtgtcccttgatttctctcccgggaccagcggatcccctatcattgacaaaaagggcaaagttgtcgggctgtacggaaacggcgtggtgacaagaagcggcgcttatgtctctgccatcgcccagaccgagaagtccatcgagaataaccccgaaattgaggatgacatctttcggaagcgcagactgacaattatggatctccaccctggggctggaaaaaccaagcggtacctgccggccatcgtgagagaagcgattaaacgcggccttcggacactgatcctcgctcccacgagagttgtggccgccgagatggaagaggctctgcgcgggctccctattcggtatcagacccccgccatcagagctgagcatacaggacgcgaaatcgtcgacctgatgtgtcacgccaccttcaccatgcggcttctgagccctgtgagagttcccaattacaacctgattatcatggacgaggcgcatttcacagatccggcctctattgctgcccgcggctatatctccacgcgggtggaaatgggggaggctgccggcatttttatgaccgccacacctcccggaagcagagaccccttccctcaatccaatgctcccatcatcgatgaggaacgggagattcctgaacgctcttggaacagcggccacgagtgggtcaccgactttaaggggaaaacagtgtggttcgttccgtccatcaaggcgggaaatgatattgccgcttgcctcagaaagaacggcaaaaaggtgatccagctgagccggaaaacctttgactctgaatacgtcaagacgcgcacaaatgattgggacttcgtggtgaccaccgatatttccgagatgggggccaactttaaagccgagagagtcatcgacccccggagatgtatgaagcctgttatccttacagatggagaggaacgcgtgattctggctggccccatgcctgtgacccatagctctgccgcgcagcggagagggcgcatcggccggaatcccaaaaacgaaaatgaccagtacatttatatgggagagccgctcgaaaacgacgaggattgcgctcactggaaggaggccaagatgctgctggacaatatcaacacacctgaaggcattatccccagcatgttcgagcctgaaagagagaaagtcgatgccattgacggggaataccgcctccggggagaggctagaaagacctttgtggatcttatgcgcagaggcgacctgcccgtttggctggcctataaagtggcggccgaggggatcaactacgctgatcggcgctggtgtttcgacggaatcaagaataaccaaattctcgaagagaatgtcgaagtggagatctggcctaaagagggcgaaagaaagaagctgaaaccccggtggcttgatgcccgcatttattccgacccgctggctctcaaggagtttaaagagttcgccgctgggagaaagtctctgacgctgaacctcatcacagagatgggccggcttcctaccttcatgacacagaaaaccagagatgccctggacaatctggcggttctccacacggccgaagctggaggccgcgcctacaaccatgctctgagcgagcttcccgagaccctggaaacactcctgctgctcacccttctggccacagtgaccgggggaatttttctgttcctcatgtccggccgggggatcggaaagatgacactgggcatgtgctgcatcattaccgcctctatccttctgtggtatgctcagattcagccccactggatcgcggccagcattatcctcgagtttttcctgatcgtcctgctcattcctgaaccggagaagcaaagaacgccccaggataatcagcttacatacgtggtcatcgctattctgaccgtggttgccgccaccatggctaacgaaatgggctttctggagaaaacaaagaaagacctcgggctgggatccatcgccacccagcaacctgagagcaatattcttgacatcgatctgcgccccgcgtctgcctggacactctacgctgtggccacgaccttcgtgacacctatgctgcggcattccattgaaaacagctccgtcaatgtttctctgaccgctatcgccaaccaggcgacagtgctcatgggccttgggaagggatggcccctgagcaaaatggacatcggcgtgcctctgctcgccattgggtgttattcccaggtcaatccgatcaccctgacggctgcccttctgctcctggtggctcactacgccattatcggacccggcctgcaggctaaggccaccagagaggcgcaaaagcgggccgctgccggcattatgaaaaaccctacagttgatgggatcaccgtgatcgacctcgatcccattccttatgaccccaagtttgaaaaacagcttggacaggtcatgctgctgatcctctgcgtgacacaagtcctgatgatgcgcaccacgtgggctctttgtgaggccctgacactcgccaccggcccgatttctacactgtgggaagggaatcctggaagattctggaacaccaccatcgcggtgagcatggctaatatttttcggggctcctacctggccggggctggactccttttcagcatcatgaagaacacaacgaacacccgcagaggcacaggcaatatgggggagaccctgggagagaaatggaagtctcggctgaacgccctcggcaaatccgaatttcagatctataaaaagagcgggattcaggaggttgatcgcacactggccaaagaaggaatcaagagaggcgagaccgaccaccatgctgtgtctcgggggtccgccaaacttcgctggttcgtcgagagaaatatggtgacgcccgaaggaaaggttgtggatctgggctgcggcagagggggatggagctactattgtggcgggctcaaaaacgtccgggaggtgaagggactgacaaagggcgggcccggacacgaagaacctattcccatgtctacctacggctggaatctggtgcgcctccagagcggcgttgacgtctttttcatccctccggaaaaatgcgatacccttctgtgtgacattggggagtcctctcccaaccctacagtggaggcgggacggaccctgagagtgctcaatctggtcgaaaactggcttaataacaatacacaattctgcatcaaggttctgaacccctacatgcctagcgtgatcgagaaaatggaagccctccagcgcaagtatggcggggctctggtgcggaatcccctgtccagaaacagcacgcatgagatgtactgggtctccaatgcctctggaaacattgtgagctccgttaacatgatctctcgcatgctcattaatcggtttaccatgagacacaaaaaggctacatatgaaccggatgtggaccttggcagcgggacccgcaacatcggaattgagtccgagacacctaatctggacatcattggcaagcggatcgagaagatcaagcaggagcatgaaacctcttggcactacgatcaggaccacccctataaaacgtgggcctaccatggcagctatgagaccaagcaaacagggtccgcgagctctatggtcaccggagtggttagactgctcacaaaaccttgggatgtgctgcccaccgtcacacagatggccatgaccgacacgacacctttcggccagcagcgcgtgtttaaggaaaaggtggatacccggacccaagaccccaaagaggctacaaagaaacttatgaagattacggccgagtggctgtggaaagaactcgggaagaaaaagaccccgagaatgtgtacacgcgaggagttcaccagaaaggtccggtccaacgctgccctgggagctatctttacagatgagaataaatggaaaagcgcccgcgaggcggttgaagactctagattctgggagctggtggataaagaacggaacctccacctggagggcaagtgcgaaacctgtgtgtacaatatgatggggaaaagagagaagaaacttggagagtttggcaaagccaagggctcccgggctatttggtacatgtggctgggggcccgcttcctcgaatttgaggctctgggattccttaacgaagaccattggtttagcagagaaaattctctgtccggcgtcgaaggggagggactccacaaactgggctatatcctgcgggatgtgagcaagaaagaagggggcgccatgtacgccgacgacacagcgggatgggatacccgcattacgctcgaagacctgaagaacgaggaaatggttaccaatcacatggagggcgaacataagaaacttgctgaggccatcttcaagctgacatatcagaacaaagtggtcagagtgcagcggcctacaccccgcgggacagttatggatatcatttccagacgggaccaacgcggaagcggccaggtggggacctacggactcaatacgtttacaaacatggaggcccagctgatcagacagatggaaggcgagggggtcttcaagaatattcaacaccttcccgtgaccgaagaggttgctgtgcagaactggctggcccgggtcggccgcgagagactctctcggatgcctatcagcggagatgactgcgtggtcaaaccgctggatgctcgcttccccacagccctgacccctctcaacgacatgggcaagattagaaaggatatccatcagtgggacccctccaaagggtggaatgattggacgcaggtccctttttgctctcaccatttccacgaactgatcatgaaggacggacgggttcttgtggtcccctgtagaaaccaagatgacctgattgcgcgcgcccggatcagccagggccctgggtggtccctcagagagaccgcttgcctgggaaaatcttatgcccagatgtggagccttatgtactttcaccgccgggacctgagactcgctgccaatgcgatttgttccgccgtgccctctcattgggtgccgacaagccgcaccacatggtccatccacgctaagcatgaatggatgaccacagaggatatgctgaccgtttggaaccgggtgtggattagagaaaatccttggatggaggacaaaacgcccgtcgagagctgggaagagatcccttatctgggcaagcgcgaagatcagtggtgcgggtctctcattggcctgacatcccgggccacctgggctaagaacatccaagtggccatcaatcaggttagaagccttattggaaacgaggaatacaccgactacatgccctctatgaaacgcttccggagagaggaggaagaggctggcgtgctgtggtga

SEQ ID NO: 20053 - RNA, 9876 nt, synthetic construct
  misc_feature 1..9876: note = derived and/or modified CDS sequence (opt5) from DENV-2__FJ205878__SS-prME
  source 1..9876: mol_type = other RNA
agcgccggaatgatcattatgctgatccccaccgtgacagctttccacctgacgacccggaatggggagcctcatatgattgtcggaatccaggaaaagggcaagagcctgctttttaagacagaggacggggttaatatgtgcaccctgatggccatggatctcggagaactgtgtgaggacacaattacctacaagtgcccgcttctgcggcaaaacgaacccgaggatatcgactgttggtgcaattctacaagcacctgggtgacgtatggcacctgtacaaccacaggggagcaccgcagagaaaagcggtccgtggcgctcgtccctcatgtgggaatgggcctggagacccgcacggaaacatggatgtctagcgagggcgcttggaagcacgcccagagaatcgagacctggattctgcggcatcccgggttcacaatcatggccgctattctcgcctacaccatcggaaccacacactttcagcgcgttctgattttcatccttctgacggctgtggccccttccatgaccatgagatgcattggcatctctaaccgggattttgtcgaaggggtgagcggaggctcctgggttgacatcgtgctcgagcacgggagctgtgtcacaaccatggcgaagaataagcccacactggatttcgaacttattaaaaccgaggccaagcagcctgctacgctgcgcaaatattgcatcgaagccaagctcacaaacaccaccacagagtctagatgtccgacccaaggagagccctccctgaaagaagaacaggacaagcggtttgtgtgcaagcatagcatggtggatcgcggctggggcaatgggtgtggactgttcggcaaagggggaattgtcacatgcgctatgtttacgtgcaagaaaaacatggaaggcaagatcgttcagcctgagaatctcgaatacaccattgtggtgacaccccactctggggaggagcatgccgtcggaaacgacaccggcaaacacggccaggaaatcaaggtgacacctcaatccagcatcaccgaggcggaactgacggggtatggaaccgttacaatggagtgttctcccagaaccggccttgatttcaatgaaatggtgctgctccagatggagaacaaagcctggctggtccaccggcagtggtttcttgacctgccgctcccttggctgcccggggctgataagcaggagtccaattggattcaaaaggaaacactggtgaccttcaaaaaccctcatgccaagaaacaggacgttgtggtcctcggaagccaggagggcgctatgcacacggccctgacaggggccaccgaaatccaaatgtcctctggcaatcttctgtttacaggacatctcaagtgccgcctgagaatggacaaacttcagctgaagggcatgagctactccatgtgtaccgggaagttcaaagtggtcaaggagattgctgagacccagcacggaacaatcgtgattcgggttcagtatgaaggcgatgggagcccctgcaaaatccccttcgagatcatggacctcgaaaagagatacgtgctgggacgcctgattacggtcaaccctatcgtgaccgagaaagattctccggttaacattgaagcggagcccccttttggcgactcctacatcattatcggggtggagcccggccaactcaagctgaattggttcaagaaaggaagctctattggccagatgtttgaaacaaccatgagaggggctaagagaatggctatccttggagatacagcctgggacttcggcagcctcggcggggtctttacctccatcgggaaagccctccatcaggtgttcggggctatttatggcgccgcgttttctggagtgagctggacgatgaagatcctgattggcgttatcattacatggatcgggatgaactcccgcagcacctctctgtccgtcagccttgtgctcgtgggaatcgtcaccctgtacctgggcgtgatggttcaggctgattctgggtgtgtggtctcctggaaaaataaggagctcaagtgcggaagcggcattttcatcacagacaacgtgcacacctggacagaacaatataaatttcagcctgagtccccctctaagctggccagcgccattcagaaagctcaggaagaggggatctgtggcattcggtccgttacgagacttgagaatctgatgtggaagcaaatcaccccggaactcaaccacatcctggccgagaatgaagtgaaactgacaattatgaccggagatatcaagggcattatgcaggctgggaaacgctctcttcggcctcagcccacagagctcaagtacagctggaagacctggggaaaagccaagatgctgtccacggaaagctataaccagaccttcctgatcgacggccctgagacagcggagtgccccaataccaacagagcctggaactctctcgaagtcgaggattacgggtttggagtgttcacaaccaacatttggctgaaacttaaggaaaaacaagacgctttttgtgactccaagctgatgagcgccgctatcaaggataatcgcgccgttcatgcggacatgggctattggatcgagtctgccctcaacgatacatggaaaattgagaaggcttccttcatcgaagtgaaaaattgccactggcctaagagccataccctgtggtctaacggcgtcctggagagcgaaatgattatccccaaaaaccttgccgggccggtgtcccagcacaattaccggcctggataccacacgcagattgctggcccctggcatctcgggaagctggagatggacttcgatttttgtgacggaacaaccgtgatcgtcaccgaagattgcggcaacagagggcccagcctgcgcacaaccacggcctctggaaagctcattacagagtggtgctgtcggtcctgcaccctgcctccgcttagatatcggggcgaggacggctgttggtacgggatggaaatccgccccctgaaagagaaggaagagaatctcgttaacagcctggtgacagccggacacggccaagtggataatttctccctgggggtccttggaatggctctctttctggaagagatgctgagaacccgggtgggcacaaaacatgcgatcctcctggttgccgtgtctttcgtcacccttattacggggaacatgagctttaaggacctgggaagagtggttgtgatggtcggcgctaccatgacagatgacatcggcatgggggtgacctatctcgccctgctggccgctttcaaagttcgccctacatttgccgcgggacttctgctccggaagctgacctccaaggagctcatgatgacgacaattggcatcgtgctgctttctcagagcaccattcccgaaacagtcctggagctcaccgatgctctggccctggggatgatggtgcttaaaatcgtgagaaatatggaaaagtaccagctggccgtcaccatcatggctattctctgcgttcctaacgccgtgatcctgcagaatgcgtggaaagtgtcctgtacaattctcgctgtcgtgtctgttagccccctgcttctgacgtccagccaacagaagaccgactggatccctctcgccctgacaattaaaggactgaaccccaccgccatcttccttacaaccctgtctcgcacgaataagaaaagatcctggccgctcaacgaggctatcatggccgtgggcatggtcagcattctggcttcttccctcctgaagaatgacatccctatgacagggccccttgtggccggaggcctgctgaccgtttgctatgtgctcaccggccggagcgcggatctggaacttgagcgcgccacagacgtcaagtgggaggatcaggctgaaatttctgggtccagccctatcctgtccattaccatcagcgaggacggatctatgagcattaaaaacgaagaggaggaacagacactcacgatcctgatcagaaccggcctcctggtgatttccgggctttttcccatctctattccgatcacagccgctgcctggtacctgtgggaggtcaagaaacaacgggccggagtgctgtgggatgttccttctccccctcccatgggcaaggctgaactcgaggacggggcgtatcgcattaaacagaagggaatcctgggctactcccagatcggcgccggggtgtacagagaaggaaccttccacacaatgtggcatgtcacccggggcgctgtgcttatgcacaaggggaaacgcattgagccctcctgggccgatgttaagaaagacctgatcagctatggaggcgggtggaagctcgagggagaatggaaagagggcgaagaggtgcaggtcctggccctcgaacctggcaagaatccgagagctgtgcaaacgaagcccgggctgtttaaaaccaacacaggaaccattggcgccgtgtcccttgatttctctcctgggacaagcggatcccccatcattgacaagaaaggcaaggttgtcgggctgtacggaaacggcgtggtgacccggagcggcgcgtatgtctctgctatcgcccagacagagaaatccatcgaggataatcctgaaattgaggacgatatctttcgcaagagacggctgacgattatggacctccaccccggggccggaaagaccaaaagatacctgcctgctatcgtgcgcgaagccattaagcggggccttagaacactgatcctcgcgccgacccgcgttgtggctgccgagatggaagaggccctgcgggggctccccattagatatcagacccctgctatccgcgccgagcatacaggacgggaaatcgtcgacctgatgtgtcacgctacgttcaccatgagacttctgagccccgtgcgcgttcctaactacaatctgattatcatggatgaggcccatttcacagaccccgcgtctattgccgctcggggctatatctccaccagagtggaaatgggggaggccgctggcatttttatgacagccaccccgcctggaagccgggatcccttcccccaatccaacgcccctatcatcgacgaggaacgcgagattcccgaaagatcttggaatagcggccacgagtgggtcacggattttaaagggaagacagtgtggttcgttccttccatcaaagctggaaacgacattgcggcctgcctccggaagaatggcaagaaagtgatccagctgagccgcaagacctttgattctgaatacgtcaaaaccagaacaaacgactgggatttcgtggtgaccacagacatttccgagatgggggctaattttaaggccgagcgggtcatcgatccgagacgctgtatgaaacccgttatccttaccgacggagaggaacgggtgattctggccggccctatgcccgtgacgcatagctctgctgcccagagacgcgggcggatcggcagaaaccctaagaatgaaaacgaccagtacatttatatgggagagcccctcgaaaatgatgaggactgcgcgcactggaaagaggctaagatgctgctggataacatcaatacaccggaaggcattatccctagcatgttcgagcccgaacgcgagaaggtcgacgccattgatggggaataccggctcagaggagaggcccgcaaaacctttgtggaccttatgagacggggcgatctgcctgtttggctggcttataaggtggccgcggaggggatcaactacgccgaccgcagatggtgtttcgatggaatcaaaaacaatcaaattctcgaagagaacgtcgaagtggagatctggacaaaggagggcgaacggaaaaagctgaagccccgctggcttgacgctagaatttattccgatcctctggccctcaaagagtttaaggagttcgctgccgggcggaaatctctgaccctgaatctcatcacggagatgggcagacttcccaccttcatgacacagaagacccgcgacgctctggataacctggccgttctccacacagcggaagccggaggccgggcttacaatcatgccctgagcgagcttccggagaccctggaaacactcctgctgctcacccttctggctacggtgacagggggaatttttctgttcctcatgtccggcagagggatcggaaaaatgaccctgggcatgtgctgcatcattaccgcctctatccttctgtggtatgcccagattcagcctcactggatcgctgcgagcattatcctcgagtttttcctgatcgtcctgctcattcccgaacccgagaagcaacgcacacctcaggacaaccagcttacctacgtggtcatcgccattctgacagtggttgctgccacgatggccaatgaaatgggctttctggagaagaccaaaaaggacctcgggctgggatccatcgctacacagcaaccggagagcaacattcttgatatcgacctgcggcccgcctctgcgtggaccctctacgccgtggctacaaccttcgtgacgcctatgctgagacattccattgaaaatagctccgtcaacgtttctctgaccgccatcgctaatcaggccacagtgctcatgggccttgggaaaggatggcccctgagcaagatggatatcggcgtgcctctgctcgcgattgggtgttattcccaggtcaaccccatcaccctgacagccgcccttctgctcctggtggcccactacgctattatcggacctggcctgcaggccaaagctacccgggaggcccaaaagcgcgcggccgctggcattatgaagaatccgacggttgacgggatcacagtgatcgatctcgaccccattccttatgatcccaaatttgaaaagcagcttggacaggtcatgctgctgatcctctgcgtgacccaagtcctgatgatgagaacaacctgggccctttgtgaggctctgaccctcgccacaggccctatttctacgctgtgggaagggaaccccggacggttctggaataccacaatcgccgtgagcatggcgaacatttttcgcggctcctacctggctggggccggactccttttcagcatcatgaaaaataccacaaacaccagacggggcacgggcaacatgggggagacactgggagagaagtggaaatctcgcctgaatgctctcggcaagtccgaatttcagatctataaaaagagcgggattcaggaggttgacagaaccctggccaaggaaggaatcaaacggggcgagaccgatcaccatgccgtgtctcgcgggtccgctaaacttagatggttcgtcgagcggaacatggtgacaccggaaggaaaagttgtggacctgggctgcggcagagggggatggagctactattgtggcgggctcaagaatgtccgcgaggtgaaaggactgaccaagggcgggcctggacacgaggaacccattcccatgtctacatacggctggaacctggtgcggctccagagcggcgttgatgtctttttcatccctcccgaaaagtgcgacacgcttctgtgtgatattggggagtcctctcctaatccgaccgtggaggccggaagaacactgcgcgtgctcaacctggtcgaaaattggcttaacaataacacccaattctgcatcaaagttctgaatccctacatgcctagcgtgatcgagaagatggaagcgctccagcggaaatatggcggggccctggtgagaaaccccctgtcccgcaatagcacacatgagatgtactgggtctccaacgcttctggaaatattgtgagctccgttaacatgatctctcggatgctcattaacagatttaccatgcgccacaagaaagccacgtatgaacctgacgtggaccttggcagcgggacccggaatatcggaacagagtccgagattcccaacctggatatcattggcaagagaatcgaaaagatcaaacaggagcatgaaacctcttggcactacgaccaggatcacccgtataagacatgggcttaccatggcagctatgagaccaaacaaacagggtccgccagctctatggtcaatggagtggttcgcctgctcaccaagccttgggacgtgctgcccatggtcacgcagatggcgatgacagataccacccctttcggccagcagcgggtgtttaaagaaaaggtggacacaagaacgcaagagcccaaggaggggaccaagaaacttatgaaaattacagccgaatggctgtggaaagagctcggcaagaagaaaacccctcgcatgtgtacaagagaagagttcacccggaaggtccgctccaacgctgccctgggcgctatctttacagatgagaataagtggaaaagcgccagagaagctgttgaggactctcggttctgggaactggtggataaggagagaaacctccacctggaagggaaatgcgagacctgtgtgtacaatatgatgggaaagcgggagaagaaacttggcgaatttggcaaagccaaagggtcccgcgcgatttggtacatgtggctgggagccagattcctcgagtttgaagctctgggcttccttaacgaggaccattggtttagccgggaaaattctctgtccggggtcgagggagagggcctccacaagctggggtatatcctgcgcgatgtgagcaaaaaggaaggcggagccatgtacgctgacgacacggccggctgggataccagaattacactcgaggacctgaaaaacgaagagatggttaccaatcacatggaaggggagcataagaaacttgccgaggcgatcttcaaactgacatatcagaacaaggtggtccgggtgcagcgccccaccccgagaggaacggttatggatatcatttcccggcgcgaccaaagaggcagcggacaggtgggaacatacggcctcaatacctttacaaacatggaagctcagctgatccggcagatggagggggaaggcgtcttcaaaaatattcaacaccttaccgtgacggaggaggttgccgtgaagaactggctggcccgcgtcggaagagaacggctctctcgcatggctatcagcggcgatgactgcgtggtcaaacctctggatgacagattcgccaacgctctgaccgccctcaatgatatggggaagattcggaaggacatccagcagtgggagccctccaaaggatggaacgattggacacaggtgcccttttgctctcatcacttccatgaactgatcatgaaggacggcagagttcttgtggtcccttgtcgcaatcaagatgagctgattgggcgggcgagaatcagccagggagccggctggtccctccgcgaaaccgcttgcctggggaaatcttatgcccagatgtggagccttatgtactttcaccggagagacctgcgcctcgctgccaacgcgatttgttccgccgtgccgtctcactgggtgcccacaagccggaccacatggtccatccatgctaagcacgagtggatgaccacggaggacatgctgacagtttggaatagagtgtggattcgcgaaaacccttggatggaggataaaacccccgtcgaaagctgggaggaaatcccttatctgggcaagcgggaggaccagtggtgcggatctctcattggcctgacctccagagccacatgggctaagaatatccaagccgctatcaaccaggtgcgcagccttattgggaatgaggaatacaccgattacatgccctctatgaaacggttcagacgggaggaagaggaagccggagttctgtggtga

SEQ ID NO: 20054 - RNA, 9876 nt, synthetic construct
  misc_feature 1..9876: note = derived and/or modified CDS sequence (opt5) from DENV-2__FJ205879__SS-prME
  source 1..9876: mol_type = other RNA
agcgccggcatgatcattatgctgatccccaccgtgatggctttccacctgacgacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttatttgcaagcatagcatggtggatcgcggctggggcaatgggtgtggactgttcggcaaagggggaatcgtgacctgcgctatgtttacatgcaagaaaaacatggaaggcaagattgtccagcctgagaatctcgaatacacgatcgttgtgacaccccactctggggaggagcatgccgtgggaaacgacacaggcaaacacggcaaggaaatcaaagtcacccctcagtccagcattacagaggcggaactgaccgggtatggaacggtgaccatggagtgttctcccagaacaggccttgatttcaatgaaatggttctgctccaaatggagaacaaggcctggctggtgcaccggcagtggtttcttgacctgccgctcccttggctgcccggggctgataagcaggagtccaattggatccagaaagaaaccctggtcacattcaagaaccctcatgccaaaaagcaagacgtggttgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgtcatccgggtgcagtatgaaggcgatgggagcccctgcaagatccccttcgagattatggacctcgagaagcggtacgttctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagtcttcaccacaaacatctggctgaaacttaaagaaaagcaggacgctttttgtgactccaagctgatgagcgccgctatcaaagataatcgcgccgtgcatgcggacatgggctattggattgagtctgccctcaacgatacctggaagatcgagaaggctagcttcattgaagttaagaattgccactggcctaaaagccatacactgtggtctaacggcgtgctggagagcgaaatgatcattcccaagaaccttgccgggccggtctcccaacacaattaccggcctggataccacacccagatcgctggcccctggcatctcgggaagctggagatggacttcgatttttgtgacggaacgacagtggtggtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagaccgactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgctgaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcacaaccgcctctattcttctgtggtatgctcagatccagcctcactggattgcggccagcatcattctcgagtttttcctgatcgtcctgctcatccccgaacccgagaaacagagaacccctcaagacaaccagcttacatacgtggtcattgctatcctgaccgtggttgccgccacaatggctaatgaaatgggctttctggagaagacgaaaaaggacctcgggctgggatccattgccacccagcagccggagagcaacatccttgatattgacctgcgccccgcgtctgcctggacactctacgctgtggccaccacattcgtgacccctatgctgcggcattccatcgaaaatagctccgtcaacgtttctctgacggctattgccaatcaagcgaccgtgctcatgggccttgggaaaggatggcccctgagcaagatggatatcggcgtgcctctgctcgccatcgggtgttattcccaggtcaaccccattacactgaccgctgcccttctgctcctggtggctcactacgccatcattggacctggcctgcaggctaaggccacaagagaggcgcagaaacgggccgctgccggcatcatgaagaatccgaccgttgacgggattacggtgatcgatctcgaccccatcccttatgatcccaaatttgaaaagcaacttggacaggtcatgctgctgattctctgcgtgacacaggtcctgatgatgcgcaccacatgggctctttgtgaggccctgaccctcgccaccggccctatctctacactgtgggaagggaaccccggaagattctggaatacgaccattgcggtgagcatggctaacatctttcggggctcctacctggccggggctggactccttttcagcattatgaaaaatacaaccaacccgcgcagaggcacaggcaacatgggggagaccctgggagagaagtggaaatctcggctgaatgccctcggcaagtccgaatttcaaatctataagcgcagcgggatccaggaggttgacagaacgctggccaaagaaggaattaagcggggcgagacagatcaccatgctgtgtctcgcgggtccgccaaacttagatggttcgtcgagcggaacatggtgacccctgaaggaaaggttgtggacctgggctgcggcagagggggatggagctactattgtggcgggctcaaaaatgtccgcgaggtgaagggactgaccaagggcgggcccggacacgaagaacccatccctatgtctacatacggctggaacctggtgcggctccagagcggcgttgatgtctttttcattccccctgaaaaatgcgacacccttctgtgtgatatcggggagtcctctccgaatcccacagtggaggcgggaagaacgctgcgcgtgctcaacctggtcgaaaattggcttaacaataacacccagttctgcattaaggttctgaatccttacatgcccagcgtgatcgagaaaatggaagccctccaacggaagtatggcggggctctggtgagaaaccctctgtcccgcaatagcacacatgagatgtactgggtctccaacgcctctggaaatatcgtgagctccgttaacatgatttctcggatgctcatcaacagatttaccatgcgccacaaaaaggctacatatgaacccgacgtggaccttggcagcgggacccggaatattggaatcgagtccgagattccgaacctggatatcattggcaagagaatcgagaagatcaagcaggagcatgaaacgtcttggcactacgaccaggatcacccttataaaacctgggcctaccatggcagctatgagacaaagcagaccgggtccgcgagctctatggtcaatggagtggttcgcctgctcacaaaaccctgggacgtgctgcctaccgtcacacaaatggccatgaccgatacgacacccttcggccagcagcgggtgtttaaggaaaaggtggacaccagaacccaggagcctaaagaggggacaaagaaacttatgaagattacggctgaatggctgtggaaagagctcggaaagaaaaagacacccagaatgtgtacaagagaagagttcacccggaaggtccgctccaacgccgctctgggcgccatctttacagatgagaataaatggaaaagcgctagagaagccgttgaggactctcggttctgggaactggtggataaagagagaaacctccacctggaagggaagtgcgagacctgtgtgtacaatatgatgggaaaacgggagaagaaacttggcgaatttggcaaagcgaaggggtcccgcgccatttggtacatgtggctgggagctagattcctcgagtttgaagccctgggcttccttaacgaggaccattggtttagccgggaaaattctctgtccggggtcgagggagagggcctccacaaactggggtatatcctgcgcgatgtgagcaagaaagaaggcggagctatgtacgccgacgacacagccggctgggataccagaattacgctcgaggacctgaagaacgaagagatggttaccaatcacatggaaggggagcataagaaacttgcggaggctatcttcaagctgacatatcaaaacaaagtggtccgggtgcagcgcccgacccctagaggaacagttatggatatcatttcccggcgcgaccagagaggcagcgggcaagtgggaacctacggcctcaatacgtttacaaacatggaagcccagctgatccggcagatggagggggaaggcgtcttcaagaatattcagcaccttaccgtgacagaggaggttgccgtgcaaaactggctggctcgcgtcggaagagaacggctctctcgcatggccatcagcggcgatgactgcgtggtcaaacccctggatgacagattcgctaacgccctgaccgcgctcaatgatatggggaagattcggaaggacatccagcagtgggagccctccaaaggatggaacgattggacacaggtgcctttttgctctcatcacttccatgaactgatcatgaaggacggcagagttcttgtggtcccgtgtcgcaatcaagatgagctgattgggcgggccagaatcagccagggagctggctggtccctccgcgaaaccgcctgcctggggaaatcttatgctcagatgtggagccttatgtactttcaccggagagacctgcgcctcgccgcgaacgccatttgttccgctgtgccctctcactgggtgcctacaagccggaccacatggtccatccatgccaagcacgagtggatgaccacagaggacatgctgaccgtttggaatagagtgtggattcgcgaaaacccctggatggaggataaaacgcctgtcgaaagctgggaggaaatcccctatctgggcaagcgggaggaccagtggtgcggatctctcattggcctgacatccagagctacctgggccaagaatatccaagctgccatcaaccaggtgcgcagccttattgggaatgaggaatacaccgattacatgccttctatgaaacggttcagacgggaggaagaggaagcgggagttctgtggtga

SEQ ID NO: 20055 - RNA, 9876 nt, synthetic construct
  misc_feature 1..9876: note = derived and/or modified CDS sequence (opt5) from DENV-2__FJ390385__SS-prME
  source 1..9876: mol_type = other RNA
agcgccggaatgatcattatgctgatccccacagtgatggctttccacctgacgacgagaaatggggagcctcatatgattgttggaatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgcgacggagaaggattctccggtgaacattgaagccgagcccccttttggcgactcctacatcattatcggggttgagcccggccagctcaagctgaattggttcaaaaagggaagctctattggccaaatgtttgaaaccacaatgagaggggctaaaagaatggccatccttggagataccgcctgggacttcggcagcctcgggggagtgtttacatccatcggcaaggctctccatcaggtcttcggggccatttatggcgcggctttttctggagtgagctggaccatgaaaatcctgattggcgtgatcattacgtggatcgggatgaactcccgcagcacatctctgtccgttagccttgtcctcgtgggaatcgtgaccctgtacctgggcgtcatggtgcaggccgattctgggtgtgttgtgtcctggaagaataaggagctcaaatgcggaagcggcattttcatcaccgacaacgtccacacatggaccgaacagtataagtttcaacctgagtccccctctaaactggccagcgctattcagaaggcccaggaagaggggatctgtggcattcggtccgtgacaagacttgagaatctgatgtggaaacagatcacgccggaactcaaccacatcctggctgagaatgaagttaagctgaccattatgacaggagatatcaaaggcattatgcaagccgggaagcgctctcttcggcctcagcccaccgagctcaagtacagctggaaaacatggggaaaggcgaaaatgctgtccaccgaaagctataaccagacgttcctgatcgacggccctgagaccgccgagtgccccaatacaaacagagcttggaactctctcgaagtggaggattacgggtttggagtcttcaccacaaacatttggctgaaacttaaagaaaagcaggacgccttttgtgactccaagctgatgagcgctgccatcaaagataatcgcgcggtgcatgccgacatgggctattggatcgagtctgctctcaacgatacctggaagattgagaaagcctccttcatcgaagttaagaattgccactggcctaaaagccatacactgtggtctaacggcgtgctggagagcgaaatgattatccccaagaaccttgctgggccggtctcccaacacaattaccggcctggataccacacccagattgccggcccctggcatctcgggaagctggagatggacttcgatttttgtgacggaacgacagtgatcgtgaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgtcaacagcctggttaccgctggacacggccaggtggataatttctccctgggggtgcttggaatggcgctctttctggaagagatgctgagaacacgggtcggcaccaagcatgccatcctcctggtggctgtttctttcgtgacacttattaccgggaacatgagctttaaagacctgggaagagtcgtggttatggtgggcgccacgatggccgatgacatcggcatgggggtcacctatctcgctctgctggccgcgttcaaggtgcgccctacatttgctgccggacttctgctccggaagctgacctccaaagagctcatgatgacaaccattggcatcgttctgctttctcaaagcacgattcccgaaacagtgctggagctcaccgatgccctggctctggggatgatggtccttaagatcgtgagaaatatggaaaaataccagctggccgtgacaatcatggcgattctctgcgtccctaacgctgttatcctgcagaatgcctggaaggtgggatgtaccattctcgccgtggtctccgtgtctcccctgcttctgaccagctcccagcagaagaccgactggatccctctcgctctgacgattaagggcctgaaccccaccgccatcttccttacaaccctgagccgcacaaataaaaagagatcttggccgctcaacgaggctatcatggccgttgggatggtgtccattctggcgagctctctcctgaagaatgacatccctatgaccggaccccttgtcgccggcggcctgctgacggtgtgctatgttctcacagggcggtccgctgatctggaacttgagcgcgccaccgacgtgaaatgggaggatcaggctgaaattagcggatcttcccctatcctgagcattaccatctccgaggacggcagcatgtctattaagaacgaagaggaggaacagacactcaccatcctgatcagaacagggctcctggtcattagcggactttttcccatctccattccgatcacggccgccgcttggtacctgtgggaggtgaaaaagcagcgggcgggcgtcctgtgggatgtgccttctccccctcccatggggaaagccgaactcgaggacggagcttatcgcattaagcaaaagggcatcctgggctacagccagatcggggccggagtttacaaagaaggcaccttccacacaatgtggcatgtgaccagaggggccgtccttatgcacaagggaaaacggattgagccctcctgggctgatgtgaagaaagacctgatctcttatggcgggggatggaagctcgagggcgaatggaaggagggcgaagaggttcaggtgctggccctcgaacctgggaaaaatccgcgcgcggtccagacaaagcccggactgtttaaaaccaacacgggcaccattggggctgtgagccttgatttctcccctggaacatctggcagccccatcattgacaagaaagggaaggtggttggactgtacggcaacggcgtcgtgaccagatccggggcctatgtgagcgccatcgctcaaacagagaagtctatcgaggataatcctgaaattgaggacgatatctttcggaaacgcagactgaccattatggacctccaccccggagccggcaagacaaaacggtacctgcctgcgatcgtcagagaagctattaagcgcgggcttcggacgctgatcctcgccccgaccagagtggttgccgctgagatggaagaggccctgcgcggactccccattcggtatcagacccctgctatcagatccgagcataccggccgcgaaatcgtggacctgatgtgtcacgccaccttcacaatgcggcttctgagccccgtcagagtgcctaactacaatctgattatcatggatgaggcgcatttcacggaccccgcctctattgctgcccgcgggtatatctccacccgggttgaaatgggcgaggctgccggaatttttatgacagccaccccgcctggcagcagagatcccttcccccagtccaacgctcctatcatcgacgaggaacgggagattcccgaacgctcttggaatagcgggcacgagtgggtgacagattttaaaggaaagaccgtctggttcgtgccttccatcaaggcgggcaacgacattgccgcttgcctccgcaaaaatgggaagaaagttatccaactgagccggaagacgtttgattctgaatacgtgaaaacacgcaccaacgactgggatttcgtcgtgaccacagacatttccgagatgggagccaattttaaggccgagagagtgatcgatccgcggagatgtatgaaacccgtcatccttaccgacggcgaggaacgcgttattctggctgggcctatgcccgtgacacatagctctgccgcgcagcggagaggccgcatcggacggaaccctaagaatgaaaacgaccagtacatttatatgggcgagcccctcgaaaatgatgaggactgcgctcactggaaggaggccaaaatgctgctggataacatcaataccccggaagggattatccctagcatgttcgagcccgaaagagagaaggtggacgccattgatggagaataccgcctccggggcgaggctagaaaaacgtttgtcgaccttatgcgcagaggggatctgcctgtgtggctggcctataaggttgcggccgagggaatcaactacgctgaccggcgctggtgtttcgatggcatcaaaaacaatcagattctcgaagagaacgtggaagtcgagatctggacaaaggagggggaaagaaagaaactgaagccccggtggcttgacgcccgcatttattccgatcctctggctctcaaagagtttaaggagttcgccgctggcagaaaatctctgaccctgaatctcatcacagagatgggacggcttcccaccttcatgacgcaaaagaccagagacgccctggataacctggcggtgctccacacagccgaagctggcgggcgcgcctacaatcatgctctgagcgagcttccggagaccctggaaacactcctgctgctcacccttctggccacagttaccggaggcatttttctgttcctcatgtccgggcggggaatcggcaagatgacgctgggcatgtgctgcatcattacagcctctatccttctgtggtatgctcagattcagcctcactggatcgcggccagcattatcctcgagtttttcctgatcgtgctgctcattcccgaacccgagaaacagagaacccctcaagacaaccagcttacctacgtcgtgatcgctattctgacagtcgtggccgccaccatggctaatgaaatggggtttctggagaagaccaagaaggacctcggactgggctccatcgccacgcagcagccggagagcaacattcttgatatcgacctgcgccccgcgtctgcctggaccctctacgctgttgccacaaccttcgtgacacctatgctgcggcattccattgaaaatagctccgtgaacgtctctctgaccgctatcgccaatcaagcgacggttctcatggggcttggaaaaggctggcccctgagcaagatggatatcggggtgcctctgctcgccattggatgttattcccaggtgaaccccatcaccctgacagctgcccttctgctcctggtcgctcactacgccattatcggccctggcctgcaggctaaggccaccagagaggcgcagaaacgggccgctgccgggattatgaagaatccgacagtggacggaatcaccgttatcgatctcgaccccattccttatgatcccaaatttgaaaagcaacttggccaggtgatgctgctgatcctctgcgtcacacaggtgctgatgatgcgcacaacctgggctctttgtgaggccctgacactcgccaccgggcctatttctaccctgtgggaaggaaaccccggcagattctggaatacaacgatcgcggtcagcatggctaacatttttcgggggtcctacctggccggagctggcctccttttcagcatcatgaaaaataccacaaacacccgcagaggcacagggaacatgggagagaccctgggcgagaagtggaaatctcggctgaatgccctcgggaagtccgaatttcaaatctataagcgcagcggcattcaggaggtggacagaacgctggccaaagaaggcatcaagcgcggggaaacagatcaccatgctgtttctcggggatccgccaaacttagatggttcgtggagcggaacatggtcaccccggaaggcaaggtggttgacctgggctgcgggagaggaggctggagctactattgtgggggactcaaaaatgtgcgcgaggtcaagggcctgaccaaagggggacctggccacgaagaacccattcccatgtctacatacggctggaacctggtgcggctccagagcggggtggatgtctttttcatccctcccgaaaaatgcgacacccttctgtgtgatattggagagtcctctcctaatccgacagtcgaggcgggcagaacgctgcgcgtgctcaacctggtggaaaattggcttaacaataacacccagttctgcatcaaggtcctgaatccctacatgcctagcgttatcgagaaaatggaagccctccaacggaagtatgggggagctctggtgagaaaccccctgtcccgcaatagcacacatgagatgtactgggtgtccaacgcctctggcaatattgtcagctccgtgaacatgatctctcggatgctcattaacagatttaccatgcgccacaaaaaggctacatatgaacctgacgttgaccttgggagcggaacccggaatatcggcacggagtccgagattcccaacctggatatcattggcaagagaatcgagaagatcaagcaggagcatgaaacctcttggcactacgaccaggatcacccgtataaaacatgggcctaccatgggagctatgagaccaagcagacaggatccgcgagctctatggtgaatggcgtcgtgcgcctgctcaccaaaccttgggacgttctgcccacagtgacccaaatggccatgacggatacaacccctttcgggcagcagcgggtctttaaggaaaaggtggacaccagaacacaggagcccaaagagggaacgaagaaacttatgaagattaccgctgaatggctgtggaaagagctcggcaagaaaaagacacctcgcatgtgtaccagagaagagttcacacggaaggtgcgctccaacgccgctctgggggccatctttaccgatgagaataaatggaaaagcgctagagaagccgtcgaggactctcggttctgggaactggttgataaagagagaaacctccacctggaaggaaagtgcgagacatgtgtgtacaatatgatgggcaaacgggagaagaaacttggcgaatttgggaaagcgaagggatcccgcgccatttggtacatgtggctgggcgctagattcctcgagtttgaagccctggggttccttaacgaggaccattggtttagccgggaaaattctctgtccggagtggagggcgaggggctccacaaactgggctatatcctgcgcgatgtcagcaagaaagaaggaggcgctatgtacgccgacgacaccgccgggtgggatacgagaattaccctcgaggacctgaagaacgaagagatggtgacaaatcacatgaagggagaacataagaaacttgcggaggctatcttcaaactgacctatcaaaacaaagttgtgcgggtccagcgccccacaccgagaggcaccgtgatggatatcatttcccggcgcgaccagagagggagcggacaagttggcacgtacgggctcaatacatttaccaacatggaggcccagctgatccggcagatggaaggcgagggagtgttcaaaaatattcagcaccttacagtcaccgaagaggtggccgttcaaaactggctggctcgcgtgggcagagagcggctctctcgcatggccatcagcggggatgactgcgtcgtgaagcctctggatgacagattcgctaacgccctgacggcgctcaatgatatgggaaagattcggaaagacatccagcagtgggaaccctccaagggctggaacgattggacccaggtccccttttgctctcatcacttccatgagctgatcatgaaagacgggagagtgcttgttgtgccttgtcgcaatcaagatgaactgattggacgggccagaatcagccagggcgctgggtggtccctccgcgagacagcctgcctgggcaagtcttatgctcagatgtggagccttatgtactttcaccggagagacctgcgcctcgccgcgaacgccatttgttccgctgtcccgtctcactgggtgcccaccagccggacaacctggtccatccatgccaaacacgaatggatgacaaccgaggacatgctgacggtgtggaatagagtttggattcgcgagaacccttggatggaagataagacacccgtggagagctgggaagagatcccttatctgggaaagcgggaagaccagtggtgcggctctctcattgggctgacctccagagctacctgggccaaaaatatccaagctgccatcaaccaggtccgcagccttattggaaatgaggagtacacagattacatgccctctatgaagcggttcagacgggaagaggaagaggcgggcgtgctgtggtga

SEQ ID NO: 20056 - RNA, 9876 nt, synthetic construct
  misc_feature 1..9876: note = derived and/or modified CDS sequence (opt5) from DENV-2__FJ024458__SS-prME
  source 1..9876: mol_type = other RNA
agcgccggcatgatcattatgctgatccccaccgtgatggctttccacctgaccacgagaaatggggaacctcatatgattgtcggaatccaggaaaagggcaagtccctgctttttaagaccgaagacggggttaatatgtgcaccctgatggccatggatctcggagaactgtgtgaagacaccattacatacaagtgcccccttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggcgccggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatggattattggatcgagtctgccctcaacgacacctggaaaattgagaaggcttccttcatcgaagtgaaaaattgccactgggccaagagccatacactgtggtctaacggcgtcctggagagcgaaatgattatccctaaaaaccttgctggccccgtgtcccaacacaattacagactcgggtaccacacccagattgccggaccgtggcatctgggcaagctggagatggatttcgacttttgtgatgggacgacagtgatcgtcaccgaagactgcggaaaccgcggccctagcctccggaccacaaccgcctctgggaagctgattacggagtggtgctgtagatcctgcacacttccgcccctgcggtatcgcggagaggatggctgttggtacggcatggaaatcagacctctcaaagagaaggaagagaatctggttaacagcctggtgaccgctgggcacggacaggtggacaatttctcccttggcgtcctcgggatggcgctgtttctggaagagatgctccggacaagagtgggaaccaaacatgccatcctgcttgttgctgtgtctttcgtcacactgattaccggcaacatgagctttaaggatctcgggcgcgtggttgtgatggtcggagccacgatggccgacgatatcggcatgggcgtgacctatctggctctgcttgccgcgttcaaagttcggccgacatttgctgccgggctgctcctgagaaagctcacctccaaggagctgatgatgacaaccattggaatcgtgcttctgtctcaaagcacgattcccgaaacagtcctcgagctgaccgacgccctggctcttggcatgatggtgctgaaaatcgtgcgcaatatggaaaagtaccagctcgccgtcacaatcatggcgattctgtgcgttcctaacgctgtgatcctccagaatgcctggaaagtgtcctgtaccattctggccgtcgtgtctgttagcccccttctgctcacctccagccagcaaaagacagactggatccctctggctctgacgattaaagggcttaaccccaccgccatcttcctgacaaccctctctagaacaaataagaaacggtcctggcctctgaacgaggctatcatggccgtgggaatggtcagcattctcgcgtcttccctgcttaagaatgatatccccatgaccggcccgctggtggccgggggactgctcacggtttgctatgtgctgacaggccgcagcgctgaccttgaactggagagagccaccgatgtcaagtgggaggaccaggctgaaatttctggctccagccctatcctctccattaccatcagcgaggatgggtctatgagcattaaaaacgaagaggaggaacagacactgaccatcctcatccggacaggactgcttgtgatttccggcctgtttcccatctctattcctatcacggccgccgcttggtacctgtgggaggtcaagaaacagcgcgcgggggtgctctgggacgttcccagcccgcctcccatgggaaaggccgaactggaggatggcgcttatagaattaaacaaaaggggatccttggatactcccagatcggcgccggcgtgtacaaggaagggaccttccacacaatgtggcatgtcacccggggagccgtgctgatgcacaaaggcaagcgcattgagccttcttgggctgacgttaaaaaggatctcatcagctatgggggaggctggaaactggagggggaatggaaggagggagaagaggtgcaggtcctcgccctggaacccggcaagaatcccagagcggtgcagacaaaacctggcctttttaagaccaacacggggaccattggagctgtgtccctggacttctctccgggcacaagcgggtcccccatcattgataaaaagggaaaagttgtcggcctgtacgggaacggagtggtgacccggagcggcgcctatgtctctgccatcgctcaaacagagaagtccatcgaggacaatcctgaaattgaggatgacatctttcgcaagagacggctcaccattatggacctgcaccccggcgccgggaaaacaaagagataccttcctgcgatcgtgcgcgaagctattaaacggggactgagaacgctcatcctggcccccacccgcgttgtggccgctgagatggaagaggccctccggggcctgcctattagatatcagacaccggctatccgcgccgagcataccgggcgggaaatcgtcgatcttatgtgtcacgcgaccttcacaatgagactgctgagccccgtgcgcgttcctaactacaatctcattatcatggacgaggcccatttcacggatcccgcttctattgccgctcggggatatatctccaccagagtggaaatgggcgaggccgccgggatttttatgacagctacccctcccggcagccgggacccgttccctcagtccaacgcgcccatcatcgatgaggaacgcgagattcccgaaagatcttggaatagcggacacgagtgggtcacagactttaagggcaaaaccgtgtggttcgttccttccatcaaggccgggaacgatattgctgcctgcctgcggaagaatggcaaaaaggtgatccaacttagccgcaaaacgtttgactctgaatacgtcaagacaagaaccaacgattgggacttcgtggtgaccacagatatttccgagatgggagccaattttaaagctgagcgggtcatcgaccccagacgctgtatgaagcctgttatcctgaccgacggggaggaacgggtgattctcgccggaccgatgcccgtgacacatagctctgcggctcagagacgcggccggatcgggagaaaccctaaaaatgaaaacgatcagtacatttatatgggcgagcccctggaaaatgacgaggattgcgcccactggaaggaggccaagatgctgctcgacaacatcaatacccctgaaggaattatccccagcatgttcgagccggaacgcgagaaagtcgatgctattgacggcgaataccggcttagaggggaggcccgcaagacgtttgtggatctgatgagacggggagacctgcctgtttggctcgcgtataaagtggccgctgagggcatcaactacgccgatcgcagatggtgtttcgacgggatcaagaacaatcagattctggaagagaacgtcgaagtggagatctggacaaaagagggagaacggaagaaacttaaaccccgctggctggatgctagaatttattccgaccctctcgccctgaaggagtttaaagagttcgctgccggccggaagtctctgaccctcaatcttatcacagagatggggagactgcccaccttcatgacgcagaagacccgcgatgcgctggacaacctcgccgttctgcacacagctgaagccggcggacgggcttacaatcatgcccttagcgagctgcctgagaccctcgaaacactgctgctccttaccctgctggccacagtgaccggcgggatttttctcttcctgatgtccggaagaggcatcgggaagatgacgcttggaatgtgctgcatcattacagcttctatcctgctctggtatgcgcagattcagccccactggatcgccgctagcattatcctggagtttttcctgatcgtcctccttattccggaacctgagaagcagcgcacaccccaagacaaccagctgacctacgtggtcatcgccattctgacagtggttgccgctaccatggccaatgaaatgggctttctcgagaaaacaaagaaagatttcggcctggggtccatcgcgacgcagcagcccgagagcaacattcttgacatcgatctgcggcctgcctctgcttggaccctctacgccgtggctacaacctttgtgacaccgatgctgagacattccattgaaaatagctccgtcaacgtttctctgaccgccatcgcgaatcaagccacggtgctcatgggacttggcaaggggtggcccctgagcaaaatggacatcggagtgcctctgctcgctattggctgttattcccaggtcaaccccatcaccctgacagccgcccttctgctcctggtggcccactacgctattatcgggcctggactgcaggccaaggcgacccgggaggcccagaagcgcgctgccgctggcattatgaaaaatcccacagttgatggcatcaccgtgatcgacctcgatcctattccgtatgaccccaagttcgaaaaacaacttgggcaggtcatgctgctgatcctctgcgtgacgcaggtcctgatgatgagaacaacctgggccctttgtgaggccctgacactcgcgaccggacctatttctaccctgtgggaaggcaaccccgggcggttttggaatacaacgatcgctgtgagcatggccaacattttccgcggatcctacctggctggcgccgggctcctttttagcatcatgaagaataccacaaacaccagacggggaacaggcaacatcggcgagaccctgggggagaaatggaagtctcgcctgaatgccctcggaaaatccgagttccaaatttataaaaagagcggcatccaggaggttgatagaacgctggctaaagaagggattaagcggggagagacagaccaccatgccgtgtctcgcggctccgcgaaacttagatggtttgtcgagcggaacatggtgacccctgaagggaaggttgtggatctgggatgcggcagaggcgggtggagctactattgtggaggcctcaaaaatgtccgcgaggtgaaggggctgaccaagggaggccccgggcacgaagaacccatccctatgtctacatacggatggaacctggtgcggctccagagcggcgttgacgtcttcttcattccgcccgaaaaatgcgatacccttctgtgtgacatcggcgagtcctctcctaatcccacagtggaggccgggagaacgctgcgcgtgctcaacctggtcgaaaattggcttaacaataacacccagttttgcatcaaggttctgaatccttacatgccgagcgtgattgagaaaatggaagctctccaacggaagtatggaggcgccctggtgagaaaccccctgtcccgcaatagcacacatgagatgtactgggtctccaacgcttctgggaatatcgtgagctccgttaacatgatttctcggatgctcatcaacagattcaccatgcgccacaaaaaggccacatatgaacctgacgtggatcttggaagcggcacccggaatattgggatcgagtccgagattcccaacctggacatcatcggaaagagaattgagaagatcaagcaggagcatgaaacgtcttggcactacgatcaggaccacccttataaaacctgggcgtaccatggcagctatgagacaaagcagaccggctccgccagctctatggtcaatggggtggttcgcctgctcacaaaaccctgggatgtgctgccgaccgtcacacaaatggctatgaccgacacgacaccttttggacagcagcgggtgttcaaggaaaaggtggataccagaacccaggagcccaaagagggcacaaagaaacttatgaagattacggccgaatggctgtggaaagagctcgggaagaaaaagacccctcgcatgtgtacaagagaagagtttacccggaaggtccgctccaacgctgccctgggagctatcttcacagacgagaataaatggaaaagcgccagagaagcggttgaggattctcggttttgggaactggtggacaaagagagaaacctccacctggaaggcaagtgcgagacctgtgtgtacaatatgatggggaaacgggagaagaaacttggagagttcggcaaagccaagggctcccgcgctatttggtacatgtggctgggggccagatttctcgagttcgaagctctgggatttcttaacgaggatcattggttcagccgggaaaattctctgtccggcgtcgagggggagggactccacaaactgggctatatcctgcgcgacgtgagcaagaaagaagggggcgccatgtacgccgacgatacagcgggatgggacaccagaatcacgctcgaggatctgaagaacgaagagatggttaccaatcacatggaaggcgagcataagaaacttgctgaggccatttttaagctgacatatcaaaacaaagtggtccgggtgcagcgccccacccctagagggacagttatggacatcatttcccggcgcgatcagagaggaagcggccaagtggggacctacggactcaatacgttcacaaacatggaagcccagctgatccggcagatggagggcgaaggggtcttcaagaatattcagcaccttaccgtgacagaggaggttgctgtgcaaaactggctggcccgcgtcggcagagaacggctctctcgcatggctatcagcggagacgattgcgtggtcaaacccctggacgatagatttgccaacgcgctgaccgccctcaatgacatgggcaagatccggaaggatattcagcagtgggagccgtccaaagggtggaacgactggacgcaggtccctttctgctctcatcactttcatgaactgatcatgaaggatggaagagttcttgtggtcccctgtcgcaatcaagacgagctgattggccgggctagaatcagccagggggccggatggtccctccgcgaaaccgcttgcctgggcaaatcttatgcccagatgtggagccttatgtacttccaccggagagacctgcgcctcgcggccaacgctatttgttccgccgtgccctctcactgggtgcctacaagccggaccacatggtccatccatgctaagcacgagtggatgaccacagaggatatgctgaccgtttggaatagagtgtggattcgcgaaaacccgtggatggaggacaaaacgcccgtcgaaagctgggaggaaatcccttatctggggaagcgggaggatcagtggtgcggctctctcatcggactgacatccagagccacctgggctaagaatattcaagccgcgatcaaccaggtgcgcagccttattggcaatgaggaatacaccgactacatgccctctatgaaacggtttagacgggaggaagaggaagccggggttctgtggtga

SEQ ID NO: 20057 - RNA, 9876 nt, synthetic construct
  misc_feature 1..9876: note = derived and/or modified CDS sequence (opt5) from DENV-2__FJ205880__SS-prME
  source 1..9876: mol_type = other RNA
tccgccggaatgatcattatgctgatccccacagtgatggctttccacctgacaacgcggaatggggagcctcatatgattgtcggaatccaggaaaagggcaaatccctgctttttaagaccgaggacggggttaatatgtgcacactgatggccatggatcttggagaactgtgtgaggacaccattacatacaaatgcccgcttctgcggcaaaatgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcggcggggtctttacatccatcgggaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgcttcctgtgacagcaagctgatgtctgccgctatcaaggataatcgcgccgttcatgcggacatgggctattggatcgagtccgccctcaacgatacctggaaaattgagaaggctagctttatcgaagtgaaaaattgccactggcctaagtctcatacactgtggagcaacggcgtcctggagtccgaaatgattatccccaaaaaccttgccgggccggtgagccagcacaattaccggcctggataccacacccagattgctggcccctggcatctcgggaagctggagatggacttcgatttctgtgacggaacgacagtgatcgtcaccgaagattgcggcaacagagggccctctctgcgcaccacaaccgcctccggaaagctcattacggagtggtgctgtcggagctgcacactgcctccgcttagatatcggggcgaggacggctgttggtacgggatggaaatccgccccctgaaagagaaggaagagaatctcgttaactccctggtgaccgccggacacggccaagtggataatttttctctgggggtccttggaatggctctcttcctggaagagatgctgaaaacaagagtgggcaccaagcatgcgatcctcctggttgccgtgagctttgtcacacttattaccgggaacatgtccttcaaagacctgggacgggtggttgtgatggtcggcgctacgatggccgatgacatcggcatgggggtgacctatctcgccctgctggctgcctttaaggttagacctacattcgcggctggacttctgctccgcaagctgacctctaaagagctcatgatgacaaccattggcatcgtgctgcttagccagtccacgattcccgaaacagtcctggagctcaccgatgccctggccctggggatgatggtgcttaagatcgtgcggaatatggaaaaataccagctggctgtcacaatcatggccattctctgcgttcctaacgcggtgatcctgcagaatgcttggaaggtgtcttgtaccattctcgccgtcgtgagcgttagccccctgcttctgaccagctctcaacagaaaacagactggatccctctcgccctgacgattaagggactgaaccccaccgctatctttcttacaaccctgtccagaacaaataaaaagcgcagctggccgctcaacgaggccatcatggctgtgggcatggtctctattctggcctccagcctcctgaagaatgacatccctatgaccgggccccttgtggcgggaggcctgctgacggtttgctatgtgctcacaggcagatctgccgatctggaacttgagcgggctaccgacgtcaaatgggaggatcaggccgaaatttccgggagctcccctatcctgagcattaccatctctgaggacggaagcatgtccattaagaacgaagaggaggaacagacactcaccatcctgatccgcacaggcctcctggtgatttctgggcttttccccatcagcattccgatcacggctgccgcctggtacctgtgggaggtcaaaaagcaaagagctggagtgctgtgggatgttccttctccccctcccatgggcaaagcggaactcgaggacggggcctatcggattaagcagaagggaatcctgggctacagccagatcggcgctggggtgtacaaagaaggaacctttcacacaatgtggcatgtcacccgcggcgccgtgcttatgcacaaggggaaaagaattgagcccagctgggccgatgttaagaaagacctgatctcctatggaggcgggtggaagctcgagggagaatggaaggagggcgaagaggtgcaggtcctggctctcgaacctggcaaaaatccgcgggccgtgcaaacaaagcccgggctgttcaaaaccaacacgggaaccattggcgcggtgtctcttgattttagccctgggacatccggaagccccatcattgacaagaaaggcaaggttgtcgggctgtacggaaacggcgtggtgacccgctctggcgcttatgtctccgccatcgcccagacagaaaagtccatcgaggataatcctgaaattgaggacgatatcttcagaaaacggcgcctgaccattatggacctccaccccggggctggaaagacaaaaagatacctgcctgccatcgtgcgggaagcgattaagagaggccttcgcacgctgatcctcgctccgacccgggttgtggccgccgagatggaagaggctctgagagggctccccattcgctatcagacccctgccatccgggctgagcataccggaagagaaatcgtcgacctgatgtgtcacgccacctttacaatgcgccttctgtctcccgtgcgggttcctaactacaatctgattatcatggatgaggcgcatttcacggaccccgcctccattgctgccagaggctatatcagcacccgcgtggaaatgggggaggctgccggcattttcatgacagccaccccgcctggatcccgggatccctttccccaatctaacgctcctatcatcgacgaggaaagagagattcccgaacggagctggaactccggccacgagtgggtcacagatttcaaagggaagaccgtgtggtttgttcctagcatcaaggcgggaaacgacattgccgcttgcctccgcaaaaatggcaagaaagtgatccagctgtctagaaagacgttcgattccgaatacgtcaaaacacggaccaacgactgggattttgtggtgaccacagacattagcgagatgggggccaatttcaaggccgagcgcgtcatcgatccgagacggtgtatgaaacccgttatccttaccgacggagaagagagagtgattctggctggccctatgcccgtgacacattctagcgccgcgcagcgccgggggagaatcggccgcaaccctaagaatgaaaacgaccagtacatttatatgggagagcccctcgaaaatgatgaggactgcgctcactggaaggaggccaaaatgctgctggataacatcaataccccggaaggcattatcccttccatgtttgagcccgaacgggagaaggtcgacgccattgatggggaatacagactccgcggagaggctcggaaaacgttcgtggaccttatgagacgcggcgatctgcctgtttggctggcctataaggtggcggccgaggggatcaactacgctgacagacggtggtgttttgatggaatcaaaaacaatcaaattctcgaagagaacgtcgaagtggagatctggacaaaggagggcgaacgcaagaaactgaagcccagatggcttgacgcccggatttattctgatcctctggctctcaaagagttcaaggaatttgccgctgggcgcaaaagcctgaccctgaatctcatcacagagatgggcagacttcccaccttcatgacgcagaagacccgggacgccctggataacctggcggttctccacacagccgaagctggaggcagagcctacaatcatgctctgtccgagcttccggagaccctggaaacactcctgctgctcacccttctggccacagtgaccgggggaattttcctgtttctcatgtctggccgcgggatcggaaagatgacgctgggcatgtgctgcatcattacagccagcatccttctgtggtatgctcagattcagcctcactggatcgcggcctccattatcctcgagttctttctgatcgtcctgctcattcccgaacccgagaaacaacggacccctcaggacaaccagcttacctacgtggtcatcgctattctgacagtggttgccgccaccatggctaatgaaatgggcttcctggagaagaccaagaaggacctcgggctgggaagcatcgccacgcagcaaccggagtctaacattcttgatatcgacctgagacccgcgtccgcctggaccctctacgctgtggccacaacctttgtgacacctatgctgcgccatagcattgaaaattcctctgtcaacgttagcctgaccgctatcgccaatcaggcgacggtgctcatgggccttgggaaaggatggcccctgtccaagatggatatcggcgtgcctctgctcgccattgggtgttattctcaggtcaaccccatcaccctgacagctgcccttctgctcctggtggctcactacgccattatcggacctggcctgcaggctaaggccacccgggaggcgcagaagcgggccgctgccggcattatgaagaatccgacagttgacgggatcaccgtgatcgatctcgaccccattccttatgatcccaaattcgaaaagcagcttggacaggtcatgctgctgatcctctgcgtgacgcaagtcctgatgatgcggacaacctgggctctttgtgaggccctgacactcgccaccggccctattagcaccctgtgggaagggaaccccggacgcttttggaatacaacgatcgcggtgtccatggctaacattttcagaggcagctacctggccggggctggactcctcttttctatcatgaaaaataccacaaacacccggcgcggcacaggcaacatgggggagaccctgggagagaagtggaaatccagactgaatgccctcggcaagagcgagttccagatctataagaaatctgggattcaggaggttgaccggacgctggccaaggaaggaatcaaacgcggcgagacagatcaccatgctgtgtccagagggagcgccaaacttcggtggtttgtcgagcgcaacatggtgaccccggaaggaaaagttgtggacctgggctgcggcagagggggatggtcttactattgtggcgggctcaagaatgtccgggaggtgaagggactgaccaaaggcgggcctggacacgaggaacccattcccatgagcacatacggctggaacctggtgagactccagtccggcgttgatgtcttctttatccctcccgaaaagtgcgacacccttctgtgtgatattggggagtctagccctaatccgacagtggaggcgggacgcacgctgcgggtgctcaacctggtcgaaaattggcttaacaataacacccaattctgcatcaaagttctgaatccctacatgccttccgtgatcgagaagatggaagccctccagagaaaatatggcggggctctggtgcgcaaccccctgagcagaaattccacacatgagatgtactgggtctctaacgccagcggaaatattgtgtcctctgttaacatgatcagcagaatgctcattaaccgcttcaccatgcggcacaagaaggctacatatgaacctgacgtggaccttggctccgggaccagaaatatcggaattgagtctgagatccccaacctggatattatcggcaaacgcatcgaaaagattaaacaggagcatgaaacgagctggcactacgaccaggatcacccgtataagacctgggcctaccatggctcctatgagacaaaacaaaccgggagcgcgtcttccatggtcaatggagtggttcggctgctcacaaagccttgggacgtgctgcccaccgtcacacagatggccatgaccgatacgacaccttttggccagcagagagtgttcaaggaaaaagtggacacccgcacccaagagcccaaggaggggaccaagaaacttatgaaaatcacggctgaatggctgtggaaggagctcggcaaaaagaagacccctcggatgtgtacaagagaagagtttacccgcaaagtcagaagcaacgccgctctgggcgccattttcacagatgagaataagtggaaatctgctcgggaagccgttgaggactcccgcttttgggaactggtggataaggagagaaacctccacctggaagggaaatgcgagacctgtgtgtacaatatgatgggaaagcgggagaagaaacttggcgagttcggcaaggcgaaagggagcagagccatctggtacatgtggctgggagctcggtttctcgagttcgaagccctgggctttcttaacgaggaccattggttctctcgcgaaaattccctgagcggggtcgagggagagggcctccacaagctggggtatattctgagagatgtgtccaaaaaggaaggcggagctatgtacgccgacgacacagccggctgggatacccggatcacgctcgaggacctgaagaacgaagagatggttaccaatcacatggaaggggagcataagaaacttgcggaggctatctttaaactgacatatcagaacaaggtggtccgcgtgcagagacccaccccgcggggaacagttatggatattatcagccgcagagaccaacggggctctggacaggtgggaacctacggcctcaatacgttcacaaacatggaagcccagctgattcgccagatggagggggaaggcgtctttaaaaatatccaacaccttaccgtgacagaggaggttgccgtgcagaactggctggctagagtcggacgggaacgcctcagcagaatggccatttccggcgatgactgcgtggtcaagcctctggatgaccggttcgctaacgccctgaccgcgctcaatgatatggggaagatccgcaaagacatccagcagtgggagccctctaagggatggaacgattggacgcaagtgcccttctgcagccatcactttcatgaactgattatgaaagacggcagagttcttgtggtcccttgtcggaatcaggatgagctgatcgggagagcccgcatttcccagggagctggctggtctctccgggaaaccgcctgcctggggaaaagctatgctcagatgtggtcccttatgtacttccacagacgcgacctgcggctcgccgcgaacgccatctgttctgctgtgccgagccactgggtgcccacatccagaaccacatggagcattcatgccaaacacgagtggatgaccacagaggacatgctgaccgtttggaatcgcgtgtggatccgggaaaacccttggatggaggataagacgcccgtcgaatcttgggaggaaattccttatctgggcaagagagaggaccaatggtgcggatccctcatcggcctgacaagccgcgctacctgggccaaaaatatccaggctgccattaaccaggtgcggtctcttatcgggaatgaggaatacaccgattacatgccctccatgaagagatttcgccgggaggaagaggaagcgggagttctgtggtga

SEQ ID NO: 20058 - RNA, 9876 nt, synthetic construct
  misc_feature 1..9876: note = derived and/or modified CDS sequence (opt5) from DENV-2__FJ390387__SS-prME
  source 1..9876: mol_type = other RNA
agcgccggaatgatcattatgctgatccccaccgtcatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaagtgcccttcgagatcatggacctcgaaaagagatacgtcctgggacgcctgatcacagtgaaccctattgttacggagaaagattctccggtgaacatcgaagcggagcccccttttggcgactcctacattatcattggggtcgagcccggccaactcaagctgaattggttcaagaaaggaagctctatcggccagatgtttgaaaccacaatgagaggggctaagagaatggctattcttggagataccgcctgggacttcggcagcctcgggggagtgtttacatccatcggcaaagccctccatcaggtgttcggggctatctatggcgccgcgttttctggagttagctggaccatgaagattctgatcggcgtcattatcacgtggattgggatgaactcccgcagcacatctctgtccgtgagccttgtgctcgtcggaatcgtgaccctgtacctgggcgttatggtgcaggctgattctgggtgtgtcgtgtcctggaaaaataaggagctcaagtgcggaagcggcatcttcattaccgacaacgttcacacatggaccgaacaatataaatttcagcctgagtccccctctaagctggccagcgccatccagaaagctcaggaagaggggatttgtggcatccggtccgtgacaagacttgagaatctgatgtggaagcaaattacgccggaactcaaccacatcctggccgagaatgaagtcaaactgaccatcatgacaggagatattaagggcatcatgcaggctgggaaacgctctcttcggcctcagcccaccgagctcaagtacagctggaagacatggggaaaagccaagatgctgtccaccgaaagctataaccagacgttcctgattgacggccctgagaccgcggagtgccccaatacaaacagagcctggaactctctcgaagtggaggattacgggtttggagttttcaccacaaacatctggctgaaacttaaggaaaaacaagacgctttttgtgactccaagctgatgagcgccgctattaaggataatcgcgccgtgcatgcggacatgggctattggatcgagtctgccctcaacgatacctggaaaatcgagaaggcttccttcattgaagtcaaaaattgccactggcctaagagccatacactgtggtctaacggcgtgctggagagcgaaatgatcattcccaaaaaccttgccgggccggtgtcccagcacaattaccggcctggataccacacccagatcgctggcccctggcatctcgggaagctggagatggacttcgatttttgtgacggaacgacagtcattgttaccgaagattgcggcaacagagggcccagcctgcgcaccacaaccgcctctggaaagctcatcacggagtggtgctgtcggtcctgcacactgcctccgcttagatatcggggcgaggacggctgttggtacgggatggaaattcgccccctgaaagagaaggaagagaatctcgtgaacagcctggtgaccgccggacacggccaagtcgataatttctccctgggggtgcttggaatggctctctttctggaagagatgctgagaacacgggttggcaccaaacatgcgatcctcctggtggccgtctctttcgtgacacttatcaccgggaacatgagctttaaggacctgggaagagttgtggtcatggtgggcgctacgatgaccgatgacattggcatgggggttacatatctcgccctgctggccgctttcaaagtgcgccctacctttgccgcgggacttctgctccggaagctgacatccaaggagctcatgatgaccacgatcggcattgtcctgctttctcagagcacaatccccgaaaccgtgctggagctcacagatgctctggccctggggatgatggtgcttaaaattgtcagaaatatggaaaagtaccagctggccgttaccatcatggctatcctctgcgtgcctaacgccgtgattctgcagaatgcgtggaaagtctcctgtaccatcctcgctgtggtttctgtgagccccctgcttctgacatccagccaacagaagacggactggattcctctcgccctgaccatcaaaggactgaaccccacagccattttccttaccacactgtctcgcaccaataagaaaagatcctggccgctcaacgaggctatcatggccgtcggcatggtgagcatcctggcttcttccctcctgaagaatgacattcctatgacggggccccttgttgccggaggcctgctgacagtgtgctatgtcctcaccggccggagcgcggatctggaacttgagcgcgccaccgacgtgaagtgggaggatcaggctgaaatctctgggtccagccctattctgtccatcacaattagcgaggacggatctatgagcatcaaaaacgaagaggaggaacagaccctcacaattctgatcagaacgggcctcctggtcatctccgggctttttcccatttctatcccgattaccgccgctgcctggtacctgtgggaggtgaagaaacaacgggccggagttctgtgggatgtgccttctccccctcccatgggcaaggctgaactcgaggacggggcgtatcgcatcaaacagaagggcattctgggctactcccagatcggcgccggggtctacaaggaaggaacattccacaccatgtggcatgtgacaagaggcgctgttcttatgcacaaagggaagcggatcgagccctcctgggccgatgtgaaaaaggacctgattagctatggaggcgggtggaaactcgagggagaatggaaggagggcgaagaggtccaggtgctggccctcgaacctggcaagaatccgcgcgctgtgcaaaccaaacccgggctgtttaagacgaacaccggaacaatcggcgccgtttcccttgatttctctcctgggaccagcggatcccccattatcgacaaaaagggcaaagtcgtggggctgtacggaaacggcgtggtcacaagaagcggcgcgtatgtgtctgctattgcccagaccgagaagtccatcgaggataatcctgaaatcgaggacgatatttttcggaagcgcagactgacaatcatggacctccaccccggggccggaaaaacgaagcggtacctgcctgctattgttagagaagccatcaaacgcggccttcggaccctgattctcgcgccgacaagagtggtcgctgccgagatggaagaggccctgcgcgggctccccatccggtatcagacccctgctattagagccgagcataccggacgcgaaatcgtggacctgatgtgtcacgctacattcacgatgcggcttctgagccccgttagagtgcctaactacaatctgatcattatggatgaggcccatttcaccgaccccgcgtctatcgccgctcgcggctatatttccacacgggtcgaaatgggggaggccgctggcatctttatgaccgccacaccgcctggaagcagagatcccttcccccaatccaacgcccctattatcgacgaggaacgggagatccccgaacgctcttggaatagcggccacgagtgggtgaccgattttaaggggaaaacggtttggttcgtgccttccattaaggctggaaacgacatcgcggcctgcctcagaaagaatggcaaaaaggtcattcagctgagccggaaaacatttgattctgaatacgtgaagacccgcaccaacgactgggatttcgtggtcacaaccgacatctccgagatgggggctaattttaaagccgagagagttattgatccgcggagatgtatgaagcccgtgatccttacagacggagaggaacgcgtgatcctggccggccctatgcccgtcacccatagctctgctgcccagcggagagggcgcattggccggaaccctaaaaatgaaaacgaccagtacatctatatgggagagcccctcgaaaatgatgaggactgcgcgcactggaaggaggctaagatgctgctggataacattaatacgccggaaggcatcattcctagcatgttcgagcccgaaagagagaaagtggacgccatcgatggggaataccgcctccggggagaggccagaaagacatttgttgaccttatgcgcagaggcgatctgcctgtgtggctggcttataaagtcgccgcggaggggattaactacgccgaccggcgctggtgtttcgatggaatcaagaacaatcaaatcctcgaagagaacgtggaagttgagatttggaccaaagagggcgaaagaaagaagctgaaaccccggtggcttgacgctcgcatctattccgatcctctggccctcaaggagtttaaagagttcgctgccgggagaaagtctctgacactgaatctcattaccgagatgggccggcttcccacgttcatgacccagaaaacaagagacgctctggataacctggccgtgctccacaccgcggaagccggaggccgcgcttacaatcatgccctgagcgagcttccggagacactggaaaccctcctgctgctcacacttctggctaccgtcacagggggaatctttctgttcctcatgtccggccgggggattggaaagatgacactgggcatgtgctgcatcatcaccgcctctattcttctgtggtatgcccagatccagcctcactggattgctgcgagcatcattctcgagtttttcctgatcgtgctgctcatccccgaacccgagaagcaaagaacccctcaggacaaccagcttacatacgtcgtgattgccatcctgaccgttgtggctgccacaatggccaatgaaatgggctttctggagaaaacgaagaaagacctcgggctgggatccattgctacccagcaaccggagagcaacatccttgatattgacctgcgccccgcctctgcgtggacactctacgccgtggctaccacattcgtcacccctatgctgcggcattccatcgaaaatagctccgttaacgtgtctctgacggccattgctaatcaggccaccgtgctcatgggccttgggaagggatggcccctgagcaaaatggatatcggcgtccctctgctcgcgatcgggtgttattcccaggtgaaccccattacactgaccgccgcccttctgctcctggttgcccactacgctatcattggacctggcctgcaggccaaggctacaagagaggcccaaaagcgggcggccgctggcatcatgaaaaatccgaccgtggacgggattacggtcatcgatctcgaccccatcccttatgatcccaagtttgaaaaacagcttggacaggtgatgctgctgattctctgcgtcacacaagtgctgatgatgcgcaccacatgggccctttgtgaggctctgaccctcgccaccggccctatctctacactgtgggaagggaaccccggaagattctggaatacgaccattgccgttagcatggcgaacatctttcggggctcctacctggctggggccggactccttttcagcattatgaagaatacaaccaacacacgcagaggcaccggcaacatgggggagacgctgggagagaaatggaagtctcggctgaatgctctcggcaaatccgaatttcagatctataaaaagagcgggatccaggaggtggaccgcacactggccaaagaaggaattaagagaggcgagaccgatcaccatgccgtctctcgggggtccgctaaacttcgctggttcgtggagagaaacatggttaccccggaaggaaaggtggtcgacctgggctgcggcagagggggatggagctactattgtggcgggctcaaaaatgtgcgggaggtgaagggactgacaaagggcgggcctggacacgaagaacccatccccatgtctacctacggctggaacctggttcgcctccagagcggcgtcgatgtgtttttcattcctcccgaaaaatgcgacacacttctgtgtgatatcggggagtcctctcctaatccgacggtggaggccggacggaccctgagagtcctcaacctggttgaaaattggcttaacaataacacacaattctgcattaaggtgctgaatccctacatgcctagcgtgatcgagaaaatggaagcgctccagcgcaagtatggcggggccctggtccggaaccccctgtccagaaatagcacccatgagatgtactgggtgtccaacgcttctggaaatatcgttagctccgtgaacatgatttctcgcatgctcatcaaccggtttacaatgagacacaaaaaggccacctatgaacctgacgtcgaccttggcagcgggacgcgcaatattggaatcgagtccgagattcccaacctggatatcattggcaagcggatcgagaagatcaagcaggagcatgaaacctcttggcactacgaccaggatcacccgtataaaacatgggcttaccatggcagctatgagaccaagcaaacagggtccgccagctctatggtgaatggagttgtgagactgctcaccaaaccttgggacgtcctgcccacagtgacccagatggcgatgacggatacaacccctttcggccagcagcgcgtgtttaaggaaaaggtcgacacccggacacaagagcccaaagaggggacgaagaaacttatgaagattaccgccgaatggctgtggaaagagctcggaaagaaaaagacacctagaatgtgtacccgcgaagagttcacaagaaaggttcggtccaacgctgccctgggcgctatctttaccgatgagaataaatggaaaagcgcccgcgaagctgtggaggactctagattctgggaactggtggataaagagcggaacctccacctggaagggaagtgcgagacatgtgtctacaatatgatgggaaaaagagagaagaaacttggcgaatttggcaaagccaaggggtcccgggcgatttggtacatgtggctgggagcccgcttcctcgagtttgaagctctgggcttccttaacgaggaccattggtttagcagagaaaattctctgtccggggtggagggagagggcctccacaaactggggtatatcctgcgggatgttagcaagaaagaaggcggagccatgtacgctgacgacaccgccggctgggatacgcgcattaccctcgaggacctgaagaacgaagagatggtgacaaatcacatggaaggggagcataagaaacttgccgaggcgatcttcaagctgacctatcagaacaaagtcgtgagagttcagcggcccacaccgcgcggaaccgtgatggatatcatttccagacgggaccaacgcggcagcgggcaggtcggaacgtacggcctcaatacatttaccaacatggaagctcagctgatcagacagatggagggggaaggcgtgttcaagaatattcaacaccttacagttaccgaggaggtggccgtcaaaaactggctggcccgggtgggacgcgaaagactctctcggatggctatcagcggcgatgactgcgtcgtgaagcctctggatgaccgcttcgccaacgctctgacggccctcaatgatatggggaagattagaaaagacatccagcagtgggagccctccaagggatggaacgattggacccaggttcccttttgctctcatcacttccatgaactgatcatgaaagacggccgggtgcttgtcgtgccttgtagaaatcaagatgagctggtggggcgcgcgcggattagccagggagccggctggtccctcagagaaacagcttgcctggggaagtcttatgcccagatgtggagccttatgtactttcaccgccgggacctgagactcgctgccaacgcgatctgttccgccgttccgtctcactgggtgcccaccagccgcacaacctggtccattcatgctaaacacgagtggatgacaaccgaggacatgctgacggtctggaatcgggtgtggatcagagaaaacccttggatggaggataagacacccgttgaaagctgggaggaaattccttatctgggcaagcgcgaggaccagtggtgcggatctctcatcggcctgacctcccgggccacctgggctaaaaatattcaagccgctatcaaccaggtgagaagccttatcgggaatgaggaatacacagattacatgccctctatgaagcgcttccggagagaggaagaggaagccggagtcctgtggtga

SEQ ID NO: 20059 - RNA, 9876 nt, synthetic construct
  misc_feature 1..9876: note = derived and/or modified CDS sequence (opt5) from DENV-2__FJ024461__SS-prME
  source 1..9876: mol_type = other RNA
agcgccggcatgatcattatgctgatccccaccgtgatggctttccacctgaccacgagaaatggggaacctcatatgattgtcggaatccaggaaaagggcaaatccctgctttttaagaccgaagacggggttaatatgtgcacgctgatggccatggatcttggagaactgtgtgaggacaccattacatacaaatgcccgcttctgcggcaaaatgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggcttccttcatcgaagtgaagaattgccactggcctaaaagccatacactgtggtctaacggcgtcctggagagcgaaatgattatccccaagaaccttgccgggccggtgtcccaacacaattaccggctcggataccacacccagattgctggcccttggcatctggggaagctggagatggacttcgatttttgtgacggaacgacagtgatcgtcaccgaagattgcggcaacagagggcccagcctccgcaccacaaccgcctctggaaaactgattacggagtggtgctgtcggtcctgcacacttccccctctgagatatcggggcgaggacggctgttggtacgggatggaaatccgcccgctcaaggagaaagaagagaatctggttaacagcctggtgaccgccggacacggccaggtggataatttctcccttggggtcctcggaatggctctgtttctggaagagatgctcagaacacgggtgggcaccaagcatgcgatcctgcttgttgccgtgtctttcgtcacactgattaccgggaacatgagctttaaagacctcggaagagtggttgtgatggtcggcgctacgatggccgatgacatcggcatgggggtgacctatctggccctgcttgctgccttcaaggttcgccccacatttgcggctggactgctcctgcggaagctcacctccaaagagctgatgatgacaaccattggcatcgtgcttctgtctcaaagcacgattcctgaaacagtcctcgagctgaccgatgccctggcccttgggatgatggtgctgaagatcgtgagaaatatggaaaaataccagctcgctgtcacaatcatggccattctgtgcgttcccaacgcggtgatcctccagaatgcttggaaggtgtcctgtaccattctggccgtcgtgtctgttagccctcttctgctcacctccagccagcagaagaccgactggatccccctggccctgacgattaagggacttaaccctaccgctatcttcctgacaaccctctctcgcacaaataaaaagagatcctggcccctgaacgaggccatcatggctgtgggcatggtcagcattctcgcctcttccctgcttaagaatgacatcccgatgaccgggcctctggtggcgggaggcctgctcacggtttgctatgtgctgacaggccggagcgccgatcttgaactggagcgcgctaccgacgtcaaatgggaggatcaggccgaaatttctgggtccagccccatcctctccattaccatcagcgaggacggatctatgagcattaagaacgaagaggaggaacagacactgaccatcctcatcagaacaggcctgcttgtgatttccgggctgtttcctatctctattcccatcacggctgccgcctggtacctgtgggaggtcaaaaagcagcgggctggagtgctctgggatgttccgagccctccccctatgggcaaagcggaactggaggacggggcctatcgcattaagcaaaagggaatccttggctactcccagatcggcgctggggtgtacaaagaaggaaccttccacacaatgtggcatgtcaccagaggcgccgtgctgatgcacaaggggaaacggattgagccctcttgggccgatgttaagaaagacctcatcagctatggaggcgggtggaagctggagggagaatggaaggagggcgaagaggtgcaggtcctcgctctggaacccggcaaaaatcctcgcgccgtgcagacaaagccggggctttttaaaaccaacacgggaaccattggcgcggtgtccctggatttctctcccgggacaagcggatcccctatcattgacaagaaaggcaaggttgtcgggctgtacggaaacggcgtggtgaccagaagcggcgcttatgtctctgccatcgcccaaacagagaaggggatcgaggataatcccgaaattgaggacgatatctttcggaaacgcagactcaccattatggacctgcaccctggagctggcaagacaaaacggtaccttcccgccatcgtgagagaagcgattaagcgcgggctgcggacgctcatcctggctcctaccagagttgtggccgccgagatggaagaggctctccgcggactgccgattcggtatcagacacccgccatcagagctgagcataccggccgcgaaatcgtcgaccttatgtgtcacgccaccttcacaatgcggctgctgtcccctgtgagagttcccaactacaatctcattatcatggatgaggcgcatttcacggaccctgccagcattgctgcccgcgggtatatctctacccgggtggaaatgggcgaggctgccggaatttttatgacagccacacccccgggctccagagatcctttcccccagagcaacgctcccatcatcgacgaggaacgggagattcctgaacgctcctggaactctgggcacgagtgggtcacagattttaaaggaaagaccgtgtggttcgttcccagcatcaaggcgggcaacgacattgccgcttgcctgcgcaaaaatgggaagaaagtgatccaactttcccggaagacgtttgatagcgaatacgtcaaaacacgcaccaacgactgggatttcgtggtgaccacagacatttctgagatgggagccaattttaaggccgagagagtcatcgatcctcggagatgtatgaaaccggttatcctgaccgacggcgaggaacgcgtgattctcgctgggcccatgcctgtgacacattccagcgccgcgcagcggagaggccgcatcggacggaaccccaagaatgaaaacgaccagtacatttatatgggcgagcctctggaaaatgatgaggactgcgctcactggaaggaggccaaaatgctgctcgataacatcaatacccccgaagggattatcccgtctatgttcgagcctgaaagagagaaggtcgacgccattgatggagaataccgccttcggggcgaggctagaaaaacgtttgtggacctgatgcgcagaggggatctgcccgtttggctcgcctataaggtggcggccgagggaatcaactacgctgaccggcgctggtgtttcgatggcatcaaaaacaatcagattctggaagagaacgtcgaagtggagatctggacaaaggagggggaaagaaagaaacttaagcctcggtggctggacgcccgcatttatagcgatcccctcgctctgaaagagtttaaggagttcgccgctggcagaaaatccctgaccctcaatcttatcacagagatgggacggctgcctaccttcatgacgcaaaagaccagagacgccctggataacctcgcggttctgcacacagccgaagctggcgggcgcgcctacaatcatgctctttctgagctgcccgagaccctcgaaacactgctgctccttaccctgctggccacagtgaccggaggcatttttctcttcctgatgagcgggcggggaatcggcaagatgacgcttggcatgtgctgcatcattacagcctccatcctgctctggtatgctcagattcagccgcactggatcgcggcctctattatcctggagtttttcctgatcgtcctccttattcctgaacccgagaaacagagaacaccccaagacaaccagctgacctacgtggtcatcgctattctgacagtggttgccgccaccatggctaatgaaatggggtttctcgagaagaccaagaaggacttcggactgggcagcatcgccacgcagcagcctgagtccaacattcttgatatcgacctgcgcccggcgagcgcctggaccctctacgctgtggccacaacctttgtgacacccatgctgcggcattctattgaaaattccagcgtcaacgtttccctgaccgctatcgccaatcaagcgacggtgctcatggggcttggaaaaggctggcctctgtctaagatggatatcggggtgcccctgctcgccattggatgttatagccaggtcaaccctatcaccctgacagctgcccttctgctcctggtggctcactacgccattatcggccccggcctgcaggctaaggccaccagagaggcgcagaaacgggccgctgccgggattatgaagaatcctacagttgacggaatcaccgtgatcgatctcgacccgattccctatgatcctaaattcgaaaagcaacttggccaggtcatgctgctgatcctctgcgtgacgcaggtcctgatgatgcgcacaacctgggctctttgtgaggccctgacactcgccaccgggcccatttccaccctgtgggaaggaaaccctggcagattttggaatacaacgatcgcggtgtctatggctaacattttccgggggagctacctggccggagctggcctcctcttttccatcatgaaaaataccacaaacacccgcagaggcacagggaacatcggagagaccctgggcgagaagtggaaaagccggctgaatgccctcgggaagtctgagttccaaatttataagaaatccggaatccaggaggttgaccgcacgctggccaaggaaggcattaaaagaggggagacagatcaccatgctgtgagccggggatctgccaaacttcgctggtttgtcgagagaaacatggtgacccccgaaggcaaagttgtggacctgggctgcgggcggggaggctggtcctactattgtgggggactcaagaatgtcagagaggtgaagggcctgaccaaagggggaccgggccacgaagaacctatccccatgagcacatacggctggaacctggtgcgcctccagtctggggttgatgtcttcttcattccccctgaaaagtgcgacacccttctgtgtgatatcggagagagctcccccaatcctacagtggaggcgggccggacgctgagagtgctcaacctggtcgaaaattggcttaacaataacacccagttttgcatcaaagttctgaatccgtacatgccctctgtgattgagaagatggaagccctccaacgcaaatatgggggagctctggtgcggaaccctctgagcagaaattccacacatgagatgtactgggtcagcaacgcctccggcaatatcgtgtctagcgttaacatgatttcccgcatgctcatcaaccggttcaccatgagacacaagaaggctacatatgaacccgacgtggaccttgggtctggaacccgcaatattggcatcgagagcgagattcctaacctggatatcatcggcaaacggattgaaaagatcaaacaggagcatgaaacgtcctggcactacgaccaggatcacccctataagacctgggcctaccatgggtcttatgagacaaaacagaccggaagcgcgtccagcatggtcaatggcgtggttagactgctcacaaagccgtgggacgtgctgcctaccgtcacacaaatggccatgaccgatacgacaccctttgggcagcagcgcgtgttcaaggaaaaagtggacacccggacccaggagcctaaggagggaaccaagaaacttatgaaaattacggctgaatggctgtggaaggagctcggcaaaaagaagacccccagaatgtgtacacgcgaagagtttaccagaaaagtccggtctaacgccgctctgggggccatcttcacagatgagaataagtggaaatccgctcgcgaagccgttgaggacagcagattttgggaactggtggataaggagcggaacctccacctggaaggaaaatgcgagacctgtgtgtacaatatgatgggcaagagagagaagaaacttggcgagttcgggaaggcgaaaggatctcgggccatttggtacatgtggctgggcgctcgctttctcgagttcgaagccctggggtttcttaacgaggaccattggttctccagagaaaatagcctgtctggagtcgagggcgaggggctccacaagctgggctatatcctgcgggatgtgtccaaaaaggaaggaggcgctatgtacgccgacgacacagccgggtgggatacccgcatcacgctcgaggacctgaagaacgaagagatggttaccaatcacatggaaggagagcataagaaacttgcggaggctatttttaaactgacatatcaaaacaaagtggtcagagtgcagcggcctacccccagaggcacagttatggatatcattagcagacgggaccagcgcgggtccggacaagtgggcacctacgggctcaatacgttcacaaacatggaagcccagctgatcagacagatggagggcgaaggagtcttcaaaaatattcagcaccttaccgtgacagaggaggttgccgtgcaaaactggctggctcgggtcggccgcgaaagactcagccggatggccatctctggggatgactgcgtggtcaagccgctggatgaccgctttgctaacgccctgaccgcgctcaatgatatgggaaagatcagaaaagacattcagcagtgggagcctagcaagggctggaacgattggacacaggtgcccttctgctcccatcactttcatgaactgatcatgaaagacgggcgggttcttgtggtcccctgtagaaatcaagatgagctgattggacgcgcccggatctctcagggcgctgggtggagcctcagagaaaccgcctgcctgggcaagtcctatgctcagatgtggtctcttatgtacttccaccgccgggacctgagactcgccgcgaacgccatttgtagcgctgtgccttcccactgggtgccgacatctcgcaccacatggagcatccatgccaaacacgagtggatgaccacagaggacatgctgaccgtttggaatcgggtgtggattagagaaaacccctggatggaggataagacgcctgtcgaatcctgggaggaaatcccctatctgggaaagcgcgaggaccagtggtgcggcagcctcatcgggctgacatctcgggctacctgggccaaaaatattcaagctgccatcaaccaggtgagatcccttattggaaatgaggaatacaccgattacatgcctagcatgaagcgctttcggagagaggaagaggaagcgggcgttctgtggtga

SEQ ID NO: 20060 - RNA, 9876 nt, synthetic construct
  misc_feature 1..9876: note = derived and/or modified CDS sequence (opt5) from DENV-2__FJ373299__SS-prME
  source 1..9876: mol_type = other RNA
agcgccggaatgatcattatgctgatccccaccgtgatggctttccacctgacaacgcggaatggggagcctcatatgattgtcggaatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgccgggaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaggacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactcccgcctgatgagcgccgctatcaaggataatcgggccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccagcacaattacagacctggataccacacccagattgctggcccctggcatctcgggaaactggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaggagaaagaagagaatctcgttaacagcctggtgaccgccggacacggccaagtggataatttctccctgggggtccttggaatggctctctttctggaagagatgctgcggacaagagtgggcaccaagcatgcgatcctcctggttgccgtgtctttcgtcacacttattaccgggaacatgagctttaaagacctgggacgcgtggttgtgatggtcggcgctacgatggccgatgacatcggcatgggggtgacctatctcgccctgctggctgccttcaaggttcggcctacatttgcggctggacttctgctcagaaaactgacctccaaggagctcatgatgacaaccattggcatcgtgctgctttctcagagcacgattcccgaaacagtcctggagctcaccgatgccctggccctggggatgatggtgcttaagatcgtgcgcaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccaacagaaaacagactggatccctctcgccctgacgattaagggactgaaccccaccgctatcttccttacaaccctgtctagaacaaataaaaagcggtcctggccgctcaacgaggccatcatggctgtgggcatggtcagcattctggcctcttccctcctgaaaaatgacatccctatgaccgggccccttgtggcgggaggcctgctgacggtttgctatgtgctcacaggccgcagcgccgatctggaacttgagagagctaccgacgtcaagtgggaggatcaggccgaaatttctgggtccagccctatcctgtccattaccatcagcgaggacggatctatgagcattaagaacgaagaggaggaacagacactcaccatcctgatccggacaggcctcctggtgatttccgggctttttcccatctctattccgatcacggctgccgcctggtacctgtgggaggtcaaaaagcaacgcgctggagtgctgtgggatgttccttctccccctcccatgggcaaagcggaactcgaggacggggcctatagaattaagcagaaaggaatcctgggctactcccagatcggcgctggggtgtacaaggaaggaaccttccacacaatgtggcatgtcacccggggcgccgtgcttatgcacaaggggaaacgcattgagccctcctgggccgatgttaagaaagacctgatcagctatggaggcgggtggaagctcgagggagaatggaaagagggcgaagaggtgcaggtcctggctctcgaacctggcaagaatccgagagccgtgcaaacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccggagcggcgcttatgtctctgccatcgcccagacagagaaatccatcgaggataatcctgaaattgaggacgatatctttcgcaagagacggctgaccattatggacctccaccccggggctggaaagacaaaaagatacctgcctgccatcgtgcgcgaagcgattaagcggggccttagaacgctgatcctcgctccgacccgcgttgtggccgccgagatggaagaggctctgcgggggctccccattagatatcagacccctgccatccgcgctgagcataccggacgggaaatcgtcgacctgatgtgtcacgccaccttcacaatgagacttctgagccccgtgcgcgttcctaactacaatctgattatcatggatgaggcgcatttcacggaccccgcctctattgctgcccggggctatatctccaccagagtggaaatgggggaggctgccggcatttttatgacagccaccccgcctggaagccgggatcccttcccccaatccaacgctcctatcatcgacgaggaacgcgagattcccgaaagatcttggaatagcggccacgagtgggtcacagattttaaagggaagaccgtgtggttcgttccttccatcaaagcgggaaacgacattgccgcttgcctccggaagaatggcaagaaagtgatccagctgagccgcaagacgtttgattctgaatacgtcaaaacaagaaccaacgactgggatttcgtggtgaccacagacatttccgagatgggggccaattttaaggccgagcgggtcatcgatccgagacgctgtatgaaacccgttatccttaccgacggagaggaacgggtgattctggctggccctatgcccgtgacacatagctctgccgcgcagagacgcgggcggatcggcagaaaccctaagaatgaaaacgaccagtacatttatatgggagagcccctcgaaaatgatgaggactgcgctcactggaaagaggccaagatgctgctggataacatcaataccccggaaggcattatccctagcatgttcgagcccgaacgcgagaaggtcgacgccattgatggggaataccggctcagaggagaggctcgcaaaacgtttgtggaccttatgagacggggcgatctgcctgtttggctggcctataaggtggcggccgggggaatcaactacgctgaccgcagatggtgtttcgatggcatcaaaaacaatcaaattctcgaggaaaacgtcgaggtggaaatctggacaaaggagggggagcggaaaaagctgaagccccgctggcttgacgccagaatttattccgatcctctggctctcaaagaatttaaggagttcgccgctggccggaaatctctgaccctgaatctcatcacagaaatgggaagacttcccaccttcatgacgcagaagacccgcgacgccctggataacctggcggttctccacacagccgaggctggcgggcgggcctacaatcatgctctgagcgaacttccggagaccctggagacactcctgctgctcacccttctggccacagtgaccggaggcatttttctgttcctcatgtccgggagaggaatcggcaaaatgacgctgggcatgtgctgcatcattacagcctctatccttctgtggtatgctcagattcagcctcactggatcgcggccagcattatcctcgaatttttcctgatcgtcctgctcattcccgagcccgaaaagcaacgcacccctcaggacaaccagcttacctacgtggtcatcgctattctgacagtggttgccgccaccatggctaatgagatggggtttctggaaaagaccaagaaggacctcggactgggctccatcgccacgcagcaaccggagagcaacattcttgatatcgacctgcggcccgcgtctgcctggaccctctacgctgtggccacaaccttcgtgacacctatgctgagacattccattgagaatagctccgtcaacgtttctctgaccgctatcgccaatcaggcgacggtgctcatggggcttggaaaaggctggcccctgagcaagatggatatcggggtgcctctgctcgccattggatgttattcccaggtcaaccccatcaccctgacagctgcccttctgctcctggtggctcactacgccattatcggccctggcctgcaggctaaagccacccgggaagcgcaaaagcgcgccgctgccgggattatgaagaatccgacagttgacggaatcaccgtgatcgatctcgaccccattccttatgatcccaaatttgagaagcagcttggccaggtcatgctgctgatcctctgcgtgacgcaagtcctgatgatgagaacaacctgggctctttgtgaagccctgacactcgccaccgggcctatttctaccctgtgggagggaaaccccggccggttctggaatacaacgatcgcggtgagcatggctaacatttttcgcgggtcctacctggccggagctggcctccttttcagcatcatgaaaaataccacaaacaccagacggggcacagggaacatgggagaaaccctgggcgagaagtggaaatctcgcctgaatgccctcgggaagtccgagtttcagatctataaaaagagcggcattcaggaagttgacagaacgctggccaaggagggcatcaaaagaggggaaacagatcaccatgctgtgtctcgcggatccgccaaacttagatggttcgtcgagcggaacatggtgaccccggagggcaaagttgtggacctgggctgcgggagaggaggctggagctactattgtgggggactcaagaatgtccgcgaagtgaaaggcctgaccaaagggggacctggccacgaggaacccattcccatgtctacatacggctggaacctggtgcggctccagagcggggttgatgtctttttcatccctcccgagaagtgcgacacccttctgtgtgatattggagaatcctctcctaatccgacagtggaggcgggcagaacgctgcgcgtgctcaacctggtcgagaattggcttaacaataacacccaattctgcatcaaagttctgaatccctacatgcctagcgtgatcgaaaagatggaggccctccagcggaaatatgggggagctctggtgagaaaccccctgtcccgcaatagcacacatgaaatgtactgggtctccaacgcctctggcaatattgtgagctccgttaacatgatctctcggatgctcattaacagatttaccatgcgccacaagaaagctacatatgagcctgacgtggaccttgggagcggaacccggaatatcggcattgaatccgagacgcccaacctggatatcattggcaagagaatcgagaagatcaaacaggaacatgagacctcttggcactacgaccaggatcacccgtataagacatgggcctaccatgggagctatgaaaccaaacaaacaggatccgcgagctctatggtcaatggcgtggttcgcctgctcaccaagccttgggacgtgctgcccacagtcacccagatggccatgacggatacaacccctttcgggcagcagcgggtgtttaaagagaaggtggacaccagaacacaagaacccaaggagggaacgaagaaacttatgaaaattaccgctgagtggctgtggaaagaactcggcaaaaagaaaacacctcgcatgtgtaccagagaggagttcacacggaaggtccgctccaacgccgctctgggggccatctttaccgatgagaataagtggaaaagcgctagagaggccgttgaagactctcggttctgggagctggtggataaggaaagaaacctccacctggagggaaaatgcgaaacatgtgtgtacaatatgatgggcaagcgggagaagaaacttggcgagtttgggaaagcgaaaggatcccgcgccatttggtacatgtggctgggcgctagattcctcgaatttgaggccctggggttccttaacgaagaccattggtttagccgggaaaattctctgtccggagtcgaaggcgaggggctccacaagctgggctatatcctgcgcgatgtgagcaaaaaggagggaggcgctatgtacgccgacgacaccgccgggtgggatacgagaattaccctcgaagacctgaaaaacgaggaaatggttacaaatcacatggagggagaacataagaaacttgcggaggctatcttcaaactgacctatcagaacaaggtggtccgggtgcagcgccccacaccgagaggcaccgttatggatatcatttcccggcgcgaccaaagagggagcggacaggtgggcacgtacgggctcaatacatttaccaacatggaggcccagctgatccggcagatggaaggcgagggagtcttcaaaaatattcaacaccttacagtgaccgaagaggttgccgtgcagaactggctggctcgcgtcggcagagagcggctctctcgcatggccatcagcggggatgactgcgtggtcaagcctctggatgacagattcgctaacgccctgacggcgctcaatgatatgggaaaaattcggaaggacatccagcagtgggaaccctccaagggctggaacgattggacccaagtgcccttttgctctcatcacttccatgagctgatcatgaaagacgggagagttcttgtggtcccttgtcgcaatcaggatgaactgattggacgggccagaatcagccagggcgctgggtggtccctccgcgagacagcctgcctgggcaagtcttatgctcagatgtggagccttatgtactttcaccggagagacctgcgcctcgccgcgaacgccatttgttccgctgtgccgtctcactgggtgcccaccagccggacaacctggtccatccatgccaaacacgaatggatgacaaccgaggacatgctgacggtttggaatagagtgtggattcgcgagaacccttggatggaagataagacacccgtcgagagctgggaagagatcccttatctgggaaaacgggaagaccaatggtgcggctctctcattgggctgacctccagagctacctgggccaagaatatccaggtggctatcaaccaggttcgcagccttattggaaatgaggagtacacagattacatgccctctatgaagcggttcagacgggaagaggaagaggccggcgtgctgtggtga

SEQ ID NO: 20061 - RNA, 9876 nt, synthetic construct
  misc_feature 1..9876: note = derived and/or modified CDS sequence (opt5) from DENV-2__FJ410193__SS-prME
  source 1..9876: mol_type = other RNA
agcgccggcatgatcattatgctgatccccacagtgatggctttccacctgacaacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttatttgcaagcatagcatggtggatcgcggctggggcaatgggtgtggactgttcggcaaagggggaatcgtgacctgcgctatgtttacatgcaagaaaaacatggaaggcaagattgtccagcctgagaatctcgaatacacgatcgttgtgacaccccactctggggaggagcatgccgtgggaaacgacacaggcaaacacggcaaggaaatcaaagtcacccctcagtccagcattacagaggcggaactgaccgggtatggaacggtgaccatggagtgttctcccagaacaggccttgatttcaatgaaatggttctgctccaaatggagaacaaggcctggctggtgcaccggcagtggtttcttgacctgccgctcccttggctgcccggggctgataagcaggagtccaattggatccagaaagaaaccctggtcacattcaagaaccctcatgccaaaaagcaagacgtggttgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgtcatccgggtgcagtatgaaggcgatgggagcccctgcaagatccccttcgagattatggacctcgagaagcggtacgttctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagtcttcaccacaaacatctggctgaaacttaaagaaaagcaggacgctttttgtgactccaagctgatgagcgccgctatcaaagataatcgcgccgtgcatgcggacatgggctattggattgagtctgccctcaacgatacctggaagatcgagaaggctagcttcattgaagttaagaattgccactggcctaaaagccatacactgtggtctaacggcgtgctggagagcgaaatgatcattcccaagaaccttgccgggccggtctcccaacacaattaccggcctggataccacacccagatcgctggcccctggcatctcgggaagctggagatggacttcgatttttgtgacggaacgacagtgattgtgaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaatccgccccctgaaggagaaagaagagaatctcgtcaacagcctggttaccgccggacacggccaggtggataatttctccctgggggtgcttggaatggctctctttctggaagagatgctgagaacacgggtcggcaccaagcatgcgattctcctggtggccgtttctttcgtgacacttatcaccgggaacatgagctttaaagacctgggaagagtcgtggttatggtgggcgctacgatggccgatgacattggcatgggggtcacctatctcgccctgctggctgccttcaaggtgcgccctacatttgcggctggacttctgctccggaagctgacctccaaagagctcatgatgacaaccatcggcattgttctgctttctcaaagcacgatccccgaaacagtgctggagctcaccgatgccctggccctggggatgatggtccttaagatcgtgagaaatatggaaaaataccagctggctgtgacaattatggccatcctctgcgtccctaacgcggttattctgcagaatgcttggaaggtgtcctgtaccatcctcgccgtggtctctgtgagccccctgcttctgacctccagccagcagaagaccgactggattcctctcgccctgacgatcaagggactgaaccccaccgctatcttccttacaaccctgtctcgcacaaataaaaagagatcctggccgctcaacgaggccattatggctgttggcatggtgagcatcctggcctcttccctcctgaagaatgacattcctatgaccgggccccttgtcgcgggaggcctgctgacggtgtgctatgttctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccatcctgattagaacaggcctcctggtcatctccgggctttttcccatttctatcccgattacggctgccgcctggtacctgtgggaggtgaaaaagcagcgggctggagtcctgtgggatgtgccttctccccctcccatgggcaaagcggaactcgaggacggggcctatcgcatcaagcaaaagggaatcctgggctactcccagattggcgctggggtttacaaagaaggaaccttccacacaatgtggcatgtgaccagaggcgccgtccttatgcacaaggggaaacggatcgagccctcctgggccgatgtgaagaaagacctgattagctatggaggcgggtggaagctcgagggagaatggaaggagggcgaagaggttcaggtgctggctctcgaacctggcaaaaatccgcgcgccgtccagacaaagcccgggctgtttaaaaccaacacgggaaccatcggcgcggtgtcccttgatttctctcctgggacaagcggatcccccattatcgacaagaaaggcaaggtggttgggctgtacggaaacggcgtcgtgaccagaagcggcgcttatgtgtctgccatcgcccaaacagagaagtccattgaggataatcctgaaatcgaggacgatatttttcggaaacgcagactgaccatcatggacctccaccccggggctggaaagacaaaacggtacctgcctgccattgtcagagaagcgatcaagcgcggccttcggacgctgattctcgctccgaccagagtggttgccgccgagatggaagaggctctgcgcgggctccccatccggtatcagacccctgccatcagagctgagcataccggacgcgaaattgtggacctgatgtgtcacgccaccttcacaatgcggcttctgagccccgtcagagtgcctaactacaatctgatcattatggatgaggcgcatttcacggaccccgcctctatcgctgcccgcggctatatttccacccgggttgaaatgggggaggctgccggcatctttatgacagccaccccgcctggaagcagagatcccttcccccagtccaacgctcctatcattgacgaggaacgggagatccccgaacgctcttggaatagcggccacgagtgggtgacagattttaaagggaagaccgtctggttcgtgccttccattaaggcgggaaacgacatcgccgcttgcctccgcaaaaatggcaagaaagttattcaactgagccggaagacgtttgattctgaatacgtgaaaacacgcaccaacgactgggatttcgtcgtgaccacagacatctccgagatgggggccaattttaaggccgagagagtgatcgatccgcggagatgtatgaaacccgtcattcttaccgacggagaggaacgcgttatcctggctggccctatgcccgtgacacatagctctgccgcgcagcggagagggcgcattggccggaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaataccgcctccggggagaggctagaaaaacgtttgtcgaccttatgcgcagaggcgatctgcctgtgtggctggcctataaggttgcggccgaggggatcaactacgctgaccggcgctggtgtttcgatggaattaaaaacaatcagatcctcgaagagaacgtggaagtcgagatttggacaaaggagggcgaaagaaagaaactgaagccccggtggcttgacgcccgcatctattccgatcctctggctctcaaagagtttaaggagttcgccgctgggagaaaatctctgaccctgaatctcattacagagatgggccggcttcccaccttcatgacgcaaaagaccagagacgccctggataacctggcggtgctccacacagccgaagctggaggccgcgcctacaatcatgctctgagcgagcttccggagaccctggaaacactcctgctgctcacccttctggccacagttaccgggggaatctttctgttcctcatgtccggccgggggatcggaaagatgacgctgggcatgtgctgcattacaaccgcctctatccttctgtggtatgctcagattcagcctcactggatcgcggccagcattatcctcgagtttttcctgatcgtgctgctcattcccgaacccgagaaacagagaacccctcaagacaaccagcttacatacgtcgtgatcgctattctgaccgtcgtggccgccacaatggctaatgaaatgggctttctggagaagacgaaaaaggacctcgggctgggatccatcgccacccagcagccggagagcaacattcttgatatcgacctgcgccccgcgtctgcctggacactctacgctgttgccaccacattcgtgacccctatgctgcggcattccattgaaaatagctccgtgaacgtctctctgacggctatcgccaatcaagcgaccgttctcatgggccttgggaaaggatggcccctgagcaagatggatatcggcgtgcctctgctcgccattgggtgttattcccaggtgaaccccatcacactgaccgctgcccttctgctcctggtcgctcactacgccattatcggacctggcctgcaggctaaggccacaagagaggcgcagaaacgggccgctgccggcattatgaagaatccgaccgtggacgggatcacggttatcgatctcgaccccattccttatgatcccaaatttgaaaagcaacttggacaggtgatgctgctgatcctctgcgtcacacaggtgctgatgatgcgcaccacatgggctctttgtgaggccctgaccctcgccaccggccctatttctacactgtgggaagggaaccccggaagattctggaatacgaccatcgcggtcagcatggctaacatttttcggggctcctacctggccggggctggactccttttcagcatcatgaaaaatacaaccaacacacgcagaggcaccggcaacatgggggagacgctgggagagaagtggaaatctcggctgaatgccctcggcaagtccgaatttcaaatctataagcgcagcgggattcaggaggtggacagaacactggccaaagaaggaatcaagcggggcgagaccgatcaccatgctgtttctcgcgggtccgccaaacttagatggttcgtggagcggaacatggtcaccccggaaggaaaggtggttgacctgggctgcggcagagggggatggagctactattgtggcgggctcaaaaatgtgcgcgaggtcaagggactgacaaagggcgggcctggacacgaagaacccattcccatgtctacctacggctggaacctggtgcggctccagagcggcgtggatgtctttttcatccctcccgaaaaatgcgacacacttctgtgtgatattggggagtcctctcctaatccgacggtcgaggcgggaagaaccctgcgcgtgctcaacctggtggaaaattggcttaacaataacacacagttctgcatcaaggtcctgaatccctacatgcctagcgttatcgagaaaatggaagccctccaacggaagtatggcggggctctggtgagaaaccccctgtcccgcaatagcacccatgagatgtactgggtgtccaacgcctctggaaatattgtcagctccgtgaacatgatctctcggatgctcattaacagatttacaatgcgccacaaaaaggctacctatgaacctgacgttgaccttggcagcgggacgcggaatatcggaattgagtccgagatccccaacctggatattatcggcaagagaatcgagaagattaagcaggagcatgaaacctcttggcactacgaccaggatcacccgtataaaacatgggcctaccatggcagctatgagaccaagcagacagggtccgcgagctctatggtgaatggagtcgtgcgcctgctcaccaaaccttgggacgttctgcccacagtgacccaaatggccatgacggatacaacccctttcggccagcagcgggtctttaaggaaaaggtggacaccagaacacaggagcccaaagaggggacgaagaaacttatgaagatcaccgctgaatggctgtggaaagagctcggaaagaaaaagacacctcgcatgtgtaccagagaagagttcacacggaaggtgcgctccaacgccgctctgggcgccatttttaccgatgagaataaatggaaaagcgctagagaagccgtcgaggactctcggttctgggaactggttgataaagagagaaacctccacctggaagggaagtgcgagacatgtgtgtacaatatgatgggaaaacgggagaagaaacttggcgaatttggcaaagcgaaggggtcccgcgccatctggtacatgtggctgggagctagattcctcgagtttgaagccctgggcttccttaacgaggaccattggtttagccgggaaaattctctgtccggggtggagggagagggcctccacaaactggggtatattctgcgcgatgtcagcaagaaagaaggcggagctatgtacgccgacgacaccgccggctgggatacgagaatcaccctcgaggacctgaagaacgaagagatggtgacaaatcacatggaaggggagcataagaaacttgcggaggctatcttcaagctgacctatcaaaacaaagttgtgcgggtccagcgccccgccccgagaggaacagtgatggatattatctcccggcgcgaccagagaggcagcgggcaagttggaacctacggcctcaatacgtttacaaacatggaagcccagctgattcggcagatggagggggaaggcgtgttcaagaatatccagcaccttaccgtcacagaggaggtggctgttcaaaactggctggcccgcgtgggaagagaacggctctctcgcatggctattagcggcgatgactgcgtcgtgaaacctctggatgacagattcgccaacgcgctgaccgccctcaatgatatggggaagatccggaaggacatccagcagtgggagccctccaaaggatggaacgattggacgcaggtccccttttgctctcatcacttccatgaactgattatgaaggacggcagagtgcttgttgtgccttgtcgcaatcaagatgagctgatcgggcgggctagaattagccagggagccggctggtccctccgcgaaaccgcttgcctggggaaatcttatgcccagatgtggagccttatgtactttcaccggagagacctgcgcctcgcggccaacgctatctgttccgccgtcccgtctcactgggtgcccacaagccggaccacatggtccattcatgctaagcacgagtggatgaccacagaggacatgctgaccgtgtggaatagagtttggatccgcgaaaacccttggatggaggataaaacgcccgtggaaagctgggaggaaattccttatctgggcaagcgggaggaccagtggtgcggatctctcatcggcctgacatccagagccacctgggctaagaatatccaagccgcgattaaccaggtccgcagccttatcgggaatgaggaatacaccgattacatgccctctatgaaacggttcagacgggaggaagaggaagccggagtgctgtggtga

SEQ ID NO: 20062 - RNA, 9876 nt, synthetic construct
  misc_feature 1..9876: note = derived and/or modified CDS sequence (opt5) from DENV-2__FJ410195__SS-prME
  source 1..9876: mol_type = other RNA
agcgccggaatgatcattatgctgatccccaccgtgatggctttccacctgaccacgagaaatggggaacctcatatgattgtcggaatccaggaaaagggcaaatccctgctttttaagaccgaggacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatcgtcggcgctacgatggccgatgacattggcatgggggtgacctatctcgccctgctggctgccttcaaggttcgccctacatttgcggctggacttctgctccggaagctgacctccaaagagctcatgatgacaaccatcggcattgtgctgctttctcaaagcacgatccccgaaacagtcctggagctcaccgatgccctggccctggggatgatggtgcttaagatcgtgagaaatatggaaaaataccagctggctgtcacaattatgaccatcctctgcgttcctaacgccgtgattctgcagaatgcgtggaaggtgtcctgtaccatcctcgctgtcgtgtctgttagccccctgcttctgacatccagccgccagaaaacggactggattcctctcgccctgaccatcaagggactgaaccccacagccatcttccttaccacactgtctagaaccaataaaaagcggtcctggccgctcaacgaggctattatggccgtgggcatggtcagcatcctggcttcttccctcctgaagaatgacattcctatgacggggccccttgtggccggaggcctgctgacagtttgctatgtgctcaccggccgcagcgcggatctggaacttgagagagccaccgacgtcaaatgggaggatcaagctgaaatctctgggtccagccctattctgtccatcacaattagcgaggacggatctatgagcatcaagaacgaagaggaggaacagaccctcacaatcctgattcggacgggcctcctggtgatctccgggcttctgcccatttctatcccgattaccgccgctgcctggtacctgtgggaggtcaaaaagcagcgcgccggagtgctctgggatgttccttctccccctcccatgggcaaagctgaactggaggacggggcgtatagaatcaagcagaagggaatccttggctactcccaaattggcgccggggtgtacaaagaaggaacatttcacaccatgtggcatgtcacacggggcgctgtgctgatgcacaaggggaaacgcatcgagccctcctgggccgatgttaagaaagacctcattagctatggaggcgggtggaagctggagggagaatggaaggagggcgaagaggtgcaggtcctcgccctggaacctggcaaaaatccgagagctgtgcagaccaagcccgggcttttcaaaacgaacaccggaacaatcggcgccgtgtccctggatttttctcctgggaccagcggatcccccattatcgacaagaaaggcaaggttgtcgggctgtacggaaacggcgtggtgacacggagcggcgcgtatgtctctgctatcgcccagaccgagaagtccattgaggataatcctgaaatcgaggacgatattttccgcaaaagacggctcacaatcatggacctgcaccccggggccggaaagacgaaaagataccttcctgctattgtgcgcgaagccatcaagcggggcctgagaaccctcattctggcgccgacacgcgttgtggctgccgagatggaagaggccctccgggggctgcccatcagatatcaaacccctgctatccgcgccgagcataccggacgggaaattgtcgaccttatgtgtcacgctacatttacgatgagactgctgagccccgtgcgcgttcctaactacaatctcatcattatggatgaggcccatttcaccgaccccgcgtctatcgccgctcggggctatatttccacaagagtggaaatgggggaggccgctggcatcttcatgaccgccacaccgcctggaagccgggatccctttccccagtccaacgcccctatcattgacgaggaacgcgagatccccgaaagatcttggaatagcggccacgagtgggtcaccgatttcaaagggaagacggtgtggtttgttccttccattaaggctggaaacgacatcgcggcctgcctgcggaaaaatggcaagaaagtgattcagcttagccgcaagacattcgattctgaatacgtcaaaaccagaaccaacgactgggattttgtggtgacaaccgacatctccgagatgggggctaatttcaaggccgagcgggtcatcgatccgagacgctgtatgaaacccgttattctgacagacggagaggaacgggtgatcctcgccggccctatgcccgtgacccatagctctgctgcccaaagacgcgggcggattggcagaaaccctaagaatgaaaacgaccagtacatctatatgggagagcccctggaaaatgatgaggactgcgcgcactggaaggaggctaaaatgctgctcgataacattaatacgccggaaggcatcattcctagcatgtttgagcccgaacgcgagaaggtcgacgccatcgatggggaataccggcttagaggagaggcccgcaaaacattcgtggacctgatgagacggggcgatctgcctgtttggctcgcttataaggtggccgcggaggggatcaactacgccgaccgcagatggtgttttgatggaattaaaaacaatcagatcctggaagagaacgtcgaagtggagatttggaccaaggagggcgaacggaagaaacttaagccccgctggctggacgctagaatctattccgatcctctcgccctgaaagagttcaaggaatttgctgccgggcggaaatctctgacactcaatcttattaccgagatgggcagactgcccacgttcatgacccagaagacacgcgacgctctggataacctcgccgttctgcacaccgcggaagccggaggccgggcttacaatcatgcccttagcgagctgccggagacactcgaaaccctgctgctccttacactgctggctaccgtgacagggggaatcttcctctttctgatgtccggcagagggatcggaaagatgacacttggcatgtgctgcattatcaccgcctctattctgctctggtatgcccaaatccagcctcactggattgctgcgagcatcatcctggagttctttctgattgtcctccttatccccgaacccgagaaacagcgcacccctcaggacaaccaactgacatacgtggtcattgccatcctgaccgtggttgctgccacaatggccaatgaaatgggcttcctcgagaagacgaaaaaggacctggggcttggatccattgctacccagcagccggagagcaacatcctggatattgacctccggcccgcctctgcgtggacactgtacgccgtggctaccacatttgtgacccctatgctgagacattccatcgaaaatagctccgtcaacgtttctctcacggccatcgctaatcaggccaccgtgcttatgggcctggggaaaggatggcccctgagcaagatggatattggcgtgcctctcctggcgatcgggtgttattcccaagtcaaccccattacacttaccgccgctctgctcctgctggtggcccactacgctatcattggacctggcctccaggccaaggctacacgggaggcccagaaacgcgcggccgctggcatcatgaagaatccgaccgttgacgggatcacggtgattgatcttgaccccatcccttatgatcccaaattcgaaaagcagctgggacaagtcatgctgctcattctgtgcgtgacacaggtccttatgatgagaaccacatgggccctgtgtgaggctctcaccctggccaccggccctatctctacactgtgggaagggaaccccggacggttttggaatacgaccattgccgtgagcatggcgaacatcttccgcggctcctacctcgctggggccggacttctgtttagcatcatgaaaaatacaaccaacacaagacggggcaccggcaacatgggggagacgctgggagagaagtggaaatctcgcctcaatgctctgggcaagaacgagttccagatttataagaaatccgggatccaagaggttgacagaacacttgccaaggaaggaattaaacggggcgagaccgatcaccatgccgtgagccgcgggtctgctaagctgagatggtttgtcgagcggaatatggtgaccccggaaggaaaagttgtggacctcggctgcggcagagggggatggtcctactattgtggcgggctgaagaacgtccgcgaggtgaagggactgacaaaaggcgggcctggacacgaagaacccatccccatgagcacctacggctggaatctcgtgcggcttcagtctggcgttgatgtcttctttattcctcccgaaaagtgcgacacactgctgtgtgatatcggggagagctcccctaacccgacggtggaggccggaagaaccctccgcgtgctgaatcttgtcgaaaactggctgaataacaatacacagttctgcatcaaagttctcaacccctacatgccttctgtgattgagaagatggaagcgctgcagcggaaatatggcggggccctggtgagaaatcccctcagccgcaactccacccatgagatgtactgggtcagcaatgcttccggaaacatcgtgtctagcgttaacatgatttcccggatgcttatcaatagattcacaatgcgccacaagaaggccacctatgaacctgacgtggacctgggctctgggacgcggaacattggaatcgagagcgagattcccaatctggatatcatcggcaaaagaattgaaaagatcaaacaagagcatgaaacctcctggcactacgaccaggatcacccgtataagacatgggcttaccatggctcttatgagaccaaacagacagggagcgcctccagcatggtcaacggagtggttcgcctcctgaccaagccttgggacgtgcttcccacagtcacccagatggcgatgacggatacaaccccttttggccaacagcgggtgttcaaggaaaaagtggacaccagaacacaggagcccaaggaggggacgaaaaagctgatgaaaattaccgccgaatggctctggaaggagctgggcaaaaagaagacacctcgcatgtgtaccagagaagagtttacacggaaagtccgctctaatgctgccctgggcgctatcttcaccgatgagaacaagtggaaatccgccagagaagctgttgaggacagccggttttgggaactcgtggataaggagagaaatctgcaccttgaagggaaatgcgagacatgtgtgtacaacatgatgggaaagcgggagaagaaactgggcgagttcggcaaggccaaagggtctcgcgcgatttggtacatgtggctcggagccagatttctggagttcgaagctcttggctttctgaatgaggaccattggttctcccgggaaaacagcctctctggggtcgagggagagggcctgcacaagctggggtatatcctccgcgatgtgtccaaaaaggaaggcggagccatgtacgctgacgacaccgccggctgggatacgagaatcaccctggaggaccttaagaatgaagagatggttacaaaccacatggaaggggagcataaaaagctggccgaggcgatttttaaactcacctatcagaataaggtggtccgggtgcaacgccccacaccgagaggaaccgttatggatatcattagccggcgcgaccagagaggctccgggcaggtcggaacgtacggcctgaacacattcaccaatatggaagctcaacttatccggcagatggagggggaaggcgtctttaaaaacattcagcacctgacagtgaccgaggaggttgccgtgcagaactggctcgcccgcgtcggaagagaacggctgagccgcatggctatctctggcgatgactgcgtggtcaagcctctggatgacagattcgccaatgctctcacggccctgaacgatatggggaagatccggaaagacattcaacagtgggagcccagcaagggatggaatgattggacccaggtgcccttctgctcccatcactttcatgaacttatcatgaaagacggcagagttctggtggtcccttgtcgcaaccaggatgagctcattgggcgggcgagaatctctcaaggagccggctggagcctgcgcgaaacagcttgccttgggaagtcctatgcccagatgtggtctctgatgtacttccaccggagagacctccgcctggctgccaatgcgatttgtagcgccgtgccgtcccactgggtgcccacctctcggacaacctggagcatccatgctaaacacgagtggatgacaaccgaggacatgctgacggtttggaacagagtgtggattcgcgaaaatccttggatggaggataagacacccgtcgaatcctgggaggaaatcccttatctcggcaagcgggaggaccagtggtgcggaagcctgatcggccttacctctagagccacctgggctaaaaacattcaggccgctatcaatcaagtgcgctccctgattgggaacgaggaatacacagattacatgcccagcatgaagcggtttagacgggaggaagaggaagccggagttctctggtga

SEQ ID NO: 20063 - RNA, 9876 nt, synthetic construct
  misc_feature 1..9876: note = derived and/or modified CDS sequence (opt5) from DENV-2__FJ432726__SS-prME
  source 1..9876: mol_type = other RNA
agcgccggaatgatcattatgctgatccccacagtgatggctttccacctgacaacgagaaatggggagcctcatatgattgttggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatccgcggcattatgcaagctgggaagcggtctcttagacctcagcccaccgagctcaaatacagctggaagacatggggaaaggccaaaatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaagaaaagcaggacgctttttgtgactccaaactgatgagcgccgctatcaaggataatcgggccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggcttcccaacacaattacagacctggataccacacccagattgccggcccctggcatctcgggaaactggagatggacttcgatttttgtgacggaacgacagtgatcgtgaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaggagaaagaagagaatctcgtcaacagcctggttaccgctggacacggccaggtggataatttctccctgggggtgcttggaatggcgctctttctggaagagatgctgcggacaagagtcggcaccaagcatgccatcctcctggtggctgtttctttcgtgacacttattaccgggaacatgagctttaaagacctgggacgcgtcgtggttatggtgggcgccacgatggccgatgacatcggcatgggggtcacctatctcgctctgctggccgcgttcaaggtgcggcctacatttgctgccggacttctgctcagaaaactgacctccaaggagctcatgatgacaaccattggcatcgttctgctttctcaaagcacgattcccgaaacagtgctggagctcaccgatgccctggctctggggatgatggtccttaagatcgtgcgcaatatggaaaaataccagctggccgtgacaatcatggcgattctctgcgtccctaacgctgttatcctgcagaatgcctggaaggtgtcctgtaccattctcgccgtggtctctgtgagccccctgcttctgacctccagccagcagaagacggactggatccctctcgctctgacgattaagggactgaaccccaccgccatcttccttacaaccctgtctagaacaaataaaaagcggtcctggccgctcaacgaggctatcatggccgttggcatggtgagcattctggcgtcttccctcctgaaaaatgacatccctatgaccgggccccttgtcgccggaggcctgctgacggtgtgctatgttctcacaggccgcagcgctgatctggaacttgagagagccaccgacgtgaagtgggaggatcaggctgaaatttctgggtccagccctatcctgtccattaccatcagcgaggacggatctatgagcattaagaacgaagaggaggaacagacactcaccatcctgatccggacaggcctcctggtcatttccgggctttttcccatctctattccgatcacggccgccgcttggtacctgtgggaggtgaaaaagcagcgcgcgggagtcctgtgggatgtgccttctccccctcccatgggcaaagccgaactcgaggacggggcttatagaattaagcaaaaaggaatcctgggctactcccagatcggcgccggggtttacaaggaaggaaccttccacacaatgtggcatgtgacccggggcgccgtccttatgcacaaggggaaacgcattgagccctcctgggctgatgtgaagaaagacctgatcagctatggaggcgggtggaagctcgagggagaatggaaagagggcgaagaggttcaggtgctggccctcgaacctggcaagaatccgagagcggtccagacaaagcccgggctgtttaaaaccaacacgggaaccattggcgctgtgtcccttgatttctctcctgggacaagcggatcccccatcattgacaagaaaggcaaggtggttgggctgtacggaaacggcgtcgtgacccggagcggcgcctatgtgtctgccatcgctcaaacagagaaatccatcgaggataatcctgaaattgaggacgatatctttcgcaagagacggctgaccattatggacctccaccccggggccggaaagacaaaaagatacctgcctgcgatcgtccgcgaagctattaagcggggccttagaacgctgatcctcgccccgacccgcgtggttgccgctgagatggaagaggccctgcgggggctccccattagatatcagacccctgctatccgcgccgagcataccggacgggaaatcgtggacctgatgtgtcacgcgaccttcacaatgagacttctgagccccgtccgcgtgcctaactacaatctgattatcatggatgaggcccatttcacggaccccgcttctattgccgctcggggctatatctccaccagagttgaaatgggggaggccgccggcatttttatgacagctaccccgcctggaagccgggatcccttcccccagtccaacgcgcctatcatcgacgaggaacgcgagattcccgaaagatcttggaatagcggccacgagtgggtgacagattttaaagggaagaccgtctggttcgtgccttccatcaaagccggaaacgacattgctgcctgcctccggaagaatggcaagaaagttatccaactgagccgcaagacgtttgattctgaatacgtgaaaacaagaaccaacgactgggatttcgtcgtgaccacagacatttccgagatgggggccaattttaaggctgagcgggtgatcgatccgagacgctgtatgaaacccgtcatccttaccgacggagaggaacgggttattctggccggccctatgcccgtgacacatagctctgcggctcagagacgcgggcggatcggcagaaaccctaagaatgaaaacgaccagtacatttatatgggagagcccctcgaaaatgatgaggactgcgcccactggaaagaggccaagatgctgctggataacatcaataccccggaaggcattatccctagcatgttcgagcccgaacgcgagaaggtggacgctattgatggggaataccggctcagaggagaggcccgcaaaacgtttgtcgaccttatgagacggggcgatctgcctgtgtggctggcgtataaggttgccgctgaggggatcaactacgccgaccgcagatggtgtttcgatggaatcaaaaacaatcagattctcgaagagaacgtggaagtcgagatctggacaaaggagggcgaacggaaaaagctgaagccccgctggcttgacgctagaatttattccgatcctctggccctcaaagagtttaaggagttcgctgccgggcggaaatctctgaccctgaatctcatcacagagatgggcagacttcccaccttcatgacgcaaaagacccgcgacgcgctggataacctggccgtgctccacacagctgaagccggaggccgggcttacaatcatgccctgagcgagcttccggagaccctggaaacactcctgctgctcacccttctggccacagttaccgggggaatttttctgttcctcatgtccggcagagggatcggaaaaatgacgctgggcatgtgctgcatcattacagcttctatccttctgtggtatgcgcagattcagcctcactggatcgccgctagcattatcctcgagtttttcctgatcgtgctgctcattcccgaacccgagaagcagcgcacccctcaagacaaccagcttacctacgtcgtgatcgccattctgacagtcgtggccgctaccatggccaatgaaatgggctttctggagaagaccaagaaggacctcgggctgggatccatcgcgacgcagcagccggagagcaacattcttgatatcgacctgcggcccgcctctgcttggaccctctacgccgttgctacaaccttcgtgacacctatgctgagacattccattgaaaatagctccgtgaacgtctctctgaccgccatcgcgaatcaagccacggttctcatgggccttgggaaaggatggcccctgagcaagatggatatcggcgtgcctctgctcgctattgggtgttattcccaggtgaaccccatcaccctgacagccgcccttctgctcctggtcgcccactacgctattatcggacctggcctgcaggccaaagcgacccgggaggcccagaagcgcgctgccgctggcattatgaagaatccgacagtggacgggatcaccgttatcgatctcgaccccattccttatgatcccaaatttgaaaagcaacttggacaggtgatgctgctgatcctctgcgtcacacaggtgctgatgatgagaacaacctgggccctttgtgaggccctgacactcgcgaccggccctatttctaccctgtgggaagggaaccccggacggttctggaatacaacgatcgctgtcagcatggccaacatttttcgcggctcctacctggctggggccggactccttttcagcatcatgaaaaataccacaaacaccagacggggcacaggcaacatcggggagaccctgggagagaagtggaaatctcgcctgaatgccctcggcaagtccgaatttcaaatttataaaaagagcgggatccaggaggtggacagaacgctggctaaggaaggaattaaacggggcgagacagatcaccatgccgtttctcgcgggtccgcgaaacttagatggttcgtggagcggaacatggtcaccccggaaggaaaagtggttgacctgggctgcggcagagggggatggagctactattgtggcgggctcaagaatgtgcgcgaggtcaaaggactgaccaagggcgggcctggacacgaggaacccatccccatgtctacatacggctggaacctggtgcggctccagagcggcgtggatgtctttttcattcctcccgaaaagtgcgacacccttctgtgtgatatcggggagtcctctcctaatccgacagtcgaggccggaagaacgctgcgcgtgctcaacctggtggaaaattggcttaacaataacacccagttctgcatcaaagtcctgaatccctacatgcctagcgttattgagaagatggaagctctccaacggaaatatggcggggccctggtgagaaaccccctgtcccgcaatagcacacatgagatgtactgggtgtccaacgcttctggaaatatcgtcagctccgtgaacatgatttctcggatgctcatcaacagatttaccatgcgccacaagaaagccacatatgaacctgacgttgaccttggcagcgggacccggaatattggaatcgagtccgagattcccaacctggatatcatcggcaagagaattgaaaagatcaaacaggagcatgaaacgtcttggcactacgaccaggatcacccgtataagacctgggcgtaccatggcagctatgagacaaaacagaccgggtccgccagctctatggtgaatggagtcgtgcgcctgctcacaaagccttgggacgttctgcccaccgtgacacaaatggctatgaccgatacgacacctttcggccagcagcgggtctttaaagaaaaggtggacaccagaacccaggagcccaaggaggggaccaagaaacttatgaaaattacggccgaatggctgtggaaggagctcggcaagaagaaaacccctcgcatgtgtacaagagaagagttcacccggaaggtgcgctccaacgctgccctgggcgctatctttacagatgagaataagtggaaaagcgccagagaagcggtcgaggactctcggttctgggaactggttgataaggagagaaacctccacctggaagggaaatgcgagacctgtgtgtacaatatgatgggaaagcgggagaagaaacttggcgaatttggcaaagccaaagggtcccgcgctatttggtacatgtggctgggagccagattcctcgagtttgaagctctgggcttccttaacgaggaccattggtttagccgggaaaattctctgtccggggtggagggagagggcctccacaagctggggtatatcctgcgcgatgtcagcaaaaaggaaggcggagccatgtacgccgacgacacagcgggctgggataccagaatcacgctcgaggacctgaaaaacgaagagatggtgaccaatcacatggaaggggagcataagaaacttgctgaggccattttcaaactgacatatcaaaacaaggttgtgcgggtccagcgccccaccccgagaggaacagtgatggatatcatttcccggcgcgaccagagaggcagcgggcaagttggaacctacggcctcaatacgtttacaaacatggaagcccagctgatccggcagatggagggggaaggcgtgttcaaaaatattcagcaccttaccgtcacagaggaggtggctgttcataactggctggcccgcgtgggaagagaacggctctctcgcatggctatcagcggcgatgactgcgtcgtgaagcctctggatgacagattcgccaacgcgctgaccgccctcaatgatatggggaaaatccggaaggacattcaacagtgggagccctccaagggatggaacgattggacgcaggtccccttttgctctcaccatttccacgaactgatcatgaaagacggccggattcttgtggttccttgtcgcaatcaggatgagctgatcgggcgggctagaattagccaaggagccggctggtccctccgcgaaaccgcttgcctggggaagtcttatgcccagatgtggagccttatgtactttcaccggagagacctgcgcctcgcggccaacgctatctgttccgccgtgccgtctcattgggtccccacaagccggaccacatggtccattcacgctaaacatgagtggatgaccacagaggacatgctgaccgtgtggaatagagtgtggatccgcgaaaacccttggatggaggataagacgcccgttgaaagctgggaggaaatcccttatctgggcaaacgggaggaccagtggtgcggatctctcattggcctgacatccagagccacctgggctaagaatatccaggccgcgattaaccaagtgcgcagccttatcgggaatgaggaatacaccgattacatgccctctatgaagcggttcagacgggaggaagaggaagccggagtcctgtggtga

SEQ ID NO: 20064 - RNA, 9876 nt, synthetic construct
  misc_feature 1..9876: note = derived and/or modified CDS sequence (opt5) from DENV-2__JF730049__SS-prME
  source 1..9876: mol_type = other RNA
agcgccggcatgatcattatgctgatccccaccgtcatggctttccacctcaccacgcggaatggggaacctcatatgattgtcggaatccaggaaaagggcaagagcctgctttttaagaccgaggacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgtcgtgggaaacgacacaggcaaacacggccaggaaatcaaggttacccctcaatccagcatcacagaggccgaactgaccgggtatggaacggtgaccatggagtgttctcccagaacaggccttgatttcaatgaaatggtcctgctccagatggagaacaaagcgtggctggtgcaccggcagtggtttcttgacctgccgctcccttggctgcccggggccgataagcaggagtccaattggattcaaaaggaaaccctggttacattcaaaaaccctcatgctaagaaacaggacgtggtcgtgctcggaagccaggagggcgccatgcacaccgctctgacgggggccacagaaatccaaatgtcctctggcaatcttctgtttaccggacatctcaagtgccgcctgagaatggacaaacttcagctgaagggcatgagctactccatgtgtacagggaagttcaaagtcgtgaaggagattgccgagacccagcacggaaccatcgttattcgggtgcagtatgaaggcgatgggagcccctgcaaaatccccttcgagatcatggacctcgaaaagagatacgtcctgggacgcctgattacagtgaaccctatcgttacggagaaagattctccggtgaacattgaagctgagcccccttttggcgactcctacatcattatcggggtcgagcccggccaactcaagctgaattggttcaagaaaggaagctctattggccagatgtttgaaaccacaatgagaggggcgaagagaatggccatccttggagataccgcttgggacttcggcagcctcgggggagtgtttacatccatcggcaaagccctccatcaggtgttcggggccatttatggcgctgccttttctggagttagctggaccatgaagatcctgattggcgtcatcattacgtggatcgggatgaactcccgcagcacatctctgtccgtgagccttgtgctcgtcggaatcgtgaccctgtacctgggcgttatggtgcaggcggattctgggtgtgtcgtgtcctggaaaaataaggagctcaagtgcggaagcggcattttcatcaccgacaacgttcacacatggaccgaacaatataaatttcagcctgagtccccctctaagctggctagcgccattcagaaagcccaggaagaggggatctgtggcattcggtccgtgacaagacttgagaatctgatgtggaagcaaatcacgccggaactcaaccacatcctgaccgagaatgaagtcaaactgacaattatgaccggagatatcaagggcattatgcaggctgggaaacgctctcttcggcctcagcccacagagctcaagtacagctggaagacctggggaaaagccaagatgttctccacggaaagctataaccagacctttctgatcgacggccctgagacagctgagtgccccaataccaacagagcctggaactctctggaagtggaggattacgggttcggagtttttacaaccaacatttggctcaaactgaaggaaaaacaagacgcgttctgtgactccaaacttatgagcgccgctatcaaggataatcgcgccgtgcatgctgacatgggctattggatcgagtctgccctgaacgatacatggaaaattgagaaggcgtccttcatcgaagtcaaaaattgccactggcctaagagccataccctctggtctaacggcgtgctggagagcgaaatgattatccccaaaaacctggccgggccggtgtcccagcacaattaccggcctggataccacacgcagattgctggcccctggcatcttgggaagctcgagatggactttgatttctgtgacggaacaaccgtcatcgttaccgaagattgcggcaacagagggcccagcctgcgcacaaccacggcctctggaaagctgattacagagtggtgctgtcggtcctgcaccctccctccgctgagatatcggggcgaggacggctgttggtacgggatggaaatccgcccccttaaagagaaggaagagaatctggtgaacagcctcgtgacagctggacacggccaagtcgataatttttccctgggggtgctgggaatggcccttttcctcgaagagatgctgaaaaccagagttggcacaaagcatgccatcctgctcgtggctgtctcttttgtgaccctgattacggggaacatgagcttcaaagaccttggacgggttgtggtcatggtgggcgcgaccatggccgatgacatcggcatgggggttacatatctggctctcctggccgcctttaaggtgagacctaccttcgctgccggactgcttctgcgcaagctcacatccaaagagctgatgatgaccacgattggcatcgtcctcctgtctcagagcacaattcccgaaaccgtgcttgagctgacagatgcgctcgctctggggatgatggtgctgcggatcgtcagaaatatggaaaagtaccagcttgccgttaccatcatggccattctgtgcgtgcctaacgctgtgatcctccagaatgcctggaaagtctcctgtaccattctggcggtggtttctgtgagccccctcctgcttacatccagccaacagaagacggactggatccctctggctctcaccattaaaggactgaaccccacagccatctttctgaccacactttctcgcaccaataagaaaagatcctggccgctgaacgaggccatcatggctgtcggcatggtgagcattctcgcctcttccctgctcaagaatgacatccctatgacggggcccctggttgctggaggccttctgacagtgtgctatgtcctgaccggccggagcgccgatctcgaactggagcgcgcgaccgacgtgaagtgggaggatcaggccgaaatttctgggtccagccctatcctttccattacaatcagcgaggacggatctatgagcattaaaaacgaagaggaggaacagaccctgacaatcctcatcagaacgggcctgctcgtcatttccgggctgttccccatctctattccgatcaccgctgccgcttggtacctttgggaggtgaagaaacaacgggccggagttctgtgggatgtgccttctccccctcccatgggcaaggccgaactggaggacggggcttatcgcattaaacagaagggaatcctcggctactcccagatcggcgcgggggtctacaaggaaggaacatttcacaccatgtggcatgtgacaagaggcgccgttctgatgcacaaagggaagcggattgagccctcctgggctgatgtgaaaaaggaccttatcagctatggaggcgggtggaaactggagggagaatggaaggagggcgaagaggtccaggtgctcgccctggaacctggcaagaatccgcgcgccgtgcaaaccaaacccgggctgttcaagacgtccaccggaacaattggcgctgtttctctggattttagccctgggacctccggaagccccatcattgacaaaaagggcaaagtcgtggggctttacggaaacggcgtggtcacaagatctggcgcctatgtgtccgcgatcgctcagaccgaaaagagcatcgaggataaccctgaaattgaggacgatatcttccggaagcgcagactgacaattatggacctgcaccccggggccggaaaaacgaagcggtacctccctgccatcgttagagaagctattaaacgcggcctgcggacccttatcctggccccgacaagagtggtcgcggctgagatggaagaggccctccgcgggctgcccattcggtatcagacccctgccatcagagctgagcataccggacgcgaaatcgtggacctcatgtgtcacgccacattcacgatgcggctgctttctcccgttagagtgcctaattacaacctgattatcatggatgaggctcattttaccgaccccgcctccattgcggcccgcggctatatcagcacacgggtcgaaatgggggaggctgccggcattttcatgaccgctacaccgcctggatccagagatccctttccccaatctaatgcccctatcatcgacgaggaacgggagattcccgaacgcagctggaactccggccacgagtgggtgaccgatttcaaggggaaaacggtttggtttgtgcctagcatcaaggccggaaatgacattgctgcgtgcctgagaaagaacggcaaaaaggtcatccagctctctcggaaaacattcgattccgaatacgtgaagacccgcaccaatgactgggattttgtggtcacaaccgacattagcgagatgggggccaacttcaaagctgagagagttatcgatccgcggagatgtatgaagcccgtgatcctgacagacggagaggaacgcgtgattcttgccggccctatgcccgtcacccattctagcgccgctcagcggagagggcgcatcggccggaatcctaaaaacgaaaatgaccagtacatttatatgggagagcccctggaaaacgatgaggactgcgcccactggaaggaggcgaagatgctcctggataatatcaacacgccggaaggcattatcccttccatgtttgagcccgaaagagagaaagtggacgctattgatggggaataccgcctgcggggagaggccagaaagacattcgttgacctcatgcgcagaggcgatcttcctgtgtggctggcctataaagtcgctgccgaggggatcaattacgcggaccggcgctggtgttttgatggaatcaagaacaaccaaattctggaagagaatgtggaagttgagatctggaccaaagagggcgaaagaaagaagctcaaaccccggtggctggacgcccgcatttattctgatcctcttgctctgaaggagttcaaagagttcgccgctgggagaaagagcctcacactgaacctgatcaccgagatgggccggctccccacgtttatgacccagaaaacaagagacgcccttgataatctggctgtgctgcacaccgccgaagcgggaggccgcgcctacaaccatgctctctccgagctgccggagacacttgaaaccctgctcctgctgacactccttgccaccgtcacagggggaattttcctgtttctgatgtctggccgggggatcggaaagatgacactcggcatgtgctgcatcattaccgctagcatcctgctttggtatgcccagattcagcctcactggatcgccgcttccattatcctggagttctttctcatcgtgctgctgattcccgaacccgagaagcaaagaacccctcaggacaatcagctcacatacgtcgtgatcgcgattcttaccgttgtggccgctacaatggccaacgaaatgggcttcctggagaaaacgaagaaagacctggggctcggaagcatcgccacccagcaaccggagtctaatattctggatatcgaccttcgccccgcttccgcctggacactgtacgcggtggccaccacatttgtcacccctatgctccggcatagcattgaaaactcctctgttaatgtgagcctgacggctatcgccaaccaggctaccgtgctgatgggcctcgggaagggatggcccctttccaaaatggatatcggcgtccctctgctggccattgggtgttattctcaggtgaatcccatcacactcaccgcggccctgcttctgctcgttgctcactacgccattatcggacctggcctgcaggctaaggccacaagagaggctcaaaagcgggccgcggccggcattatgaaaaacccgaccgtggacgggatcacggtcatcgatctggaccccattccttatgatcccaagttcgaaaaacagctcggacaggtgatgcttctgatcctgtgcgtcacacaagtgctcatgatgcgcaccacatgggctctgtgtgaggcccttaccctggctaccggccctattagcacactctgggaagggaatcccggaagattttggaacacgaccatcgccgtttccatggccaatattttccggggcagctacctggcgggggctggactgctcttttctatcatgaagaacacaaccaatacacgcagaggcaccggcaacatgggggagacgcttggagagaaatggaagtcccggctgaacgccctgggcaaaagcgagttccagatctataagaagtctgggattcaggaggtggaccgcacactcgctaaagaaggaatcaagagaggcgagaccgatcaccatgccgtctcccgggggagcgccaaactgcgctggtttgtggagagaaatatggttaccccggaaggaaaggtggtcgaccttggctgcggcagagggggatggtcttactattgtggcgggctgaaaaacgtgcgggaggtgaagggactcacaaagggcgggcctggacacgaagaacccattcccatgagcacctacggctggaatctggttcgcctgcagtccggcgtcgatgtgttcttcatccctcccgaaaaatgcgacacactcctttgtgatattggggagtctagccctaacccgacggtggaggctggacggaccctgagagtcctgaatctcgttgaaaactggctgaataacaatacacaattttgcatcaaggtgcttaacccctacatgccttccgtgatcgagaaaatggaagccctgcagcgcaagtatggcggggcgctcgtccggaatcccctgagcagaaactccacccatgagatgtactgggtgtctaatgccagcggaaacattgtttcctctgtgaatatgatcagccgcatgctgattaaccggttcacaatgagacacaaaaaggctacctatgaacctgacgtcgacctcggctccgggacgcgcaacatcggaattgagtctgagatccccaatcttgatattatcggcaagcggatcgagaagattaagcaggagcatgaaaccagctggcactacgaccaggatcacccgtataaaacatgggcctaccatggctcctatgagaccaagcaaacagggagcgcttcttccatggtgaacggagttgtgagactgctgaccaaaccttgggacgtcctccccacagtgacccagatggccatgacggatacaaccccttttggccagcagcgcgtgttcaaggaaaaggtcgacacccggacacaagagcccaaagaggggacgaagaaactgatgaagatcaccgcggaatggctttggaaagagctgggaaagaaaaagacacctagaatgtgtacccgcgaagagtttacaagaaaggttcggagcaatgccgctctcggcgccattttcaccgatgagaacaaatggaagtctgctcgcgaagccgtggaggactccagattttgggaactggtggataaagagcggaatctgcacctcgaagggaagtgcgagacatgtgtctacaacatgatgggaaaaagagagaagaagctgggcgagttcggcaaagctaaggggagccgggccatctggtacatgtggcttggagcgcgctttctggagttcgaagccctcggctttctgaatgaggaccattggttctctagagaaaactcccttagcggggtggagggagagggcctgcacaaactcgggtatattctgcgggatgtttccaagaaagaaggcggagctatgtacgccgacgacaccgctggctgggatacgcgcatcaccctggaggacctcaagaatgaagagatggtgacaaaccacatggaaggggagcataagaaactggccgaggccatctttaaacttacctatcagaataaagtcgtgagagttcagcggcccacaccgcgcggaaccgtgatggatattatcagcagacgggaccaacgcggctctgggcaggtcggaacgtacggcctgaacacattcaccaatatggaagcgcagctcattagacagatggagggggaaggcgtgttcaagaacatccaacacctgacagttaccgaggaggtggctgtccagaattggcttgcccgggtgggacgcgaaagactgagccggatggccatttccggcgatgactgcgtcgtgaaacctctcgatgaccgctttgctaacgccctgacggctctgaacgatatggggaagatcagaaaggacatccagcagtgggagccctctaaaggatggaatgattggacccaagttcccttctgcagccatcactttcatgaactcattatgaaggacggccgggtgctggtcgtgccttgtagaaaccaggatgagcttatcgggcgcgcccggatttcccagggagcgggctggtctctgagagaaacagcctgcctcgggaaaagctatgctcagatgtggtccctgatgtacttccaccgccgggaccttagactggccgctaatgccatctgttctgcggtgccgagccactgggttcccacctcccgcacaacctggagcattcatgccaagcacgagtggatgacaaccgaggacatgctcacggtgtggaaccgggtctggatcagagaaaatccttggatggaggataaaacacccgtggaatcttgggaggaaattccttatctgggcaagcgcgaggaccaatggtgcggatccctgatcggcctcaccagccgggctacctgggccaagaacatccaggctgccattaatcaggttagatctctgatcgggattgaggaatacacagattacatgccctccatgaaacgctttcggagagaggaagaggaagctggagtgctttggtga

SEQ ID NO: 20065 - RNA, 9876 nt, synthetic construct
  misc_feature 1..9876: note = derived and/or modified CDS sequence (opt5) from DENV-2__FJ562098__SS-prME
  source 1..9876: mol_type = other RNA
agcgctggcatgatcattatgctgatccccaccgtcatggctttccacctgaccacgagaaatggggaacctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgcgacggagaaggattctccggtgaacattgaagccgagcccccttttggcgactcctacatcattatcggggttgagcccggccagctcaagctgaattggttcaaaaagggaagctctattggccaaatgtttgaaaccacaatgagaggggctaaaagaatggccatccttggagataccgcctgggacttcggcagcctcgggggagtgtttacatccatcggcaaggctctccatcaggtcttcggggccatttatggcgcggctttttctggagtgagctggaccatgaaaatcctgattggcgtgatcattacgtggatcgggatgaactcccgcagcacatctctgtccgttagccttgtcctcgtgggaatcgtgaccctgtacctgggcgtcatggtgcaggccgattctgggtgtgttgtgtcctggaagaataaggagctcaaatgcggaagcggcattttcatcaccgacaacgtccacacatggaccgaacagtataagtttcaacctgagtccccctctaaactggccagcgctattcagaaggcccaggaagaggggatctgtggcattcggtccgtgacaagacttgagaatctgatgtggaaacagatcacgccggaactcaaccacatcctggctgagaatgaagttaagctgaccattatgacaggagatatcaaaggcattatgcaagccgggaagcgctctcttcggcctcagcccatcgagctcaagtacagctggaaaacctggggaaaggcgaaaatgctgtccacagaaagccataaccagaccttcctgattgacggccctgagacggccgagtgccccaataccaacagagcttggaactctctcgaagtggaggattatgggtttggagtcttcacaaccaacatctggctgcgccttaaggaaaaacaggacgccttttgtgactccaagctgatgagcgctgccatcaaggataatcgggcggtgcacgccgacatgggctactggattgagtctgctctcaacgatacatggaaaatcgagaaggcctccttcattgaagttaaaaattgccattggcctaagagccacaccctgtggtctaacggcgtgctggagagcgaaatggtcatccccaaaaaccttgctgggccggtgtcccaacacaattatagacctggataccatacacagattgccggcccctggcacctcgggaagctggagatggacttcgatttttgtgacggaaccacggtgatcgtcacagaagattgcggcaaccgcgggcccagcctgcggaccaccacagcctctggaaagctcattaccgagtggtgctgtagatcctgcacgctgcctccgcttcggtaccgcggcgaggacggctgttggtatgggatggaaatcagacccctgaaagagaaggaagagaatctcgttaacagcctggtgacagctggacatggccaggtggataatttctccctgggggtccttggaatggcgctctttctggaagagatgctgcggaccagagtgggcacaaaacacgccatcctcctggttgctgtgtctttcgtcacccttattacagggaacatgagctttaaggacctgggacgcgtggttgtgatggtcggcgccaccatggccgatgacatcggcatgggggtgacgtacctcgctctgctggccgcgttcaaagttcggcctacctttgctgccggacttctgctcagaaagctgacatccaaggagctcatgatgaccacaattggcatcgtgctgctttctcaaagcaccattcccgaaacggtcctggagctcacagatgccctggctctggggatgatggtgcttaaaatcgtgcgcaatatggaaaagtatcagctggccgtcaccatcatggcgattctctgcgttcctaacgctgtgatcctgcagaatgcctggaaagtgtcctgtacaattctcgccgtcgtgtctgttagccccctgcttctgacctccagccagcaaaagaccgactggatccctctcgctctgacaattaaaggactgaaccccacggccatcttccttaccacactgtctagaaccaataagaaacggtcctggccgctcaacgaggctatcatggccgtgggcatggtcagcattctggcgtcttccctcctgaagaatgacatccctatgacagggccccttgtggccggaggcctgctgaccgtttgctacgtgctcacgggccgcagcgctgatctggaacttgagagagccacagacgtcaagtgggaggatcaggctgaaatttctgggtccagccctatcctgtccattaccatcagcgaggacggatctatgagcattaaaaacgaagaggaggaacagaccctcacaatcctgatccggaccggcctcctggtgatttccgggctttttcccatctctattccgatcacagccgccgcttggtatctgtgggaggtcaagaaacagcgcgcgggagtgctgtgggatgttccttctccccctcccatgggcaaggccgaactcgaggacggggcttacagaattaaacaaaagggaatcctgggctattcccagatcggcgccggggtgtacaaggaaggaacgttccataccatgtggcacgtcacacggggcgccgtgcttatgcacaaagggaagcgcattgagccctcctgggctgatgttaaaaaggacctgatcagctacggaggcgggtggaaactcgagggagaatggaaggagggcgaagaggtgcaggtcctggccctcgaacctggcaagaatccgagagcggtgcagaccaaacccgggctgtttaagacaaacaccggaacgattggcgctgtgtcccttgatttctctcctgggaccagcggatcccccatcattgacaaaaagggcaaagttgtcgggctgtatggaaacggcgtggtgacacggagcggcgcctacgtctctgccatcgctcaaaccgagaagtccatcgaggataatcctgaaattgaggacgatatctttcgcaagagacggctgacaattatggacctccatcccggggccggaaaaaccaagagatatctgcctgcgatcgtgcgcgaagctattaaacggggccttagaacactgatcctcgccccgacgcgcgttgtggccgctgagatggaagaggccctgcgggggctccccattagataccagacccctgctatccgcgccgagcacacaggacgggaaatcgtcgacctgatgtgtcatgcgaccttcaccatgagacttctgagccccgtgcgcgttcctaactataatctgattatcatggatgaggcccacttcacagaccccgcttctattgccgctcggggctacatctccacgagagtggaaatgggggaggccgccggcatttttatgaccgctacaccgcctggaagccgggatcccttcccccagtccaacgcgcctatcatcgacgaggaacgcgagattcccgaaagatcttggaatagcggccatgagtgggtcaccgattttaaggggaaaacagtgtggttcgttccttccatcaaggccggaaacgacattgctgcctgcctccggaagaatggcaaaaaggtgatccaactgagccgcaaaacctttgattctgaatatgtcaagacgagaacaaacgactgggatttcgtggtgaccaccgacatttccgagatgggggccaattttaaagctgagcgggtcatcgatccgagacgctgtatgaagcccgttatccttacagacggagaggaacgggtgattctggccggccctatgcccgtgacccacagctctgcggctcagagacgcgggcggatcggcagaaaccctaaaaatgaaaacgaccagtacatttacatgggagagcccctcgaaaatgatgaggactgcgcccactggaaggaggccaagatgctgctggataacatcaatacaccggaaggcattatccctagcatgttcgagcccgaacgcgagaaagtcgacgctattgatggggaatatcggctcagaggagaggcccgcaagacctttgtggaccttatgagacggggcgatctgcctgtttggctggcgtacaaagtggccgctgaggggatcaactatgccgaccgcagatggtgtttcgatggaatcaagaacaatcagattctcgaagagaacgtcgaagtggagatctggacgaaagagggcgaacggaagaagctgaaaccccgctggcttgacgctagaatttactccgatcctctggccctcaaggagtttaaagagttcgctgccgggcggaagtctctgacactgaatctcatcaccgagatgggcagacttcccacattcatgacccagaagacgcgcgacgcgctggataacctggccgttctccataccgctgaagccggaggccgggcttataatcacgccctgagcgagcttccggagacactggaaaccctcctgctgctcacacttctggccaccgtgacagggggaatttttctgttcctcatgtccggcagagggatcggaaagatgaccctgggcatgtgctgcatcattacggcttctatccttctgtggtacgcgcagattcagcctcattggatcgccgctagcattatcctcgagtttttcctgatcgtcctgctcattcccgaacccgagaagcagcgcacacctcaagacaaccagcttacctatgtggtcatcgccattctgaccgtggttgccgctacaatggccaatgaaatgggctttctggagaaaaccaagaaagacctcgggctgggatccatcgcgacacagcagccggagagcaacattcttgatatcgacctgcggcccgcctctgcttggacgctctacgccgtggctaccacattcgtgacccctatgctgagacactccattgaaaatagctccgtcaacgtttctctgacagccatcgcgaatcaagccaccgtgctcatgggccttgggaagggatggcccctgagcaaaatggatatcggcgtgcctctgctcgctattgggtgttactcccaggtcaaccccatcacgctgaccgccgcccttctgctcctggtggcccactatgctattatcggacctggcctgcaggccaaggcgacacgggaggcccagaagcgcgctgccgctggcattatgaaaaatccgaccgttgacgggatcacagtgatcgatctcgaccccattccttacgatcccaagtttgaaaaacaacttggacaggtcatgctgctgatcctctgcgtgacccaggtcctgatgatgagaacgacatgggccctttgtgaggccctgaccctcgcgacaggccctatttctaccctgtgggaagggaaccccggacggttctggaataccacaatcgctgtgagcatggccaacatttttcgcggctcctatctggctggggccggactccttttcagcatcatgaagaatacgaccaacacaagacggggcaccggcaacatgggggagacactgggagagaaatggaagtctcgcctgaatgccctcggcaaatccgaatttcaaatctacaaaaagagcgggattcaggaggttgacagaaccctggctaaagaaggaatcaagcggggcgagacggatcatcacgccgtgtctcgcgggtccgcgaaacttagatggttcgtcgagcggaacatggtgacaccggaaggaaaggttgtggacctgggctgcggcagagggggatggagctattactgtggcgggctcaaaaatgtccgcgaggtgaagggactgaccaagggcgggcctggacatgaagaacccattcccatgtctacctatggctggaacctggtgcggctccagagcggcgttgatgtctttttcatccctcccgaaaaatgcgacacacttctgtgtgatattggggagtcctctcctaatccgaccgtggaggccggaagaacactgcgcgtgctcaacctggtcgaaaattggcttaacaataacacgcagttctgcatcaaggttctgaatccctacatgcctagcgtgatcgagaaaatggaagctctccaacggaagtacggcggggccctggtgagaaaccccctgtcccgcaatagcacccacgagatgtattgggtctccaacgcttctggaaatattgtgagctccgttaacatgatctctcggatgctcattaacagatttacaatgcgccataaaaaggccacctacgaacctgacgtggaccttggcagcgggacacggaatatcggaattgagtccgagatccccaacctggatattatcggcaagagaatcgagaagattaagcaggagcacgaaacctcttggcactatgaccaggatcatccgtacaaaacgtgggcgtatcacggcagctacgagaccaagcagacagggtccgccagctctatggtcaatggagtggttcgcctgctcaccaaaccttgggacgtgctgcccacagtcacccaaatggctatgacagataccacgcctttcggccagcagcgggtgtttaaggaaaaggtggacacaagaacccaggagcccaaagaggggaccaagaaacttatgaagatcacagccgaatggctgtggaaagagctcggaaagaaaaagacgcctcgcatgtgtaccagagaagagttcacacggaaggtccgctccaacgctgccctgggcgctatttttaccgatgagaataaatggaaaagcgccagagaagcggttgaggactctcggttctgggaactggtggataaagagagaaacctccatctggaagggaagtgcgagacatgtgtgtataatatgatgggaaaacgggagaagaaacttggcgaatttggcaaagccaaggggtcccgcgctatctggtacatgtggctgggagccagattcctcgagtttgaagctctgggcttccttaacgaggaccactggtttagccgggaaaattctctgtccggggtcgagggagagggcctccacaaactggggtacattctgcgcgatgtgagcaagaaagaaggcggagccatgtatgccgacgacaccgcgggctgggatacaagaatcaccctcgaggacctgaagaacgaagagatggttacgaatcatatggaaggggagcacaagaaacttgctgaggccatcttcaagctgacctaccaaaacaaagtggtccgggtgcagcgccccacaccgagaggaaccgttatggatattatctcccggcgcgaccagagaggcagcgggcaagtgggaacatatggcctcaatacctttacgaacatggaagcccagctgattcggcagatggagggggaaggcgtcttcaagaatatccagcatcttacagtgaccgaggaggttgctgtgcaaaactggctggcccgcgtcggaagagaacggctctctcgcatggctattagcggcgatgactgcgtggtcaaacctctggatgacagattcgccaacgcgctgacagccctcaatgatatggggaagatccggaaggacatccagcagtgggagccctccaaaggatggaacgattggacccaggtgcccttttgctctcaccatttccacgaactgattatgaaggacggcagagttcttgtggtcccttgtcgcaatcaagatgagctgatcgggcgggctagaattagccagggagccggctggtccctccgcgaaacggcttgcctggggaaatcttacgcccagatgtggagccttatgtattttcaccggagagacctgcgcctcgcggccaacgctatctgttccgccgtgccgtctcattgggtgcccaccagccggacaacctggtccattcacgctaagcatgagtggatgacaaccgaggacatgctgacagtttggaatagagtgtggatccgcgaaaacccttggatggaggataaaacccccgtcgaaagctgggaggaaattccttacctgggcaagcgggaggaccagtggtgcggatctctcatcggcctgacgtccagagccacatgggctaagaatatccaagccgcgattaaccaggtgcgcagccttatcgggaatgaggaatataccgattacatgccctctatgaaacggttcagacgggaggaagaggaagccggagttctgtggtga

SEQ ID NO: 20066 - RNA, 9876 nt, synthetic construct
  misc_feature 1..9876: note = derived and/or modified CDS sequence (opt5) from DENV-2__FJ859028__SS-prME
  source 1..9876: mol_type = other RNA
agcgccggaatgatcattatgctgatccccaccgtcatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaagaataaccgcgccgttcatgcggatatgggctattggatcgagtctgccctcaatgacacctggaaaattgagaaggcttccttcatcgaagtgaaaaactgccactggcctaagagccatacactgtggtctaacggcgtcctggagagcgaaatgattatccccaaaaatcttgccgggccggtgtcccagcacaactaccggcctggataccacacccagattgctggcccctggcatctcgggaagctggagatggatttcgacttttgtgatggaacgacagtggtcgttaccgaagactgcggcaatagagggcccagcctgcgcaccacaaccgcctctggaaagctcatcacggagtggtgctgtcggtcctgcacactgcctccgcttagatatcggggcgaggatggctgttggtacgggatggaaattcgccccctgaaagagaaggaagagaacctcgtgaatagcctggtgaccgccggacacggccaagtcgacaacttctccctgggggtgcttggaatggctctctttctggaagagatgctgagaacacgggttggcaccaaacatgcgatcctcctggtggccgtctctttcgtgacacttatcaccgggaatatgagctttaaggatctgggaagagttgtggtcatggtgggcgctacgatggccgacgatattggcatgggggttacctatctcgccctgctggctgccttcaaagtgcgccctacatttgcggctggacttctgctccggaagctgacctccaaggagctcatgatgacaaccatcggcattgtcctgctttctcagagcacgatccccgaaacagtgctggagctcaccgacgccctggccctggggatgatggtgcttaaaattgtcagaaacatggaaaagtaccagctggctgttacaatcatggccatcctctgcgtgcctaatgcggtgattctgcagaacgcttggaaagtctcctgtaccatcctcgccgtggtttctgtgagccccctgcttctgacctccagccaacagaagacagattggattcctctcgccctgacgatcaaaggactgaatcccaccgctattttccttacaaccctgtctcgcacaaacaagaaaagatcctggccgctcaatgaggccatcatggctgtcggcatggtgagcatcctggcctcttccctcctgaagaacgacattcctatgaccgggccccttgttgcgggaggcctgctgacggtgtgctatgtcctcacaggccggagcgccgacctggaacttgagcgcgctaccgatgtgaagtgggaggaccaggccgaaatctctgggtccagccctattctgtccatcaccattagcgaggatggatctatgagcatcaaaaatgaagaggaggaacagacactcaccattctgatcagaacaggcctcctggtcatctccgggctttttcccatttctatcccgattacggctgccgcctggtacctgtgggaggtgaagaaacaacgggctggagttctgtgggacgtgccttctccccctcccatgggcaaggcggaactcgaggatggggcctatcgcatcaaacagaagggcattctgggctactcccagatcggcgctggggtctacaaggaaggaaccttccacacaatgtggcatgtgaccagaggcgccgttcttatgcacaaagggaagcggatcgagccctcctgggccgacgtgaaaaaggatctgattagctatggaggcgggtggaaactcgagggagaatggaaggagggcgaagaggtccaggtgctggctctcgaacctggcaagaacccgcgcgccgtgcaaacaaaacccgggctgtttaagaccaacacgggaaccatcggcgcggtttcccttgacttctctcctgggacaagcggatcccccattatcgataaaaagggcaaagtcgtggggctgtacggaaatggcgtggtcaccagaagcggcgcttatgtgtctgccattgcccagacagagaagtccatcgaggacaaccctgaaatcgaggatgacatttttcggaagcgcagactgaccatcatggatctccaccccggggctggaaaaacaaagcggtacctgcctgccattgttagagaagcgatcaaacgcggccttcggacgctgattctcgctccgaccagagtggtcgccgccgagatggaagaggctctgcgcgggctccccatccggtatcagacccctgccattagagctgagcataccggacgcgaaatcgtggacctgatgtgtcacgccaccttcacaatgcggcttctgagccccgttagagtgcctaattacaacctgatcattatggacgaggcgcatttcacggatcccgcctctatcgctgcccgcggctatatttccacccgggtcgaaatgggggaggctgccggcatctttatgacagccaccccgcctggaagcagagaccccttcccccaatccaatgctcctattatcgatgaggaacgggagatccccgaacgctcttggaacagcggccacgagtgggtgacagactttaaggggaaaaccgtttggttcgtgccttccattaaggcgggaaatgatatcgccgcttgcctcagaaagaacggcaaaaaggtcattcagctgagccggaaaacgtttgactctgaatacgtgaagacacgcaccaatgattgggacttcgtggtcaccacagatatctccgagatgggggccaactttaaagccgagagagttattgacccgcggagatgtatgaagcccgtgatccttaccgatggagaggaacgcgtgatcctggctggccctatgcccgtcacacatagctctgccgcgcagcggagagggcgcattggccggaatcctaaaaacgaaaatgaccagtacatctatatgggagagcccctcgaaaacgacgaggattgcgctcactggaaggaggccaagatgctgctggacaatattaacaccccggaaggcatcattcctagcatgttcgagcccgaaagagagaaagtggatgccatcgacggggaataccgcctccggggagaggctagaaagacgtttgttgatcttatgcgcagaggcgacctgcctgtgtggctggcctataaagtcgcggccgaggggattaactacgctgatcggcgctggtgtttcgacggaatcaagaataaccaaatcctcgaagagaatgtggaagttgagatttggacaaaagagggcgaaagaaagaagctgaaaccccggtggcttgatgcccgcatctattccgaccctctggctctcaaggagtttaaagagttcgccgctgggagaaagtctctgaccctgaacctcattacagagatgggccggcttcccaccttcatgacgcagaaaaccagagatgccctggacaatctggcggtgctccacacagccgaagctggaggccgcgcctacaaccatgctctgagcgagcttccggagaccctggaaacactcctgctgctcacccttctggccacagtcaccgggggaatctttctgttcctcatgtccggccgggggattggaaagatgacgctgggcatgtgctgcatcatcacagcctctattcttctgtggtatgctcagatccagcctcactggattgcggccagcatcattctcgagtttttcctgatcgtgctgctcatccccgaacccgagaagcaaagaacccctcaggataatcagcttacctacgtcgtgattgctatcctgacagttgtggccgccaccatggctaacgaaatgggctttctggagaaaacaaagaaagacctcgggctgggatccattgccacgcagcaaccggagagcaatatccttgacattgatctgcgccccgcgtctgcctggaccctctacgctgtggccacaaccttcgtcacacctatgctgcggcattccatcgaaaacagctccgttaatgtgtctctgaccgctattgccaaccaggcgacggtgctcatgggccttgggaagggatggcccctgagcaaaatggacatcggcgtccctctgctcgccatcgggtgttattcccaggtgaatcccattaccctgacagctgcccttctgctcctggttgctcactacgccatcattggacctggcctgcaggctaaggccaccagagaggcgcaaaagcgggccgctgccggcatcatgaaaaacccgacagtggatgggattaccgtcatcgacctcgatcccatcccttatgaccccaagtttgaaaaacagcttggacaggtgatgctgctgattctctgcgtcacgcaagtgctgatgatgcgcacaacctgggctctttgtgaggccctgacactcgccaccggccctatctctaccctgtgggaagggaatcccggaagattctggaacacaacgattgcggttagcatggctaatatctttcggggctcctacctggccggggctggactccttttcagcattatgaagaacaccacaaacacccgcagaggcacaggcaatatgggggagaccctgggagagaaatggaagtctcggctgaacgccctcggcaaatccgaatttcagatctataaaaagagcgggatccaggaggtggatcgcacgctggccaaagaaggaattaagagaggcgagacagaccaccatgctgtctctcgggggtccgccaaacttcgctggttcgtggagagaaatatggttaccccggaaggaaaggtggtcgatctgggctgcggcagagggggatggagctactattgtggcgggctcaaaaacgtgcgggaggtgaagggactgaccaagggcgggcctggacacgaagaacccatccccatgtctacatacggctggaatctggttcgcctccagagcggcgtcgacgtgtttttcattcctcccgaaaaatgcgatacccttctgtgtgacatcggggagtcctctcctaacccgacagtggaggcgggacggacgctgagagtcctcaatctggttgaaaactggcttaataacaatacccaattctgcattaaggtgctgaacccctacatgcctagcgtgatcgagaaaatggaagccctccagcgcaagtatggcggggctctggtccggaatcccctgtccagaaacagcacacatgagatgtactgggtgtccaatgcctctggaaacatcgttagctccgtgaacatgatttctcgcatgctcatcaatcggtttaccatgagacacaaaaaggctacatatgaacctgatgtcgaccttggcagcgggacccgcaacattggaatcgagtccgagattcccaatctggacatcattggcaagcggatcgagaagatcaagcaggagcatgaaacgtcttggcactacgatcaggaccacccgtataaaacctgggcctaccatggcagctatgagacaaagcaaaccgggtccgcgagctctatggtgaacggagttgtgagactgctcacaaaaccttgggatgtcctgcccaccgtgacacagatggccatgaccgacacgacacctttcggccagcagcgcgtgtttaaggaaaaggtcgatacccggacccaagagcccaaagaggggacaaagaaacttatgaagattacggctgaatggctgtggaaagagctcggaaagaaaaagacccctagaatgtgtacacgcgaagagttcaccagaaaggttcggtccaatgccgctctgggcgccatctttacagacgagaacaaatggaaaagcgctcgcgaagccgtggaggattctagattctgggaactggtggacaaagagcggaatctccacctggaagggaagtgcgagacctgtgtctacaacatgatgggaaaaagagagaagaaacttggcgaatttggcaaagcgaaggggtcccgggccatttggtacatgtggctgggagctcgcttcctcgagtttgaagccctgggcttccttaatgaggatcattggtttagcagagaaaactctctgtccggggtggagggagagggcctccacaaactggggtatatcctgcgggacgttagcaagaaagaaggcggagctatgtacgccgatgacacagccggctgggacacccgcattacgctcgaggatctgaagaatgaagagatggtgaccaaccacatggaaggggagcataagaaacttgcggaggctatcttcaagctgacatatcagaataaagtcgtgagagttcagcggcccaccccgcgcggaacagtgatggacatcatttccagacgggatcaacgcggcagcgggcaggtcggaacctacggcctcaacacgtttacaaatatggaagcccagctgatcagacagatggagggggaaggcgtgttcaagaacattcaacaccttaccgttacagaggaggtggccgtccagaactggctggctcgggtgggacgcgaaagactctctcggatggccatcagcggcgacgattgcgtcgtgaaacctctggacgatcgcttcgctaatgccctgaccgcgctcaacgacatggggaagattagaaaggatatccagcagtgggagccctccaaaggatggaatgactggacgcaagttcccttttgctctcatcacttccatgaactgatcatgaaggatggccgggtgcttgtcgtgccttgtagaaaccaggacgagctgattgggcgcgcccggatcagccagggagctggctggtccctcagagaaaccgcctgcctggggaaatcttatgctcagatgtggagccttatgtactttcaccgccgggatctgagactcgccgcgaatgccatttgttccgctgtgccgtctcactgggttcccacaagccgcaccacatggtccatccatgccaagcacgagtggatgaccacagaggacatgctgaccgtgtggaaccgggtctggattagagaaaatccttggatggaggacaaaacgcccgtggaaagctgggaggaaatcccttatctgggcaagcgcgaggatcaatggtgcggatctctcattggcctgacatcccgggctacctgggccaagaacatccaggttgctatcaatcaggtgagaagccttattgggaacgaggaatacaccgactacatgccctctatgaaacgcttccggagagaggaagaggaagccggagtcctgtggtga

SEQ ID NO: 20067 - RNA, 9876 nt, synthetic construct
  misc_feature 1..9876: note = derived and/or modified CDS sequence (opt5) from DENV-2__FJ410200__SS-prME
  source 1..9876: mol_type = other RNA
agcgccggcatgatcattatgctgatccccaccgtcatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcaacttttgtgatggaacgacagtgatcgtcaccgaagactgcggcaatagagggcccagcctgcgcaccacaaccgcctctggaaagctcattacggagtggtgctgtcggtcctgcacactgcctccgcttagatatcggggcgaggatggctgttggtacgggatggaaatccgccccctgaaagagaaggaagagaacctcgttaatagcctggtgaccgccggacacggccaagtggacaacttctccctgggggtccttggaatggctctctttctggaagagatgctgagaacacgggtgggcaccaaacatgcgatcctcctggttgccgtgtctttcgtcacacttattaccgggaatatgagctttaaggatctgggaagagtggttgtgatggtcggcgctacgatgaccgacgatatcggcatgggggtgacatatctcgccctgctggccgctttcaaagttcgccctacctttgccgcgggacttctgctccggaagctgacatccaaggagctcatgatgaccacgattggcatcgtgctgctttctcagagcacaattcccgaaaccgtcctggagctcacagacgctctggccctggggatgatggtgcttaaaatcgtgagaaacatggaaaagtaccagctggccgtcaccatcatggctattctctgcgttcctaatgccgtgatcctgcagaacgcgtggaaagtgtcctgtaccattctcgctgtcgtgtctgttagccccctgcttctgacatccagccaacagaagacggattggatccctctcgccctgaccattaaaggactgaatcccacagccatcttccttaccacactgtctcgcaccaacaagaaaagatcctggccgctcaatgaggctatcatggccgtgggcatggtcagcattctggcttcttccctcctgaagaacgacatccctatgacggggccccttgtggccggaggcctgctgacagtttgctatgtgctcaccggccggagcgcggacctggaacttgagcgcgccaccgatgtcaagtgggaggaccaggctgaaatttctgggtccagccctatcctgtccattacaatcagcgaggatggatctatgagcattaaaaatgaagaggaggaacagaccctcacaatcctgatcagaacgggcctcctggtgatttccgggctttttcccatctctattccgatcaccgccgctgcctggtacctgtgggaggtcaagaaacaacgggccggagtgctgtgggacgttccttctccccctcccatgggcaaggctgaactcgaggatggggcgtatcgcattaaacagaagggaatcctgggctactcccagatcggcgccggggtgtacaaggaaggaacattccacaccatgtggcatgtcacaagaggcgctgtgcttatgcacaaagggaagcggattgagccctcctgggccgacgttaaaaaggatctgatcagctatggaggcgggtggaaactcgagggagaatggaaggagggcgaagaggtgcaggtcctggccctcgaacctggcaagaacccgcgcgctgtgcaaaccaaacccgggctgtttaagacgaacaccggaacaattggcgccgtgtcccttgacttctctcctgggaccagcggatcccccatcattgataaaaagggcaaagttgtcgggctgtacggaaatggcgtggtgacaagaagcggcgcgtatgtctctgctatcgcccagaccgagaagtccatcgagaacaatcctgaaattgaggacgatatctttcggaagcgcagactgacaattatggacctccaccccggggccggaaaaacgaagcggtacctgcctgctatcgtgagagaagccattaaacgcggccttcggaccctgatcctcgcgccgacaagagttgtggctgccgagatggaagaggccctgcgcgggctccccattcggtatcagacccctgctatcagagccgagcataccggacgcgaaatcgtcgatctgatgtgtcacgctacattcacgatgcggcttctgagccccgtgagagttcctaactacaatctgattatcatggacgaggcccatttcaccgaccccgcgtctattgccgctcgcggctatatctccacacgggtggaaatgggggaggccgctggcatttttatgaccgccacaccgcctggaagcagagatcccttcccccaatccaacgcccctatcatcgacgaggaacgggagattcccgaacgctcttggaatagcggccacgagtgggtcaccgattttaaggggaaaacggtgtggttcgttccttccatcaaggctggaaacgacattgcggcctgcctcagaaagaatggcaaaaaggtgatccagctgagccggaaaacatttgattctgaatacgtcaagacccgcaccaacgactgggatttcgtggtgacaaccgacatttccgagatgggggctaattttaaagccgagagagtcatcgatccgcggagatgtatgaagcccgttatccttacagacggagaggaacgcgtgattctggccggccctatgcccgtgacccatagctctgctgcccagcggagagggcgcatcggccggaaccctaaaaatgaaaacgatcagtacatttatatgggagagcccctcgaaaatgacgaggactgcgcgcactggaaggaggctaagatgctgctggataacatcaacacgccggaaggcattatccctagcatgttcgagcccgaaagagagaaagtcgacgccattgatggggaataccgcctccggggagaggccagaaagacatttgtggaccttatgcgcagaggcgatctgcctgtttggctggcttataaagtggccgcggaggggatcaattacgccgaccggcgctggtgtttcgatggaatcaagaacaatcaaattctcgaagagaacatggaagtcgagatctggaccaaagagggcgaaagaaagaagctgaaaccccggtggcttgacgctcgcatttattccgatcctctggccctcaaggagtttaaagagttcgctgccgggagaaagtctctgacactgaatctcatcaccgagatgggccggcttcccacgttcatgacccagaaaacaagagacgctctggataacctggccgtgctccacaccgcggaagccggaggccgcgcttacaatcatgccctgagcgagcttccggagacactggaaaccctcctgctgctcacacttctggctaccgttacagggggaatttttctgttcctcatgtccggccgggggatcggaaagatgacactgggcatgtgctgcatcattaccgcctctatccttctgtggtatgcccagattcagcctcactggatcgctgcgagcattatcctcgagtttttcctgatcgtgctgctcattcccgaacccgagaagcaaagaacccctcaggacaaccagcttacatacgtcgtgatcgccattctgaccgtcgtggctgccacaatggccaatgaaatgggctttctggagaaaacgaagaaagatctcgggctgggatccatcgctacccgccagccggagagcaacattcttgacatcgacctgcggcccgcctctgcgtggacactctacgccgttgctaccacattcgtgacccctatgctgagacattccattgaaaatagctccgtgaacgtctctctgacggccatcgctaatcaagccaccgttctcatgggccttgggaagggatggcccctgagcaaaatggatatcggcgtgcctctgctcgcgattgggtgttattcccaggtgaaccccatcacactgaccgccgcccttctgctcctggtcgcccactacgctattatcggacctggcctgcaggccaaggctacacgggaggcccagaagcgcgcggccgctggcattatgaaaaatccgaccgtggacgggatcacggttatcgatctcgaccccattccttatgatcccaagtttgaaaaacaacttggacaggtgatgctgctggtcctctgcgtgacacaggtcctgatgatgagaaccacatgggccctttgtgaggctctgaccctcgccaccggccctatctctacactgtgggaagggaaccccggacggttctggaatacgaccattgccgtgagcatggcgaacatctttcgcggctcctacctggctggggccggactccttttcagcattatgaagaacacaaccaatacaagacggggcaccggcaacatgggggagacgctgggagagaaatggaagtctcgcctgaatgctctcggcaaatccgaatttcaaatctataaaaagagcgggatccaggaggttgacagaacactggccaaagaaggaattaagcggggcgagaccgatcaccatgccgtgtctcgcgggtccgctaaacttagatggttcgtcgagcggaacatggtgaccccggaaggaaaggttgtggacctgggctgcggcagagggggatggagctactattgtggcgggctcaaaaatgtccgcgaggtgaagggactgacaaagggcgggcctggacacgaagaacccatccccatgtctacctacggctggaacctggtgcggctccagagcggcgttgatgtctttttcattcctcccgaaaaatgcgacacacttctgtgtgatatcggggagtcctctcctaatccgacggtggaggccggaagaaccctgcgcgtgctcaacctggtcgaaaattggcttaacaataacacacagttctgcattaaggttctgaatccctacatgcctagcgtgatcgagaaaatggaagcgctccaacggaagtatggcggggccctggtgagaaaccccctgtcccgcaatagcacccatgagatgtactgggtctccaacgcttctggaaacatcgtgagctccgttaatatgatttctcggatgctcatcaacagatttacaatgcgccacaaaaaggccacctatgaacctgacgtggatcttggcagcgggacgcggaatattggaatcgagtccgagattcccaacctggacatcattggcaagagaatcgagaagatcaagcaggagcatgaaacctcttggcactacgaccaggatcacccgtataaaacatgggcttaccatggcagctatgagaccaagcagacagggtccgccagctctatggtcaatggagtggttcgcctgctcaccaaaccttgggacgtgctgcccacagtcacccaaatggcgatgacggatacaacccctttcggccagcagcgggtgtttaaggaaaaggtggacaccagaacacaggagcccaaagaggggacgaagaaacttatgaagattaccgccgaatggctgtggaaagagctcggaaagaaaaagacacctcgcagatgtacccgggaagagttcacacgcaaggtcagatccaacgctgccctgggcgctatctttaccgatgagaataaatggaaaagcgcccgggaagctgttgaggactctagattctgggaactggtggataaagagcggaacctccacctggaagggaagtgcgagacatgtgtgtacaatatgatgggaaaacgcgagaagaaacttggcgaatttggcaaagccaaggggtccagagcgatttggtacatgtggctgggagcccggttcctcgagtttgaagctctgggcttccttaacgaggaccattggtttagccgcgaaaattctctgtccggggtcgagggagagggcctccacaaactggggtatatcctgagagatgtgagcaagaaagaaggcggagccatgtacgctgacgataccgccggctgggacacgcggattaccctcgaggacctgaagaacgaagagatggttacaaatcacatggaaggggagcataagaaacttgccgaggcgatcttcaagctgacctatcaaaacaaagtggtccgcgtgcagagacccacaccgcggggaaccgttatggatatcatttcccgcagagaccagcggggcagcgggcaagtgggaacgtacggcctcaatacatttaccaacatggaagctcagctgatccgccagatggagggggaaggcgtcttcaagaacattcagcaccttacagtgaccgaggaggttgccgtgaaaaattggctggccagagtcggacgggaacgcctctctagaatggctatcagcggcgatgactgcgtggtcaagcctctggatgaccggttcgccaacgctctgacggccctcaatgatatggggaagattagaaaagacatccaacagtgggagccctccaagggatggaacgattggacccaggtgcccttttgctctcatcacttccatgaactgatcatgaaagacggccgcgttcttgtggtcccttgtcggaatcaggatgagctgattgggagagcgcgcatcagccaaggagccggctggtccctccgggaaacagcttgcctggggaagtcttatgcccagatgtggagccttatgtactttcacagacgcgacctgcggctcgctgccaacgcgatttgttccgccgtgccgtctcactgggtgcccaccagcagaacaacctggtccatccatgctaaacacgagtggatgacaaccgaggatatgctgacggtttggaatcgcgtgtggattcgggaaaacccttggatggaggacaagacacccgtcgaaagctgggaggaaatcccttatctgggcaagagagaggaccagtggtgcggatctctcattggcctgacctcccgcgccacctgggctaaaaatatccaggccgctatcaaccaagtgcggagccttattgggaatgaggaatacacagattacatgccctctatgaagagattccggagagaggaagaggaagccggagttctgtggtga

SEQ ID NO: 20068 - RNA, 9876 nt, synthetic construct
  misc_feature 1..9876: note = derived and/or modified CDS sequence (opt5) from DENV-2__FJ410202__SS-prME
  source 1..9876: mol_type = other RNA
agcgccggcatgatcattatgctgatccccacagtgatggctttccacctgacgacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccgtgggcaaggccctccatcaggtgttcggggctatctatggcgccgcgttttctggagttagctggaccatgaaaattctgatcggcgtcattatcacgtggattgggatgaactcccgcagcacatctctgtccgtgagccttgtgctcgtcggaatcgtgaccctgtacctgggcgttatggtgcaggctgattctgggtgtgtcgtgtcctggaagaataaggagctcaaatgcggaagcggcatcttcattaccgacaacgttcacacatggaccgaacagtataagtttcaacctgagtccccctctaaactggccagcgccatccagaaggctcaggaagaggggatttgtggcatccggtccgtgacaagacttgagaatctgatgtggaaacagattacgccggaactcaaccacatcctggccgagaatgaagtcaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagttttcaccacaaacatctggctgaaacttaaagaaaagcaggacgctttttgtgactccaagctgatgagcgccgctattaaagataatcgcgccgtgcatgcggacatgggctattggatcgagtctgccctcaacgatacctggaagatcgagaaggctagcttcattgaagtcaagaattgccactggcctaaaagccatacactgtggtctaacggcgtgctggagagcgaaatgatcattcccaagaaccttgccgggccggtgtcccaacacaattaccggcctggataccacacccagatcgctggcccctggcatctcgggaagctggagatggacttcgatttttgtgacggaacgacagtcattgttaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaattcgccccctgaaggagaaagaagagaatctcgtgaacagcctggtgaccgccggacacggccaggtcgataatttctccctgggggtgcttggaatggctctctttctggaagagatgctgagaacacgggttggcaccaagcatgcgatcctcctggtggccgtctctttcgtgacacttatcaccgggaacatgagctttaaagacctgggaagagttgtggtcatggtgggcgctacgatggccgatgacattggcatgggggttacctatctcgccctgctggctgccttcaaggtgcgccctacatttgcggctggacttctgctccggaagctgacctccaaagagctcatgatgacaaccatcggcattgtcctgctttctcaaagcacgatccccgaaacagtgctggagctcaccgatgccctggccctggggatgatggtgcttaagattgtcagaaatatggaaaaataccagctggctgttacaatcatggccatcctctgcgtgcctaacgcggtgattctgcagaatgcttggaaggtctcctgtaccatcctcgccgtggtttctgtgagccccctgcttctgacctccagccagcagaagaccgactggattcctctcgccctgacgatcaagggactgaaccccaccgctattttccttacaaccctgtctcgcacaaataaaaagagatcctggccgctcaacgaggccatcatggctgtcggcatggtgagcatcctggcctcttccctcctgaagaatgacattcctatgaccgggccccttgttgcgggaggcctgctgacggtgtgctatgtcctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccattctgatcagaacaggcctcctggtcatctccgggctttttcccatttctatcccgattacggctgccgcctggtacctgtgggaggtgaaaaagcagcgggctggagttctgtgggatgtgccttctccccctcccatgggcaaagcggaactcgaggacggggcctatcgcatcaagcaaaagggcattctgggatactcccagatcggcgctggggtctacaaagaaggaaccttccacacaatgtggcatgtgaccagaggcgccgttcttatgcacaaggggaaacggatcgagccctcctgggccgatgtgaagaaagacctgattagctatggaggcgggtggaagctcgagggagaatggaaggagggcgaagaggtccaggtgctggctctcgaacctggcaaaaatccgcgcgccgtgcagacaaagcccgggctgtttaaaaccaacacgggaaccatcggcgcggtttcccttgatttctctcctgggacaagcggatcccccattatcgacaagaaaggcaaggtcgtggggctgtacggaaacggcgtggtcaccagaagcggcgcttatgtgtctgccattgcccaaacagagaagtccatcgaggataatcctgaaatcgaggacgatatttttcggaaacgcagactgaccatcatggacctccaccccggggctggaaagacaaaacggtacctgcctgccattgttagagaagcgatcaagcgcggccttcggacgctgattctcgctccgaccagagtggtcgccgccgagatggaagaggctctgcgcgggctccccatccggtatcagacccctgccattagagctgagcataccggacgcgaaatcgtggacctgatgtgtcacgccaccttcacaatgcggcttctgagccccgttagagtgcctaactacaatctgatcattatggatgaggcgcatttcacggaccccgcctctatcgctgcccgcggctatatttccacccgggtcgaaatgggggaggctgccggcatctttatgacagccaccccgcctggaagcagagatcccttcccccagtccaacgctcctattatcgacgaggaacgggagatccccgaacgctcttggaatagcggccacgagtgggtgacagattttaaagggaagaccgtttggttcgtgccttccattaaggcgggaaacgacatcgccgcttgcctccgcaaaaatggcaagaaagtcattcaactgagccggaagacgtttgattctgaatacgtgaaaacacgcaccaacgactgggatttcgtggtcaccacagacatctccgagatgggggccaattttaaggccgagagagttattgatccgcggagatgtatgaaacccgtgatccttaccgacggagaggaacgcgtgatcctggctggccctatgcccgtcacacatagctctgccgcgcagcggagagggcgcattggccggaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaataccgcctccggggagaggctagaaaaacgtttgttgaccttatgcgcagaggcgatctgcctgtgtggctggcctataaggtcgcggccgaggggattaactacgctgaccggcgctggtgtttcgatggaatcaaaaacaatcagatcctcgaagagaacgtggaagttgaggtgtggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggtcctccacacagccgaagtgggaggccgcgcttacaatcatgccctgagcgagcttccggagaccctggaaacactcctgctgctcacccttctggctacagtcaccgggggaatttttctgttcctcatgtccggccgggggatcggaaagatgacgctgggcatgtgctgcattatcacagcctctatccttctgtggtatgcccagattcagcctcactggatcgctgcgagcattatcctcgagtttttcctgattgtgctgctcatccccgaacccgagaaacagagaacccctcaagacaaccagcttacctacgttgtgatcgccattctgacagtggtcgctgccaccatggccaatgaaatgggctttctggagaagaccaagaaggacctcgggctgggatccatcgctacgcagcagccggagagcaacattcttgatatcgacctgcgccccgcctctgcgtggaccctctacgccgttgctacaaccttcgtgacacctatgctgcggcattccattgaaaatagctccgtgaacgtctctctgaccgccatcgctaatcaagccacggtgctcatgggccttgggaaaggatggcccctgagcaagatggatattggcgttcctctgctcgcgatcgggtgttattcccaggtgaaccccatcaccctgacagccgcccttctgctcctggtcgcccactacgctattatcggacctggcctgcaggccaaggctaccagagaggcccagaaacgggcggccgctggcattatgaagaatccgacagtggacgggatcaccgtcattgatctcgaccccatcccttatgatcccaaatttgaaaagcaacttggacaggtgatgctgctgatcctctgcgttacacaggtgctgatgatgcgcacaacctgggccctttgtgaggctctgacactcgccaccggccctatttctaccctgtgggaagggaaccccggaagattctggaatacaacgatcgccgtcagcatggcgaacatttttcggggctcctacctggctggggccggactccttttcagcatcatgaaaaataccacaaacacccgcagaggcacaggcaacatgggggagaccctgggagagaagtggaaatctcggctgaatgctctcggcaagtccgaatttcaaatttataagcgcagcgggatccaggaggtggacagaacgctggccaaagaaggaatcaagcggggcgagacagatcaccatgccgtttctcgcgggtccgctaaacttagatggttcgtggagcggaacatggtcaccccggaaggaaaggtggtggacctgggctgcggcagagggggatggagctactattgtggcgggctcaaaaatgttcgcgaggtcaagggactgaccaagggcgggcctggacacgaagaacccattcccatgtctacatacggctggaacctggtgcggctccagagcggcgtggatgtctttttcatccctcccgaaaaatgcgacacccttctgtgtgatattggggagtcctctcctaatccgacagttgaggccggaagaacgctgcgcgtgctcaacctggtggaaaattggcttaacaataacacccagttctgcatcaaggtcctgaatccctacatgcctagcgtgattgagaaaatggaagcgctccaacggaagtatggcggggccctggttagaaaccccctgtcccgcaatagcacacatgagatgtactgggtgtccaacgcttctggaaatatcgtcagctccgtgaacatgatctctcggatgctcattaacagatttaccatgcgccacaaaaaggccacatatgaacctgacgttgaccttggcagcgggacccggaatatcggaattgagtccgagatccccaacctggatattatcggcaagagaattgagaaaatcaagcaggagcatgaaacgtcttggcactacgaccaggatcacccgtataaaacctgggcttaccatggcagctatgagacaaagcagaccgggtccgccagctctatggtgaatggagtcgtgcgcctgctcacaaaaccttgggacgtgctgcccaccgtcacacaaatggcgatgaccgatacgacacctttcggccagcagcgggtttttaaggaaaaggtggacaccagaacccaggagcccaaagaggggacaaagaaacttatgaagatcacggccgaatggctgtggaaagagctcggaaagaaaaagacccctcgcatgtgtacaagagaagagttcacccggaaggtgcgctccaacgctgccctgggcgctatttttacagatgagaataaatggaaaagcgccagagaagctgtcgaggactctcggttctgggaactggtggataaagagagaaacctccacctggaagggaagtgcgagacctgtgtttacaatatgatgggaaaacgggagaagaaacttggcgaatttggcaaagccaaggggtcccgcgcgatctggtacatgtggctgggagccagattcctcgagtttgaagctctgggcttccttaacgaggaccattggtttagccgggaaaattctctgtccggggtggagggagagggcctccacaaactggggtatattctgcgcgatgtcagcaagaaagaaggcggagccatgtacgctgacgacacagccggctgggataccagaatcacgctcgaggacctgaagaacgaagagatggtgaccaatcacatggaaggggagcataagaaacttgccgaggcgattttcaagctgacatatcaaaacaaagttgtgcgggtccagcgccccaccccgagaggaacagtgatggatatcatctcccggcgcgaccagagaggcagcgggcaagttggaacctacggcctcaatacgtttacaaacatggaagctcagctgattcggcagatggagggggaaggcgtgttcaagaatatccagcaccttaccgtcacagaggaggtggccgtccaaaactggctggcccgcgtgggaagagaacggctctctcgcatggctattagcggcgatgactgcgttgtgaaacctctggatgacagattcgccaacgctctgaccgccctcaatgatatggggaagatccggaaggacattcagcagtgggagccctccaaaggatggaacgattggacgcaggtccccttttgctctcatcacttccatgaactgatcatgaaggacggcagagtgcttgtggttccttgtcgcaatcaagatgagctgatcgggcgggcgagaattagccagggagccggctggtccctccgcgaaaccgcttgcctggggaaatcttatgcccagatgtggagccttatgtactttcaccggagagacctgcgcctcgctgccaacgcgatctgttccgccgtgccgtctcactgggtccccacaagccggaccacatggtccattcatgctaagcacgagtggatgaccacagaggacatgctgaccgtgtggaatagagtttggatccgcgaaaacccttggatggaggataaaacgcccgtggaaagctgggaggaaattccttatctgggcaagcgggaggaccagtggtgcggatctctcatcggcctgacatccagagccacctgggctaagaatattcaagccgctatcaaccaggtccgcagccttatcgggaatgaggaatacattgattacatgccctctatgaaacggttcagacgggaggaagaggaagccggagtgctgtggtga

SEQ ID NO: 20069 - RNA, 9876 nt, synthetic construct
  misc_feature 1..9876: note = derived and/or modified CDS sequence (opt5) from DENV-2__FJ410208__SS-prME
  source 1..9876: mol_type = other RNA
agcgccggcatgatcattatgctgatccccaccgtcatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcaacttttgtgatggaacgacagtgatcgtcaccgaagactgcggcaatagagggcccagcctgcgcaccacaaccgcctctggaaagctcattacggagtggtgctgtcggtcctgcacactgcctccgcttagatatcggggcgaggatggctgttggtacgggatggaaatccgccccctgaaagagaaggaagagaacctcgttaatagcctggtgaccgccggacacggccaagtggacaacttctccctgggggtccttggaatggctctctttctggaagagatgctgagaacacgggtgggcaccaaacatgcgatcctcctggttgccgtgtctttcgtcacacttattaccgggaatatgagctttaaggatctgggaagagtggttgtgatggtcggcgctacgatgaccgacgatatcggcatgggggtgacatatctcgccctgctggccgctttcaaagttcgccctacctttgccgcgggacttctgctccggaagctgacatccaaggagctcatgatgaccacgattggcatcgtgctgctttctcagagcacaattcccgaaaccgtcctggagctcacagacgctctggccctggggatgatggtgcttaaaatcgtgagaaacatggaaaagtaccagctggccgtcaccatcatggctattctctgcgttcctaatgccgtgatcctgcagaacgcgtggaaagtgtcctgtaccattctcgctgtcgtgtctgttagccccctgcttctgacatccagccaacagaagacggattggatccctctcgccctgaccattaaaggactgaatcccacagccatcttccttaccacactgtctcgcaccaacaagaaaagatcctggccgctcaatgaggctatcatggccgtgggcatggtcagcattctggcttcttccctcctgaagaacgacatccctatgacggggccccttgtggccggaggcctgctgacagtttgctatgtgctcaccggccggagcgcggacctggaacttgagcgcgccaccgatgtcaagtgggaggaccaggctgaaatttctgggtccagccctatcctgtccattacaatcagcgaggatggatctatgagcattaaaaatgaagaggaggaacagaccctcacaatcctgatcagaacgggcctcctggtgatttccgggctttttcccatctctattccgatcaccgccgctgcctggtacctgtgggaggtcaagaaacaacgggccggagtgctgtgggacgttccttctccccctcccatgggcaaggctgaactcgaggatggggcgtatcgcattaaacagaagggaatcctgggctactcccagatcggcgccggggtgtacaaggaaggaacattccacaccatgtggcatgtcacaagaggcgctgtgcttatgcacaaagggaagcggattgagccctcctgggccgacgttaaaaaggatctgatcagctatggaggcgggtggaaactcgagggagaatggaaggagggcgaagaggtgcaggtcctggccctcgaacctggcaagaacccgcgcgctgtgcaaaccaaacccgggctgtttaagacgaacaccggaacaattggcgccgtgtcccttgacttctctcctgggaccagcggatcccccatcattgataaaaagggcaaagttgtcgggctgtacggaaatggcgtggtgacaagaagcggcgcgtatgtctctgctatcgcccagaccgagaagtccatcgaggacaaccctgaaattgaggatgacatctttcggaagcgcagactgacaattatggatctccaccccggggccggaaaaacgaagcggtacctgcctgctatcgtgagagaagccattaaacgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaattacaacctgattatcatggacgaggcccatttcaccgatcccgcgtctattgccgctcgcggctatatctccacacgggtggaaatgggggaggccgctggcatttttatgaccgccacaccgcctggaagcagagaccccttcccccaatccaatgcccctatcatcgatgaggaacgggagattcccgaacgctcttggaacagcggccacgagtgggtcaccgactttaaggggaaaacggtgtggttcgttccttccatcaaggctggaaatgatattgcggcctgcctcagaaagaacggcaaaaaggtgatccagctgagccggaaaacatttgactctgaatacgtcaagacccgcaccaatgattgggacttcgtggtgacaaccgatatttccgagatgggggctaactttaaagccgagagagtcatcgacccgcggagatgtatgaagcccgttatccttacagatggagaggaacgcgtgattctggccggccctatgcccgtgacccatagctctgctgcccagcggagagggcgcatcggccggaatcctaaaaacgaaaatgaccagtacatttatatgggagagcccctcgaaaacgacgaggattgcgcgcactggaaggaggctaagatgctgctggacaatatcaacacgccggaaggcattatccctagcatgttcgagcccgaaagagagaaagtcgatgccattgacggggaataccgcctccggggagaggccagaaagacatttgtggatcttatgcgcagaggcgacctgcctgtttggctggcttataaagtggccgcggaggggatcaactacgccgatcggcgctggtgtttcgacggaatcaagaataaccaaattctcgaagagaatatggaagtcgagatctggaccaaagagggcgaaagaaagaagctgaaaccccggtggcttgatgctcgcatttattccgaccctctggccctcaaggagtttaaagagttcgctgccgggagaaagtctctgacactgaacctcatcaccgagatgggccggcttcccacgttcatgacccagaaaacaagagatgctctggacaatctggccgtgctccacaccgcggaagccggaggccgcgcttacaaccatgccctgagcgagcttccggagacactggaaaccctcctgctgctcacacttctggctaccgttacagggggaatttttctgttcctcatgtccggccgggggatcggaaagatgacactgggcatgtgctgcatcattaccgcctctatccttctgtggtatgcccagattcagcctcactggatcgctgcgagcattatcctcgagtttttcctgatcgtgctgctcattcccgaacccgagaagcaaagaacccctcaggataatcagcttacatacgtcgtgatcgccattctgaccgtcgtggctgccacaatggccaacgaaatgggctttctggagaaaacgaagaaagacctcgggctgggatccatcgctacccgccagccggagagcaatattcttgacatcgatctgcggcccgcctctgcgtggacactctacgccgttgctaccacattcgtgacccctatgctgagacattccattgaaaacagctccgtgaatgtctctctgacggccatcgctaaccaagccaccgttctcatgggccttgggaagggatggcccctgagcaaaatggacatcggcgtgcctctgctcgcgattgggtgttattcccaggtgaatcccatcacactgaccgccgcccttctgctcctggtcgcccactacgctattatcggacctggcctgcaggccaaggctacacgggaggcccagaagcgcgcggccgctggcattatgaaaaacccgaccgtggatgggatcacggttatcgacctcgatcccattccttatgaccccaagtttgaaaaacaacttggacaggtgatgctgctggtcctctgcgtgacacaggtcctgatgatgagaaccacatgggccctttgtgaggctctgaccctcgccaccggccctatctctacactgtgggaagggaatcccggacggttctggaacacgaccattgccgtgagcatggcgaatatctttcgcggctcctacctggctggggccggactccttttcagcattatgaagaacacaaccaacacaagacggggcaccggcaatatgatcgagacgctgggggagaaatggaagtctcgcctgaacgctctcggaaaatccgaatttcaaatctataaaaagagcggcattcaggaggttgatagaacactggccaaagaagggatcaagcggggagagaccgaccaccatgccgtgtctcgcggctccgctaaacttagatggttcgtcgagcggaatatggtgaccccggaagggaaggttgtggatctgggatgcggcagaggcgggtggagctactattgtggaggcctcaaaaacgtccgcgaggtgaaggggctgacaaagggaggccctgggcacgaagaacccattcccatgtctacctacggatggaatctggtgcggctccagagcggcgttgacgtctttttcatccctcccgaaaaatgcgatacacttctgtgtgacattggcgagtcctctcctaacccgacggtggaggccgggagaaccctgcgcgtgctcaatctggtcgaaaactggcttaataacaatacacagttctgcatcaaggttctgaacccctacatgcctagcgtgatcgagaaaatggaagcgctccaacggaagtatggaggcgccctggtgagaaatcccctgtcccgcaacagcacccatgagatgtactgggtctccaatgcttctgggaacattgtgagctccgttaacatgatctctcggatgctcattaatagatttacaatgcgccacaaaaaggccacctatgaacctgatgtggaccttggaagcggcacgcggaacatcgggattgagtccgagatccccaatctggacattatcggaaagagaatcgagaagattaagcaggagcatgaaacctcttggcactacgatcaggaccacccgtataaaacatgggcttaccatggcagctatgagaccaagcagacaggctccgccagctctatggtcaacggggtggttcgcctgctcaccaaaccttgggatgtgctgcccacagtcacccaaatggcgatgacggacacaacccctttcggacagcagcgggtgtttaaggaaaaggtggataccagaacacaggagcccaaagagggcacgaagaaacttatgaagatcaccgccgaatggctgtggaaagagctcgggaagaaaaagacacctcgcatgtgtaccagagaagagttcacacggaaggtccgctccaatgctgccctgggagctatttttaccgacgagaacaaatggaaaagcgccagagaagctgttgaggattctcggttctgggaactggtggacaaagagagaaatctccacctggaaggcaagtgcgagacatgtgtgtacaacatgatggggaaacgggagaagaaacttggagaatttggcaaagccaagggctcccgcgcgatctggtacatgtggctgggggccagattcctcgagtttgaagctctgggattccttaatgaggatcattggtttagccgggaaaactctctgtccggcgtcgagggggagggactccacaaactgggctatattctgcgcgacgtgagcaagaaagaagggggcgccatgtacgctgatgacaccgccggatgggacacgagaatcaccctcgaggatctgaagaatgaagagatggttacaaaccacatggaaggcgagcataagaaacttgccgaggcgatcttcaagctgacctatcaaaataaagtggtccgggtgcagcgccccacaccgagagggaccgttatggacattatctcccggcgcgatcagagaggaagcggccaagtggggacgtacggactcaacacatttaccaatatggaagctcagctgattcggcagatggagggcgaaggggtcttcaagaacatccagcaccttacagtgaccgaggaggttgccgtgaaaaactggctggcccgcgtcggcagagaacggctctctcgcatggctattagcggagacgattgcgtggtcaagcctctggacgatagattcgccaatgctctgacggccctcaacgacatgggcaagatccggaaagatatccaacagtgggagccctccaaggggtggaatgactggacccaggtgcccttttgctctcatcacttccatgaactgattatgaaagatggaagagttcttgtggtcccttgtcgcaaccaggacgagctgatcggccgggcgagaattagccaaggggccggatggtccctccgcgaaacagcttgcctgggcaagtcttatgcccagatgtggagccttatgtactttcaccggagagatctgcgcctcgctgccaatgcgatctgttccgccgtgccgtctcactgggtgcccaccagccggacaacctggtccattcatgctaaacacgagtggatgacaaccgaggacatgctgacggtttggaacagagtgtggatccgcgaaaatccttggatggaggacaagacacccgtcgaaagctgggaggaaattccttatctggggaagcgggaggatcagtggtgcggctctctcatcggactgacctccagagccacctgggctaaaaacatccaggccgctattaatcaagtgcgcagccttatcggcaacgaggaatacacagactacatgccctctatgaagcggttcagacgggaggaagaggaagccggggttctgtggtga

SEQ ID NO: 20070 - RNA, 9876 nt, synthetic construct
  misc_feature 1..9876: note = derived and/or modified CDS sequence (opt5) from DENV-2__FJ461305__SS-prME
  source 1..9876: mol_type = other RNA
agcgccggcatgatcattatgctgatccccaccgtgatggctttccacctgacaacgagaaatggggagcctcatatgattgttggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaaatcgataatttctccctgggggtgcttggaatggctctctttctggaagagatgctgaaaacaagagtcggcaccaagcatgcgattctcctggtggccgtttctttcgtgacacttatcaccgggaacatgagctttaaagacctgggacgggtcgtggttatggtgggcgctacgatggccgatgacattggcatgggggtcacctatctcgccctgctggctgccttcaaggtgagacctacatttgcggctggacttctgctccgcaagctgacctccaaagagctcatgatgacaaccatcggcattgttctgctttctcagagcacgatccccgaaacagtgctggagctcaccgatgccctggccctggggatgatggtccttaagatcgtgcggaatatggaaaaataccagctggctgtgacaattatggccatcctctgcgtccctaacgcggttattctgcagaatgcttggaaggtgtcctgtaccatcctcgccgtggtctctgtgagccccctgcttctgacctccagccaacagaaaacagactggattcctctcgccctgacgatcaagggactgaaccccaccgctatcttccttacaaccctgtctagaacaaataaaaagcgctcctggccgctcaacgaggccattatggctgttggcatggtgagcatcctggcctcttccctcctgaagaatgacattcctatgaccgggccccttgtcgcgggaggcctgctgacggtgtgctatgttctcacaggcagaagcgccgatctggaacttgagcgggctaccgacgtgaaatgggaggatcaggccgaaatctctgggtccagccctattctgtccatcaccattagcgaggacggatctatgagcatcaagaacgaagaggaggaacagacactcaccatcctgattcgcacaggcctcctggtcatctccgggctttttcccatttctatcccgattacggctgccgcctggtacctgtgggaggtgaaaaagcaaagagctggagtcctgtgggatgtgccttctccccctcccatgggcaaagcggaactcgaggacggggcctatcggatcaagcagaagggaatcctgggctactcccagattggcgctggggtttacaaagaaggaaccttccacacaatgtggcatgtgacccgcggcgccgtccttatgcacaaggggaaaagaatcgagccctcctgggccgatgtgaagaaagacctgattagctatggaggcgggtggaagctcgagggagaatggaaggagggcgaagaggttcaggtgctggctctcgaacctggcaaaaatccgcgggccgtccaaacaaagcccgggctgtttaaaaccaacacgggaaccatcggcgcggtgtcccttgatttctctcctgggacaagcggatcccccattatcgacaagaaaggcaaggtggttgggctgtacggaaacggcgtcgtgacccgcagcggcgcttatgtgtctgccatcgcccagacagagaagtccattgaggataatcctgaaatcgaggacgatatttttagaaaacggcgcctgaccatcatggacctccaccccggggctggaaagacaaaaagatacctgcctgccattgtccgggaagcgatcaagagaggccttcgcacgctgattctcgctccgacccgggtggttgccgccgagatggaagaggctctgagagggctccccatccgctatcagacccctgccatccgggctgagcataccggaagagaaattgtggacctgatgtgtcacgccaccttcacaatgcgccttctgagccccgtccgggtgcctaactacaatctgatcattatggatgaggcgcatttcacggaccccgcctctatcgctgccagaggctatatttccacccgcgttgaaatgggggaggctgccggcatctttatgacagccaccccgcctggaagccgggatcccttcccccaatccaacgctcctatcattgacgaggaaagagagatccccgaacggtcttggaatagcggccacgagtgggtgacagattttaaagggaagaccgtctggttcgtgccttccattaaggcgggaaacgacatcgccgcttgcctccgcaaaaatggcaagaaagttattcagctgagcagaaagacgtttgattctgaatacgtgaaaacacggaccaacgactgggatttcgtcgtgaccacagacatctccgagatgggggccaattttaaggccgagcgcgtgatcgatccgagacggtgtatgaaacccgtcattcttaccgacggagaagagagagttatcctggctggccctatgcccgtgacacatagctctgccgcgcagcgccgggggagaattggccgcaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaacgggagaaggtggacgccatcgatggggaatacagactccgcggagaggctcggaaaacgtttgtcgaccttatgagacgcggcgatctgcctgtgtggctggcctataaggttgcggccgaggggatcaactacgctgacagacggtggtgtttcgatggaattaaaaacaatcaaatcctcgaagagaacgtggaagtcgagatttggacaaaggagggcgaacgcaagaaactgaagcccagatggcttgacgcccggatctattccgatcctctggctctcaaagagtttaaggagttcgccgctgggcgcaaatctctgaccctgaatctcattacagagatgggcagacttcccaccttcatgacgcagaagacccgggacgccctggataacctggcggtgctccacacagccgaagctggaggcagagcctacaatcatgctctgagcgagcttccggagaccctggaaacactcctgctgctcacccttctggccacagttaccgggggaatctttctgttcctcatgtccggccgcgggatcggaaagatgacgctgggcatgtgctgcattatcacagcctctattcttctgtggtatgctcagatccagcctcactggattgcggccagcatcatcctcgagtttttcctgattgtgctgctcatccccgaacccgagaaacaacggacccctcaggacaaccagcttacctacgtcgtgattgctatcctgacagtcgtggccgccaccatggctaatgaaatgggctttctggagaagaccaagaaggacctcgggctgggatccattgccacgcagcaaccggagagcaacatccttgatattgacctgagacccgcgtctgcctggaccctctacgctgttgccacaaccttcgtgacacctatgctgcgccattccatcgaaaatagctccgtgaacgtctctctgaccgctatcgccaatcaggcgacggttctcatgggccttgggaaaggatggcccctgagcaagatggatattggcgtgcctctgctcgccatcgggtgttattcccaggtgaaccccattaccctgacagctgcccttctgctcctggtcgctcactacgccatcattggacctggcctgcaggctaaggccacccgggaggcgcagaagcgggccgctgccggcatcatgaagaatccgacagtggacgggatcaccgttattgatctcgaccccatcccttatgatcccaaatttgaaaagcagcttggacaggtgatgctgctgattctctgcgtcacgcaagtgctgatgatgcggacaacctgggctctttgtgaggccctgacactcgccaccggccctatctctaccctgtgggaagggaaccccggacgcttctggaatacaacgattgcggtcagcatggctaacatctttagaggctcctacctggccggggctggactccttttcagcatcatgaaaaataccacaaacacccggcgcggcacaggcaacatgggggagaccctgggagagaagtggaaatctagactgaatgccctcggcaagtccgaatttcagatttataagaaaagcgggatccaggaggtggaccggacgctggccaaggaaggaattaaacgcggcgagacagatcaccatgctgtttctagagggtccgccaaacttcggtggttcgtggagcgcaacatggtcaccccggaaggaaaagtggttgacctgggctgcggcagagggggatggagctactattgtggcgggctcaagaatgtgcgggaggtcaagggactgaccaaaggcgggcctggacacgaagaacccatccccatgtctacatacggctggaacctggtgagactccagagcggcgtggatgtctttttcattcctcccgaaaagtgcgacacccttctgtgtgatatcggggagtcctctcctaatccgacagtcgaggcgggacgcacgctgcgggtgctcaacctggtggaaaattggcttaacaataacacccaattctgcatcaaagtcctgaatccctacatgcctagcgttattgagaagatggaagccctccagagaaaatatggcggggctctggtgcgcaaccccctgtcccggaatagcacacatgagatgtactgggtgtccaacgcctctggaaatatcgtcagctccgtgaacatgatttctagaatgctcatcaaccgctttaccatgcggcacaagagagctacatatgaacctgacgttgaccttggcagcgggacccgcaatattggaatcgagtccgagattcccaacctggatatcatcggcaagcggattgagaagatcaagcaggagcatgaaacgtcttggcactacgaccaggatcacccgtataaaacctgggcctaccatggcagctatgagacaaagcaaaccgggtccgcgagctctatggtgaatggagtcgtgagactgctcacaaaaccttgggacgttctgcccaccgtgacacagatggccatgaccgatacgacacctttcggccagcagcgcgtctttaaggaaaaggtggacacccggacccaagagcccaaagaggggacaaagaaacttatgaagattacggctgaatggctgtggaaagagctcggaaagaaaaagacccctagaatgtgtacacgcgaagagttcaccagaaaggtgcggtccaacgccgctctgggcgccatctttacagatgagaataaatggaaaagcgctcgcgaagccgtcgaggactctagattctgggaactggttgataaagagcggaacctccacctggaagggaagtgcgagacctgtgtgtacaatatgatgggaaaaagagagaagaaacttggcgaatttggcaaagcgaaggggtcccgggccatttggtacatgtggctgggagctcgcttcctcgagtttgaagccctgggcttccttaacgaggaccattggtttagcagagaaaattctctgtccggggtggagggagagggcctccacaaactggggtatatcctgcgggatgtcagcaagaaagaaggcggagctatgtacgccgacgacacagccggctgggatacccgcatcacgctcgaggacctgaagaacgaagagatggtgaccaatcacatggaaggggagcataagaaacttgcggaggctattttcaagctgacatatcagaacaaagttgtgagagtccagcggcccaccccgcgcggaacagtgatggatatcatttccagacgggaccaacgcggcagcgggcaggttggaacctacggcctcaatacgtttacaaacatggaagcccagctgatcagacagatggagggggaaggcgtgttcaagaatattcaacaccttaccgtcacagaggaggtggccgttcagaactggctggctcgggtgggacgcgaaagactctctcggatggccatcagcggcgatgactgcgtcgtgaaacctctggatgaccgcttcgctaacgccctgaccgcgctcaatgatatggggaagatcagaaaggacattcagcagtgggagccctccaaaggatggaacgattggacgcaagtccccttttgctctcatcacttccatgaactgatcatgaaggacggccgggtgcttgttgtgccttgtagaaatcaggatgagctgattgggcgcgcccggatcagccagggagctggctggtccctcagagaaaccgcctgcctggggaaatcttatgctcagatgtggagccttatgtactttcaccgccgggacctgagactcgccgcgaacgccatttgttccgctgtcccgtctcactgggtgcccacaagccgcaccacatggtccatccatgccaagcacgagtggatgaccacagaggacatgctgaccgtgtggaatcgggtttggattagagaaaacccttggatggaggataaaacgcccgtggaaagctgggaggaaatcccttatctgggcaagcgcgaggaccaatggtgcggatctctcatcggcctgacatcccgggctacctgggccaagaatattcaggctgccatcaaccaggtcagaagccttattgggaatgaggaatacaccgattacatgccctctatgaaacgcttccggagagaggaagaggaagcgggagtgctgtggtga

SEQ ID NO: 20071 - RNA, 9876 nt, synthetic construct
  misc_feature 1..9876: note = derived and/or modified CDS sequence (opt5) from DENV-2__FJ410215__SS-prME
  source 1..9876: mol_type = other RNA
agcgccggaatgatcattatgctgatccccaccgtgatggctttccacctgaccacgagaaatggggaacctcatatgattgtcggaatccaggaaaagggcaaatccctgctttttaagaccgaagacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctgccatggccgatgacatcggcatgggggtgacgtatctcgctctgctggccgcgttcaaggttcgccctacctttgctgccggacttctgctccggaagctgacatccaaagagctcatgatgaccacaattggcatcgtgctgctttctcaaagcaccattcccgaaacggtcctggagctcacagatgccctggctctggggatgatggtgcttaagatcgtgagaaatatggaaaaataccagctggccgtcaccatcatggcgattctctgcgttcctaacgctgtgatcctgcagaatgcctggaaggtgtcctgtacaattctcgccgtcgtgtctgttagccccctgcttctgacctccagccagcagaaaaccgactggatccctctcgctctgacaattaagggactgaaccccacggccatcttccttaccacactgtctcgcaccaataaaaagagatcctggccgctcaacgaggctatcatggccgtgggcatggtcagcattctggcgtcttccctcctgaagaatgacatccctatgacagggccccttgtggccggaggcctgctgaccgtttgctatgtgctcacgggccggagcgctgatctggaacttgagcgcgccacagacgtcaaatgggaggatcaggctgaaatttctgggtccagccctatcctgtccattaccatcagcgaggacggatctatgagcattaagaacgaagaggaggaacagaccctcacaatcctgatcagaaccggcctcctggtgatttccgggctttttcccatctctattccgatcacagccgccgcttggtacctgtgggaggtcaaaaagcagcgggcgggagtgctgtgggatgttccttctccccctcccatgggcaaagccgaactcgaggacggggcttatcgcattaagcaaaagggaatcctgggctactcccagatcggcgccggggtgtacaaagaaggaacgttccacaccatgtggcatgtcacaagaggcgccgtgcttatgcacaaggggaaacggattgagccctcctgggctgatgttaagaaagacctgatcagctatggaggcgggtggaagctcgagggagaatggaaggagggcgaagaggtgcaggtcctggccctcgaacctggcaaaaatccgcgcgcggtgcagaccaagcccgggctgtttaaaacaaacaccggaacgattggcgctgtgtcccttgatttctctcctgggaccagcggatcccccatcattgacaagaaaggcaaggttgtcgggctgtacggaaacggcgtggtgacaagaagcggcgcctatgtctctgccatcgctcaaaccgagaagtccatcgaggataatcctgaaattgaggacgatatctttcggaaacgcagactgacaattatggacctccaccccggggccggaaagaccaaacggtacctgcctgcgatcgtgagagaagctattaagcgcggccttcggacactgatcctcgccccgacgagagttgtggccgctgagatggaagaggccctgcgcgggctccccattcggtatcagacccctgctatcagagccgagcatacaggacgcgaaatcgtcgacctgatgtgtcacgcgaccttcaccatgcggcttctgagccccgtgagagttcctaactacaatctgattatcatggatgaggcccatttcacagaccccgcttctattgccgctcgcggctatatctccacgcgggtggaaatgggggaggccgccggcatttttatgaccgctacaccgcctggaagcagagatcccttcccccagtccaacgcgcctatcatcgacgaggaacgggagattcccgaacgctcttggaatagcggccacgagtgggtcaccgattttaaagggaagacagtgtggttcgttccttccatcaaggccggaaacgacattgctgcctgcctccgcaaaaatggcaagaaagtgatccaactgagccggaagacctttgattctgaatacgtcaaaacgcgcacaaacgactgggatttcgtggtgaccaccgacatttccgagatgggggccaattttaaggctgagagagtcatcgatccgcggagatgtatgaaacccgttatccttacagacggagaggaacgcgtgattctggccggccctatgcccgtgacccatagctctgcggctcagcggagagggcgcatcggccggaaccctaagaatgaaaacgaccagtacatttatatgggagagcccctcgaaaatgatgaggactgcgcccactggaaggaggccaaaatgctgctggataacatcaatacaccggaaggcattatccctagcatgttcgagcccgaaagagagaaggtcgacgctattgatggggaataccgcctccggggagaggccagaaaaacctttgtggaccttatgcgcagaggcgatctgcctgtttggctggcgtataaggtggccgctgaggggatcaactacgccgaccggcgctggtgtttcgatggaatcaaaaacaatcagattctcgaagagaacgtcgaagtggagatctggacgaaggagggcgaaagaaagaaactgaagccccggtggcttgacgctcgcatttattccgatcctctggccctcaaagagtttaaggagttcgctgccgggagaaaatctctgacactgaatctcatcaccgagatgggccggcttcccacattcatgacccaaaagacgagagacgcgctggataacctggccgttctccacaccgctgaagccggaggccgcgcttacaatcatgccctgagcgagcttccggagacactggaaaccctcctgctgctcacacttctggccaccgtgacagggggaatttttctgttcctcatgtccggccgggggatcggaaagatgaccctgggcatgtgctgcatcattacggcttctatccttctgtggtatgcgcagattcagcctcactggatcgccgctagcattatcctcgagtttttcctgatcgtcctgctcattcccgaacccgagaaacagagaacacctcaagacaaccagcttacctacgtggtcatcgccattctgaccgtggttgccgctacaatggccaatgaaatgggctttctggagaagaccaaaaaggacttcgggctcggatccatcgcgacacagcagccggagagcaacattctggatatcgaccttcgccccgcctctgcttggacgctgtacgccgtggctaccacatttgtgacccctatgctccggcattccattgaaaatagctccgtcaacgtttctctgacagccatcgcgaatcaagccaccgtgctgatgggcctcgggaaaggatggccccttagcaagatggatatcggcgtgcctctgctggctattgggtgttattcccaggtcaaccccatcacgctcaccgccgctctgcttctgctcgtggcccactacgctattatcggacctggcctgcaggccaaggcgacaagagaggcccagaaacgggctgccgctggcattatgaagaatccgaccgttgacgggatcacagtgatcgatctggaccccattccttatgatcccaaattcgaaaagcaactcggacaggtcatgcttctgatcctgtgcgtgacccaggtcctcatgatgcgcacgacatgggccctgtgtgaggcccttaccctggcgacaggccctatttctaccctctgggaagggaaccccggaagattttggaataccacaatcgctgtgagcatggccaacattttccggggctcctacctggctggggccggactgctctttagcatcatgaaaaatacgaccaacacacgcagaggcaccggcaacatcggggagacacttggagagaagtggaaatctcggctgaatgccctgggcaagtccgagttccaaacctataagaaaagcgggattcaggaggttgaccgcacgctcgctaaggaaggaatcaaaagaggcgagacagatcaccatgccgtgtctcgggggtccgcgaagctgcgctggtttgtcgagagaaacatggtgaccccggaaggaaaagttgtggaccttggctgcggcagagggggatggagctactattgtggcgggctgaagaatgtccgggaggtgaagggactcaccaaaggcgggcctggacacgaagaacccattcccatgtctacatacggctggaacctggtgcgcctgcagagcggcgttgatgtcttcttcatccctcccgaaaagtgcgacaccctcctttgtgatattggggagtcctctcctaatccgacagtggaggccggacggacgctgagagtgctgaacctcgtcgaaaattggctgaacaataacacccagttttgcatcaaagttcttaatccctacatgcctagcgtgatcgagaagatggaagctctgcaacgcaaatatggcggggccctcgtgcggaaccccctgtccagaaatagcacacatgagatgtactgggtctccaacgcttctggaaatattgtgagctccgttaacatgatctctcgcatgctgattaaccggttcaccatgagacacaagaaggccacatatgaacctgacgtggacctcggcagcgggacccgcaatatcggaattgagtccgagatccccaaccttgatattatcggcaaacggatcgaaaagattaaacaggagcatgaaacgtcttggcactacgaccaggatcacccgtataagacctgggcgtaccatggcagctatgagacaaaacagaccgggtccgccagctctatggtcaatggagtggttagactgctgacaaagccttgggacgtgctccccaccgtcacacaaatggctatgaccgatacgacaccttttggccagcagcgcgtgttcaaggaaaaagtggacacccggacccaggagcccaaggaggggaccaaaaagctgatgaaaatcacggccgaatggctttggaaggagctgggcaaaaagaagacccctagaatgtgtacacgcgaagagtttaccagaaaagtccggtccaacgctgccctcggcgctattttcacagatgagaataagtggaaaagcgcccgcgaagcggttgaggactctagattttgggaactggtggataaggagcggaacctgcacctcgaagggaaatgcgagacctgtgtgtacaatatgatgggaaagagagagaagaaactgggcgagttcggcaaggccaaagggtcccgggctatctggtacatgtggcttggagcccgctttctggagttcgaagctctcggctttctgaacgaggaccattggttcagcagagaaaattctctttccggggtcgagggagagggcctgcacaagctcgggtatattctgcgggatgtgagcaaaaaggaaggcggagccatgtacgccgacgacacagcgggctgggatacccgcatcacgctggaggacctcaagaacgaagagatggttaccaatcacatggaaggggagcataaaaagctggctgaggccatctttaaacttacatatcaaaacaaggtggtcagagtgcagcggcccaccccgcgcggaacagttatggatattatctccagacgggaccagcgcggcagcgggcaagtgggaacctacggcctgaatacgttcacaaacatggaagcccagctcattagacagatggagggggaaggcgtcttcaaaaatatccagcacctgaccgtgacagaggaggttgctgtgcaaaactggcttgcccgggtcggacgcgaaagactgtctcggatggctattagcggcgatgactgcgtggtcaagcctctcgatgaccgctttgccaacgcgctgaccgccctgaatgatatggggaagatcagaaaagacatccagcagtgggagccctccaagggatggaacgattggacacaggtgcccttctgctctcatcactttcatgaactcattatgaaagacggccgggttctggtggtcccttgtagaaatcaagatgagcttatcgggcgcgctcggattagccagggagccggctggtccctgagagaaaccgcttgcctcgggaagtcttatgcccagatgtggagcctgatgtacttccaccgccgggaccttagactggcggccaacgctatctgttccgccgtgccgtctcactgggtgcccacaagccgcaccacatggtccattcatgctaaacacgagtggatgaccacagaggacatgctcaccgtttggaatcgggtgtggatcagagaaaacccttggatggaggataagacgcccgtcgaaagctgggaggaaattccttatctgggcaagcgcgaggaccagtggtgcggatctctgatcggcctcacatcccgggccacctgggctaaaaatatccaagccgcgattaaccaggtgagaagcctgatcgggaatgaggaatacaccgattacatgccctctatgaagcgctttcggagagaggaagaggaagccggagttctttggtga

SEQ ID NO: 20072 - RNA, 9876 nt, synthetic construct
  misc_feature 1..9876: note = derived and/or modified CDS sequence (opt5) from DENV-2__FJ461309__SS-prME
  source 1..9876: mol_type = other RNA
agcgccggaatgatcattatgctgatccccacagtgatggctttccacctgacaacgagaaatggggagcctcatatgattgtcggaatccaggaaaagggaaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgaaaacaagagtgggcaccaagcatgcgatcctcctggttgccgtgtctttcgtcacacttattaccgggaacatgagctttaaagacctgggacgggtggttgtgatggtcggcgctacgatggccgatgacatcggcatgggggtgacctatctcgccctgctggctgccttcaaggttagacctacatttgcggctggacttctgctccgcaagctgacctccaaagagctcatgatgacaaccattggcatcgtgctgctttctcagagcacgattcccgaaacagtcctggagctcaccgatgccctggccctggggatgatggtgcttaagatcgtgcggaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccaacagaaaacagactggatccctctcgccctgacgattaagggactgaaccccaccgctatcttccttacaaccctgtctagaacaaataaaaagcgctcctggccgctcaacgaggccatcatggctgtgggcatggtcagcattctggcctcttccctcctgaagaatgacatccctatgaccgggccccttgtggcgggaggcctgctgacggtttgctatgtgctcacaggcagaagcgccgatctggaacttgagcgggctaccgacgtcaaatgggaggatcaggccgaaatttctgggtccagccctatcctgtccattaccatcagcgaggacggatctatgagcattaagaacgaagaggaggaacagacactcaccatcctgatccgcacaggcctcctggtgatttccgggctttttcccatctctattccgatcacggctgccgcctggtacctgtgggaggtcaaaaagcaaagagctggagtgctgtgggatgttccttctccccctcccatgggcaaagcggaactcgaggacggggcctatcggattaagcagaagggaatcctgggctactcccagatcggcgctggggtgtacaaagaaggaaccttccacacaatgtggcatgtcacccgcggcgccgtgcttatgcacaaggggaaaagaattgagccctcctgggccgatgttaagaaagacctgatcagctatggaggcgggtggaagctcgagggagaatggaaggagggcgaagaggtgcaggtcctggctctcgaacctggcaaaaatccgcgggccgtgcaaacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccgcagcggcgcttatgtctctgccatcgcccagacagagaagtccatcgaggataatcctgaaattgaggacgatatctttagaaaacggcgcctgaccattatggacctccaccccggggctggaaagacaaaaagatacctgcctgccatcgtgcgggaagcgattaagagaggccttcgcacgctgatcctcgctccgacccgggttgtggccgccgagatggaagaggctctgagagggctccccattcgctatcagacccctgccatccgggctgagcataccggaagagaaatcgtcgacctgatgtgtcacgccaccttcacaatgcgccttctgagccccgtgcgggttcctaactacaatctgattatcatggatgaggcgcatttcacggaccccgcctctattgctgccagaggctatatctccacccgcgtggaaatgggggaggctgccggcatttttatgacagccaccccgcctggaagccgggatcccttcccccaatccaacgctcctatcatcgacgaggaaagagagattcccgaacggtcttggaatagcggccacgagtgggtcacagattttaaagggaagaccgtgtggttcgttccttccatcaaggcgggaaacgacattgccgcttgcctccgcaaaaatggcaagaaagtgatccagctgagcagaaagacgtttgattctgaatacgtcaaaacacggaccaacgactgggatttcgtggtgaccacagacatttccgagatgggggccaattttaaggccgagcgcgtcatcgatccgagacggtgtatgaaacccgttatccttaccgacggagaagagagagtgattctggctggccctatgcccgtgacacatagctctgccgcgcagcgccgggggagaatcggccgcaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaacgggagaaggtcgacgccattgatggggaatacagactccgcggagaggctcggaaaacgtttgtggaccttatgagacgcggcgatctgcctgtttggctggcctataaggtggcggccgaggggatcaactacgctgacagacggtggtgtttcgatggaatcaaaaacaatcaaattctcgaagagaacgtcgaagtggagatctggacaaaggagggcgaacgcaagaaactgaagcccagatggcttgacgcccggatttattccgatcctctggctctcaaagagtttaaggagttcgccgctgggcgcaaatctctgaccctgaatctcatcacagagatgggcagacttcccaccttcatgacgcagaagacccgggacgccctggataacctggcggttctccacacagccgaagctggaggcagagcctacaatcatgctctgagcgagcttccggagaccctggaaacactcctgctgctcacccttctggccacagtgaccgggggaatttttctgttcctcatgtccggccgcgggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacaacggacccctcaggacaaccagcttacctacgtggtcatcgctattctgacagtggttgccgccaccatggctaatgaaatgggctttctggagaagaccaagaaggacctcgggctgggatccatcgccacgcagcaaccggagagcaacattcttgatatcgacctgagacccgcgtctgcctggaccctctacgctgtggccacaaccttcgtgacacctatgctgcgccattccattgaaaatagctccgtcaacgtttctctgaccgctatcgccaatcaggcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaggccacccgggaggcgcagaagcgggccgctgccggcattatgaagaatccgacagttgacgggatcaccgtgatcgatctcgaccccattccttatgatcccaaatttgaaaagcagcttggacaggtcatgctgctgatcctctgcgtgacgcaagtcctgatgatgcggacaacctgggctctttgtgaggccctgacactcgccaccggccctatttctaccctgtgggaagggaaccccggacgcttctggaatacaacgatcgcggtgagcatggctaacatttttagaggctcctacctggccggggctggactccttttcagcatcatgaaaaataccacaaacacccggcgcggcacaggcaacatgggggagaccctgggagagaagtggaaatctagactgaatgccctcggcaagtccgaatttcagatctataagaaaagcgggattcaggaggttgaccggacgctggccaaggaaggaatcaaacgcggcgagacagatcaccatgctgtgtctagagggtccgccaaacttcggtggttcgtcgagcgcaacatggtgaccccggaaggaaaagttgtggacctgggctgcggcagagggggatggagctactattgtggcgggctcaagaatgtccgggaggtgaagggactgaccaaaggcgggcctggacacgaggaacccattcccatgtctacatacggctggaacctggtgagactccagagcggcgttgatgtctttttcatccctcccgaaaagtgcgacacccttctgtgtgatattggggagtcctctcctaatccgacagtggaggcgggacgcacgctgcgggtgctcaacctggtcgaaaattggcttaacaataacacccaattctgcatcaaagttctgaatccctacatgcctagcgtgatcgagaagatggaagccctccagagaaaatatggcggggctctggtgcgcaaccccctgtcccggaatagcacacatgagatgtactgggtctccaacgcctctggaaatattgtgagctccgttaacatgatctctagaatgctcattaaccgctttaccatgcggcacaagaaggctacatatgaacctgacgtggaccttggcagcgggaccagaaatatcggaattgagtccgagatccccaacctggatattatcggcaaacgcatcgaaaagattaaacaggagcatgaaacgtcttggcactacgaccaggatcacccgtataagacctgggcctaccatggcagctatgagacaaaacaaaccgggtccgcgagctctatggtcaatggagtggttcggctgctcacaaagccttgggacgtgctgcccaccgtcacacagatggccatgaccgatacgacacctttcggccagcagagagtgtttaaggaaaaagtggacacccgcacccaagagcccaaggaggggaccaagaaacttatgaaaatcacggctgaatggctgtggaaggagctcggcaaaaagaagacccctcggatgtgtacaagagaagagttcacccgcaaagtcagatccaacgccgctctgggcgccatttttacagatgagaataagtggaaaagcgctcgggaagccgttgaggacgggcgcttctgggaactggtggataaggagagaaacctccacctggaaggaaaatgcgagacctgtgtgtacaatatgatgggcaagcgggagaagaaacttggcgaatttgggaaggcgaaaggatctagagccatctggtacatgtggctgggcgctcggttcctcgagtttgaagccctggggttccttaacgaggaccattggttttcccgcgaaaatagcctgtctggagtcgagggcgaggggctccacaagctgggctatattctgagagatgtgtccaaaaaggaaggaggcgctatgtacgccgacgacacagccgggtgggatacccggatcacgctcgaggacctgaagaacgaagagatggttaccaatcacatggaaggagagcataagaaacttgcggaggctatcttcaaactgacatatcagaacaaagtggtccgcgtgcagagacccaccccgcggggcacagttatggatattatcagccgcagagaccaacgggggtccggacaggtgggcacctacgggctcaatacgtttacaaacatggaagcccagctgattcgccagatggagggcgaaggagtcttcaaaaatatccaacaccttaccgtgacagaggaggttgccgtgcagaactggctggctagagtcggccgggaacgcctcagcagaatggccatttctggggatgactgcgtggtcaagcctctggatgaccggttcgctaacgccctgaccgcgctcaatgatatgggaaagatccgcaaagacatccagcagtgggagcccagcaagggctggaacgattggacgcaagtgcccttttgctcccatcacttccatgaactgattatgaaagacgggagagttcttgtggtcccttgtcggaatcaggatgagctgatcggcagagcccgcatttctcagggcgctgggtggagcctccgggaaaccgcctgcctgggcaagtcctatgctcagatgtggtctcttatgtactttcacagacgcgacctgcggctcgccgcgaacgccatctgtagcgctgtgccgtcccactgggtgcccacatctagaaccacatggagcattcatgccaaacacgagtggatgaccacagaggacatgctgaccgtttggaatcgcgtgtggatccgggaaaacccttggatggaggataagacgcccgtcgaatcctgggaggaaattccttatctgggaaagagagaggaccaatggtgcggcagcctcatcgggctgacatctcgcgctacctgggccaaaaatatccaggctgccattaaccaggtgcggtcccttatcggaaatgaggaatacaccgattacatgcccagcatgaagagattccgccgggaggaagaggaagcgggcgttctgtggtga

SEQ ID NO: 20073 - RNA, 9876 nt, synthetic construct
  misc_feature 1..9876: note = derived and/or modified CDS sequence (opt5) from DENV-2__FJ461311__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcaacttttgtgatggaacgacagtgatcgtcaccgaagactgcggcaatagagggcccagcctgcgcaccacaaccgcctctggaaagctcattacggagtggtgctgtcggtcctgcacactgcctccgcttagatatcggggcgaggatggctgttggtacgggatggaaatccgccccctgaaagagaaggaagagaacctcgttaatagcctggtgaccgccggacacggccaagtggacaacttctccctgggggtccttggaatggctctctttctggaagagatgctgagaacacgggtgggcaccaaacatgcgatcctcctggttgccgtgtctttcgtcacacttattaccgggaatatgagctttaaggatctgggaagagtggttgtgatggtcggcgctacgatgaccgacgatatcggcatgggggtgacatatctcgccctgctggccgctttcaaagttcgccctacctttgccgcgggacttctgctccggaagctgacatccaaggagctcatgatgaccacgattggcatcgtgctgctttctcagagcacaattcccgaaaccgtcctggagctcacagacgctctggccctggggatgatggtgcttaaaatcgtgagaaacatggaaaagtaccagctggccgtcaccatcatggctattctctgcgttcctaatgccgtgatcctgcagaacgcgtggaaagtgtcctgtaccattctcgctgtcgtgtctgttagccccctgcttctgacatccagccaacagaagacggattggatccctctcgccctgaccattaaaggactgaatcccacagccatcttccttaccacactgtctcgcaccaacaagaaaagatcctggccgctcaatgaggctatcatggccgtgggcatggtcagcattctggcttcttccctcctgaagaacgacatccctatgacggggccccttgtggccggaggcctgctgacagtttgctatgtgctcaccggccggagcgcggacctggaacttgagcgcgccaccgatgtcaagtgggaggaccaggctgaaatttctgggtccagccctatcctgtccattacaatcagcgaggatggatctatgagcattaaaaatgaagaggaggaacagaccctcacaatcctgatcagaacgggcctcctggtgatttccgggctttttcccatctctattccgatcaccgccgctgcctggtacctgtgggaggtcaagaaacaacgggccggagtgctgtgggacgttccttctccccctcccatgggcaaggctgaactcgaggatggggcgtatcgcattaaacagaagggaatcctgggctactcccagatcggcgccggggtgtacaaggaaggaacattccacaccatgtggcatgtcacaagaggcgctgtgcttatgcacaaagggaagcggattgagccctcctgggccgacgttaaaaaggatctgatcagctatggaggcgggtggaaactcgagggagaatggaaggagggcgaagaggtgcaggtcctggccctcgaacctggcaagaacccgcgcgctgtgcaaaccaaacccgggctgtttaagacgaacaccggaacaattggcgccgtgtcccttgacttctctcctgggaccagcggatcccccatcattgataaaaagggcaaagttgtcgggctgtacggaaatggcgtggtgacaagaagcggcgcgtatgtctctgctatcgcccagaccgagaagtccatcgaggacaaccctgaaattgaggatgacatctttcggaagcgcagactgacaattatggatctccaccccggggccggaaaaacgaagcggtacctgcctgctatcgtgagagaagccattaaacgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaattacaacctgattatcatggacgaggcccatttcaccgatcccgcgtctattgccgctcgcggctatatctccacacgggtggaaatgggggaggccgctggcatttttatgaccgccacaccgcctggaagcagagaccccttcccccaatccaatgcccctatcatcgatgaggaacgggagattcccgaacgctcttggaacagcggccacgagtgggtcaccgactttaaggggaaaacggtgtggttcgttccttccatcaaggctggaaatgatattgcggcctgcctcagaaagaacggcaaaaaggtgatccagctgagccggaaaacatttgactctgaatacgtcaagacccgcaccaatgattgggacttcgtggtgacaaccgatatttccgagatgggggctaactttaaagccgagagagtcatcgacccgcggagatgtatgaagcccgttatccttacagatggagaggaacgcgtgattctggccggccctatgcccgtgacccatagctctgctgcccagcggagagggcgcatcggccggaatcctaaaaacgaaaatgaccagtacatttatatgggagagcccctcgaaaacgacgaggattgcgcgcactggaaggaggctaagatgctgctggacaatatcaacacgccggaaggcattatccctagcatgttcgagcccgaaagagagaaagtcgatgccattgacggggaataccgcctccggggagaggccagaaagacatttgtggatcttatgcgcagaggcgacctgcctgtttggctggcttataaagtggccgcggaggggatcaactacgccgatcggcgctggtgtttcgacggaatcaagaataaccaaattctcgaagagaatatggaagtcgagatctggaccaaagagggcgaaagaaagaagctgaaaccccggtggcttgatgctcgcatttattccgaccctctggccctcaaggagtttaaagagttcgctgccgggagaaagtctctgacactgaacctcatcaccgagatgggccggcttcccacgttcatgacccagaaaacaagagatgctctggacaatctggccgtgctccacaccgcggaagccggaggccgcgcttacaaccatgccctgagcgagcttccggagacactggaaaccctcctgctgctcacacttctggctaccgttacagggggaatttttctgttcctcatgtccggccgggggatcggaaagatgacactgggcatgtgctgcatcattaccgcctctatccttctgtggtatgcccagattcagcctcactggatcgctgcgagcattatcctcgagtttttcctgatcgtgctgctcattcccgaacccgagaagcaaagaacccctcaggataatcagcttacatacgtcgtgatcgccattctgaccgtcgtggctgccacaatggccaacgaaatgggctttctggagaaaacgaagaaagacctcgggctgggatccatcgctacccgccagccggagagcaatattcttgacatcgatctgcggcccgcctctgcgtggacactctacgccgttgctaccacattcgtgacccctatgctgagacattccattgaaaacagctccgtgaatgtctctctgacggccatcgctaaccaagccaccgttctcatgggccttgggaagggatggcccctgagcaaaatggacatcggcgtgcctctgctcgcgattgggtgttattcccaggtgaatcccatcacactgaccgccgcccttctgctcctggtcgcccactacgctattatcggacctggcctgcaggccaaggctacacgggaggcccagaagcgcgcggccgctggcattatgaaaaacccgaccgtggatgggatcacggttatcgacctcgatcccattccttatgaccccaagtttgaaaaacaacttggacaggtgatgctgctggtcctctgcgtgacacaggtcctgatgatgagaaccacatgggccctttgtgaggctctgaccctcgccaccggccctatctctacactgtgggaagggaatcccggacggttctggaacacgaccattgccgtgagcatggcgaatatctttcgcggctcctacctggctggggccggactccttttcagcattatgaagaacacaaccaacacaagacggggcaccggcaatatgggggagacgctgggagagaaatggaagtctcaactgaacgctctcggcaaatccgaatttcagatctataaaaagagcgggatccaggaggttgatcgcacactggccaaagaaggaattaagagaggcgagaccgaccaccatgccgtgtctcgggggtccgctaaacttcgctggttcgtcgagagaaatatggtgaccccggaaggaaaggttgtggatctgggctgcggcagagggggatggagctactattgtggcgggctcaaaaacgtccgggaggtgaagggactgacaaagggcgggcctggacacgaagaacccatccccatgtctacctacggctggaatctggtgcgcctccagagcggcgttgacgtctttttcattcctcccgaaaaatgcgatacacttctgtgtgacatcggggagtcctctcctaacccgacggtggaggccggacggaccctgagagtgctcaatctggtcgaaaactggcttaataacaatacacaattctgcattaaggttctgaacccctacatgcctagcgtgatcgagaaaatggaagcgctccagcgcaagtatggcggggccctggtgcggaatcccctgtccagaaacagcacccatgagatgtactgggtctccaatgcttctggaaacatcgtgagctccgttaacatgatttctcgcatgctcatcaatcggtttacaatgagacacaaaaaggccacctatgaacctgatgtggaccttggcagcgggacgcgcaacattggaatcgagtccgagattcccaatctggacatcattggcaagcggatcgagaagatcaagcaggagcatgaaacctcttggcactacgatcaggaccacccgtataaaacatgggcttaccatggcagctatgagaccaagcaaacagggtccgccagctctatggtcaacggagtggttagactgctcaccaaaccttgggatgtgctgcccacagtcacccagatggcgatgacggacacaacccctttcggccagcagcgcgtgtttaaggaaaaggtggatacccggacacaagagcccaaagaggggacgaagaaacttatgaagattaccgccgaatggctgtggaaagagctcggaaagaaaaagacacctagaatgtgtacccgcgaagagttcacaagaaaggtccggtccaatgctgccctgggcgctatctttaccgacgagaacaaatggaaaagcgcccgcgaagctgttgaggattctagattctgggaactggtggacaaagagcggaatctccacctggaagggaagtgcgagacatgtgtgtacaacatgatgggaaaaagagagaagaaacttggcgaatttggcaaagccaaggggtcccgggcgatttggtacatgtggctgggagcccgcttcctcgagtttgaagctctgggcttccttaatgaggatcattggtttagcagagaaaactctctgtccggggtcgagggagagggcctccacaaactggggtatatcctgcgggacgtgagcaagaaagaaggcggagccatgtacgctgatgacaccgccggctgggacacgcgcattaccctcgaggatctgaagaatgaagagatggttacaaaccacatggaaggggagcataagaaacttgccgaggcgatcttcaagctgacctatcagaataaagtggtcagagtgcagcggcccacaccgcgcggaaccgttatggacatcatttccagacgggatcaacgcggcagcgggcaggtcggaacgtacggcctcaacacatttaccaatatggaagctcagctgatcagacagatggagggggaaggcgtcttcaagaacattcaacaccttacagtgaccgaggaggttgccgtgaaaaactggctggcccgggtcggacgcgaaagactctctcggatggctatcagcggcgacgattgcgtggtcaagcctctggacgatcgcttcgccaatgctctgacggccctcaacgacatggggaagattagaaaagatatccagcagtgggagccctccaagggatggaatgactggacccaggtgcccttttgctctcatcacttccatgaactgatcatgaaagatggccgggttcttgtggtcccttgtagaaaccaagacgagctgattgggcgcgcgcggatcagccagggagccggctggtccctcagagaaacagcttgcctggggaagtcttatgcccagatgtggagccttatgtactttcaccgccgggatctgagactcgctgccaatgcgatttgttccgccgtgccgtctcactgggtgcccaccagccgcacaacctggtccatccatgctaaacacgagtggatgacaaccgaggacatgctgacggtttggaaccgggtgtggattagagaaaatccttggatggaggacaagacacccgtcgaaagctgggaggaaatcccttatctgggcaagcgcgaggatcagtggtgcggatctctcattggcctgacctcccgggccacctgggctaaaaacatccaagccgctatcaatcaggtgagaagccttattgggaacgaggaatacacagactacatgccctctatgaagcgcttccggagagaggaagaggaagccggagttctgtggtga

SEQ ID NO: 20074 - RNA, 9876 nt, synthetic construct
  misc_feature 1..9876: note = derived and/or modified CDS sequence (opt5) from DENV-2__FJ410217__SS-prME
  source 1..9876: mol_type = other RNA
agcgccggcatgatcattatgctgatccccaccgtcatggctttccacctcacaacgagaaatggggaacctcatatgattgtcggaatccaggaaaagggcaagagcctgctttttaagaccgaagacggggttaatatgtgcacactgatggccatggatctcggagaactgtgtgaagacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtattgtgtcctggaagaataaggagctcaaatgcggaagcggcatcttcgtcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagccataaccagacgttcctgatcgacggccctgagaccgcggagtgccccaatacaaacagagcctggaactctctcgaagtcgaggattatgggtttggagtgttcaccacaaacatttggctgcgccttaaggaaaaacaggacgctttttgtgactccaagctgatgagcgccgctatcaaggataatcgggccgttcacgcggacatgggctactggatcgagtctgccctcaacgatacctggaaaattgagaaggcttccttcatcgaagtgaaaaattgccattggcctaagagccacacactgtggtctaacggcgtcctggagagcgaaatgattatccccaaaaaccttgccgggccggtgtcccaacacaattatagacctggataccatacccagattgctggcccctggcacctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtaccgcggcgaggacggctgttggtatgggatggaaatcagacccctgaaagagaaggaagagaatctcgttaacagcctggtgaccgccggacatggccaggtggataatttctccctgggggtccttggaatggctctctttctggaagagatgctgcggacaagagtgggcaccaaacacgcgatcctcctggttgccgtgtctttcgtcacacttattaccgggaacatgagctttaaggacctgggacgcgtggttgtgatggtcggcgctacgatggccgatgacatcggcatgggggtgacctacctcgccctgctggctgccttcaaagttcggcctacatttgcggctggacttctgctcagaaagctgacctccaaggagctcatgatgacaaccattggcatcgtgctgctttctcaaagcacgattcccgaaacagtcctggagctcaccgatgccctggccctggggatgatggtgcttaaaatcgtgcgcaatatggaaaagtatcagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctagaacaaataagaaacggtcctggccgctcaacgaggccatcatggctgtgggcatggtcagcattctggcctcttccctcctgaagaatgacatccctatgaccgggccccttgtggcgggaggcctgctgacggtttgctacgtgctcacaggccgcagcgccgatctggaacttgagagagctaccgacgtcaagtgggaggatcaggccgaaatttctgggtccagccctatcctgtccattaccatcagcgaggacggatctatgagcattaaaaacgaagaggaggaacagacactcaccatcctgatccggacaggcctcctggtgatttccgggctttttcccatctctattccgatcacggctgccgcctggtatctgtgggaggtcaagaaacagcgcgctggagtgctgtgggatgttccttctccccctcccatgggcaaggcggaactcgaggacggggcctacagaattaaacaaaagggaatcttcggctattcccagatcggcgctggggtgtacaaggaaggaacctttcatacaatgtggcacgtcacccggggcgccgtgctgatgcacaaagggaagcgcattgagccctcctgggccgatgttaaaaaggaccttatcagctacggaggcgggtggaaactggagggagaatggaaggagggcgaagaggtgcaggtcctcgctctggaacctggcaagaatccgagagccgtgcagacaaaacccgggctgttcaagaccaacacgggaaccattggcgcggtgtccctggatttttctcctgggacaagcggatcccccatcattgacaaaaagggcaaagttgtcgggctttatggaaacggcgtggtgacccggagcggcgcttacgtctctgccatcgcccaaacagagaagtccatcgaggataatcctgaaattgaggacgatatcttccgcaagagacggctgaccattatggacctgcatcccggggctggaaaaacaaagagatatctccctgccatcgtgcgcgaagcgattaaacggggcctgagaacgcttatcctggctccgacccgcgttgtggccgccgagatggaagaggctctccgggggctgcccattagataccagacccctgccatccgcgctgagcacaccggacgggaaatcgtcgacctcatgtgtcatgccaccttcacaatgagactgcttagccccgtgcgcgttcctaactataatctgattatcatggatgaggcgcactttacggaccccgcctctattgctgcccggggctacatctccaccagagtggaaatgggggaggctgccggcattttcatgacagccaccccgcctggaagccgggatccctttccccagtccaacgctcctatcatcgacgaggaacgcgagattcccgaaagatcttggaatagcggccatgagtgggtcacagatttcaaggggaaaaccgtgtggtttgttccttccatcaaggcgggaaacgacattgccgcttgcctgcggaagaatggcaaaaaggtgatccaactcagccgcaaaacgttcgattctgaatatgtcaagacaagaaccaacgactgggattttgtggtgaccacagacatttccgagatgggggccaatttcaaagccgagcgggtcatcgatccgagacgctgtatgaagcccgttatcctggctgacggagaggaacgggtgattcttgccggccctatgcccgtgacccacagctctgcggctcagagacgcgggcggatcggcagaaaccctaaaaatgaaaacgaccagtacatttacatgggagagcccctggaaaatgatgaggactgcgcccactggaaggaggccaagatgctcctggataacatcaatacaccggaaggcattatccctagcatgtttgagcccgaacgcgagaaagtcgacgctattgatggggaatatcggctgagaggagaggcccgcaagaccttcgtggacctcatgagacggggcgatcttcctgtttggctggcgtacaaagtggccgctgaggggatcaactatgccgaccgcagatggtgttttgatggaatcaagaacaatcagattctggaagagaacgtcgaagtggagatctggacgaaagagggcgaacggaagaagctcaaaccccgctggctggacgctagaatttactccgatcctcttgccctgaaggagttcaaagagttcgctgccgggcggaagtctctcacactgaatctgatcaccgagatgggcagactccccacatttatgacccagaagacgcgcgacgcgcttgataacctggccgttctgcataccgctgaagccggaggccgggcttataatcacgccctcagcgagctgccggagacacttgaaaccctgctcctgctgacactccttgccaccgtgacagggggaattttcctgtttctgatgtccggcagagggatcggaaagatgaccctcggcatgtgctgcatcattacggcttctatcctgctttggtacgcgcagattcagcctcattggatcgccgctagcattatcctggagttctttctcatcgtcctgctgattcccgaacccgagaagcagcgcacacctcaagacaaccagctcacctatgtggtcatcgccattcttaccgtggttgccgctacaatggccaatgaaatgggcttcctggagaaaaccaagaaagacctggggctcggatccatcgcgacacagcagccggagagcaacattctggatatcgaccttcggcccgcctctgcttggacgctgtacgccgtggctaccacatttgtgacccctatgctcagacactccattgaaaatagctccgtcaacgtttctctgacagccatcgcgaatcaagccaccgtgctgatgggcctcgggaagggatggccccttagcaaaatggatatcggcgtgcctctgctggctattgggtgttactcccaggtcaaccccatcacgctcaccgccgctctgcttctgctcgtggcccactatgctattatcggacctggcctgcaggccaaggcgacacgggaggcccagaagcgcgctgccgctggcattatgaaaaatccgaccgttgacgggatcacagtgatcgatctggaccccattccttacgatcccaagttcgaaaaacaactcggacaggtcatgcttctgatcctgtgcgtgacccaggtcctcatgatgagaacgacatgggccctgtgtgaggcccttaccctggcgacaggccctatttctaccctctgggaagggaaccccggacggttttggaataccacaatcgctgtgagcatggccaacattttccgcggctcctatctggctggggccggactgctctttagcatcatgaagaatacgaccaacgccagacggggcacaggcaacatgggggagacccttggagagaaatggaagtctcgcctgaatgctctgggcaaatccgagttccaaatctacaaaaagagcgggattcaggaggttgacagaacactcgccaaagaaggaatcaagcggggcgagaccgatcatcacgcggtgtctcgcgggtccgccaaactgagatggtttgtcgagcggaacatggtgacgccggaaggaaaggttgtggaccttggctgcggcagagggggatggagctattactgtggcgggctgaaaaatgtccgcgaggtgaagggactcacaaagggcgggcctggacatgaagaacccattcccatgtctacctatggctggaacctggtgcggctgcagagcggcgttgatgtcttcttcatccctcccgaaaaatgcgacaccctcctttgtgatattggggagtcctctcctaatccgacagtggaggctggaagaaccctgcgcgtgctgaacctcgtcgaaaattggctgaacaataacacacagttttgcatcaaggttcttaatccctacatgcctagcgtgatcgagaaaatggaagccctgcaacggaagtacggcggggctctcgtgagaaaccccctgtcccgcaatagcacgcacgagatgtattgggtctccaacgcctctggaaatattgtgagctccgttaacatgatctctcggatgctgattaacagattcaccatgcgccataaaaaggcgacatacgaacctgacgtggacctcggcagcgggacccggaatatcggaattgagtccgagatccccaaccttgatattatcggcaagagaatcgagaagattaagcaggagcacgaaacatcttggcactatgaccaggatcatccgtacaaaacctgggcctatcacggcagctacgagacgaagcagaccgggtccgctagctctatggtcaatggagtggttcgcctgctgacaaaaccttgggacgtgctccccaccgtcacacaaatggccatgaccgatacaaccccttttggccagcagcgggtgttcaaggaaaaggtggacacgagaacacaggagcccaaagaggggaccaagaaactgatgaagatcaccgctgaatggctttggaaagagctgggaaagaaaaagacacctcgcatgtgtacgagagaagagtttacccggaaggtccgctccaacgccgctctcggcgccattttcacagatgagaataaatggaaaagcgcgagagaagccgttgaggactctcggttttgggaactggtggataaagagagaaacctgcatctcgaagggaagtgcgagacctgtgtgtataatatgatgggaaaacgggagaagaagctgggcgagttcggcaaagctaaggggtcccgcgccatctggtacatgtggcttggagctagatttctggagttcgaagccctcggctttctgaacgaggaccactggttcagccgggaaaattctctttccggggtcgagggagagggcctgcacaaactcgggtacattctgcgcgatgtgagcaagaaagaaggcggagccatgtatgcggacgacacagctggctgggataccagaatcacactggaggacctcaagaacgaagagatggttaccaatcatatggaaggggagcacaagaaactggccgaggccatctttaaacttacgtaccaaaacaaagtggtccgggtgcagcgccccaccccgagaggaacagttatggatattatctcccggcgcgaccagagaggcagcgggcaagtgggaacctatggcctgaatacattcaccaacatggaagctcagctcattcggcagatggagggggaaggcgtcttcaagaatatccagcatctgacggtgacagaggaggttgccgtgcaaaactggcttgctcgcgtcggaagagaacggctgtctcgcatggccattagcggcgatgactgcgtggtcaaacctctcgatgacagatttgcgaacgccctgaccgctctgaatgatatggggaagatccggaaggacatccagcagtgggagccctccaaaggatggaacgattggacacaggtgcccttctgctctcaccattttcacgaactcattatgaaggacggcagagttctggtggtcccttgtcgcaatcaagatgagcttatcgggcgggccagaattagccagggagctggctggtccctgcgcgaaaccgcctgcctcgggaaatcttacgcgcagatgtggagcctgatgtatttccaccggagagaccttcgcctggccgctaacgccatctgttccgctgtgccgtctcattgggtgcccacgagccggaccacatggtccattcacgccaagcatgagtggatgaccacagaggacatgctcaccgtttggaatagagtgtggatccgcgaaaacccttggatggaggataaaacacccgtcgaaagctgggaggaaattccttacctgggcaagcgggaggaccagtggtgcggatctctgatcggcctcacctccagagctacgtgggccaagaatatccaagcggccattaaccaggtgcgcagcctgatcgggaatgaggaatatacagattacatgccctctatgaaacggtttagacgggaggaagaggaagctggagttctttggtga

SEQ ID NO: 20075 - RNA, 9876 nt, synthetic construct
  misc_feature 1..9876: note = derived and/or modified CDS sequence (opt5) from DENV-2__FJ410219__SS-prME
  source 1..9876: mol_type = other RNA
agcgccggcatgatcattatgctgatccccaccgtgatggctttccacctcacaacgagaaacggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagagcaggacaagcggtttgtgtgcaagcatagcatggtggatcgcggctggggcaatgggtgtggactgttcggcaaagggggaattgtcacctgcgctatgtttacatgcaagaaaaacatggaaggcaagatcgttcagcctgagaatctcgaatacacgattgtggtgaccccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccttatgtcctctggcaatctgctctttaccggacatctgaagtgccgccttagaatggacaaactgcaactcaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctggaaaagagatacgtgctgggacgcctcattacagtcaaccctatcgtgacggagaaagattctccggttaacattgaagcggagcccccttttggcgactcctacatcattatcggggtggagcccggccagctgaagcttaattggttcaagaaaggaagctctattggccaaatgtttgaaaccacaatgcggggggccaagagaatggctatcctgggagataccgcctgggacttcggcagcctcgggggagtctttacatccatcggcaaagccctgcatcaggtgttcggggctatttatggcgccgcgttttctggagtgagctggaccatgaagatcctgattggcgttatcattacgtggatcgggatgaactcccgcagcacatctctttccgtcagcctcgtgctggtgggaatcgtcaccctgtacctcggcgtgatggttcaggctgattctgggtgtgtggtctcctggaaaaataaggagctgaagtgcggaagcggcattttcatcaccgacaacgtgcacacatggaccgaacagtataaatttcaacctgagtccccctctaagcttgccagcgccattcagaaagctcaggaagaggggatctgtggcattcggtccgttacaagactggagaatctcatgtggaagcagatcacgccggaactgaaccacatcctggccgagaatgaagtgaaacttaccattatgacaggagatatcaagggcattatgcaagctgggaaacgcttcctccggcctcagcccaccgagctgaagtactcttggaagacatggggaaaagccaagatgctgagcaccgaatcctataaccagacgtttctcatcgacggccctgagaccgcggagtgccccaatacaaacagagcctggaatagcctggaagtcgaggattacgggttcggagtgtttaccacaaacatttggcttaaactgaaggaaaaacaggacgctttctgtgactctaagctcatgtccgccgctatcaaggataatcgcgccgttcatgcggacatgggctattggatcgagagcgccctgaacgatacctggaaaattgagaaggcttctttcatcgaagtgaaaaattgccactggcctaagtcccatacactgtggagcaacggcgtccttgagtctgaaatgattatccccaaaaacctcgccgggccggtgagccaacacaattaccggcctggataccacacccagattgctggcccctggcatctggggaagctggagatggactttgatttctgtgacggaacgacagtgatcgtcaccgaagattgcggcaacagagggccctccctccgcaccacaaccgccagcggaaagctgattacggagtggtgctgtcggtcttgcacacttcctccgctgagatatcggggcgaggacggctgttggtacgggatggaaatccgccccctcaaagagaaggaagagaatctggttaactccctggtgaccgccggacacggccaggtggataattttagccttggggtcctcggaatggctctgttcctggaagagatgctcagaacacgggtgggcatgaaacatgcgatcctgcttgttgccgtgtcctttgtcaccctgattacagggaacatgtctttcaaggacctcggaagagtggttgtgatggtcggcgctaccatgacggatgacatcggcatgggggtgacctatctggccctgcttgccgcttttaaagttcgccctacattcgccgcgggactgctcctgcggaagctcaccagcaaggagctgatgatgattacaatcggcattgtgcttctgtcccaatctaccatccccgaaacggtcctcgagctgacagatgctctggcccttgggatgatggtgctgaaaatcgtgagaaatatggaaaagtaccagctcgccgtcaccattatggctatcctgtgcgttcctaacgccgtgattctccagaatgcgtggaaagtgagctgtacaatcctggctgtcgtgtccgtttctccccttctgctcaccagctcccagcaaaagaccgactggattcctctggccctgacaatcaaaggacttaaccccacggccatctttctgaccacactcagccgcaccaataagaaaagatcttggccgctgaacgaggctattatggccgtgggcatggtctccatcctcgctagctctctgcttaagaatgacattcctatgacagggcccctggtggccggaggcctgctcaccgtttgctatgtgctgacgggccggtccgcggatcttgaactggagcgcgtcacagacgtgaagtgggaggatcaggccgaaatcagcgggtcttcccctattctcagcatcaccatttccgaggacggaagcatgtctatcaaaaacgaagaggaggaacagaccctgacaatcctcattagaaccggcctgcttgtcatcagcgggctgttccccatttccatcccgattacagctgccgcttggtacctgtgggaggtgaagaaacagcgggccggagttctctgggatgtgccttctccccctcccatgggcaaggccgaactggaggacggggcttatcgcatcaaacaaaagggaatccttggctacagccagattggcgcgggggtctacaaggaaggaacgtttcacaccatgtggcatgtgacaagaggcgccgttctgatgcacaaagggaagcggatcgagccctcctgggctgatgtgaaaaaggacctcatttcttatggaggcgggtggaaactggagggagaatggaaggagggcgaagaggtccaggtgctcgccctggaacctggcaagaatccgcgcgccgtgcagaccaaacccgggcttttcaagacaaacaccggaacgatcggcgctgttagcctggatttttcccctgggacctctggaagccccattatcgacaaaaagggcaaagtcgtggggctgtacggaaacggcgtggtcacaagatccggcgcctatgtgagcgcgatcgctcaaaccgagaagtctattgaggataatcctgaaatcgaggacgatattttccggaagcgcagactcacaatcatggacctgcaccccggggccggaaaaaccaagcggtaccttcctgccattgttagagaagctatcaaacgcggcctgcggacactcattctggccccgacgagagtggtcgcggctgagatggaagaggccctccgcgggctgcccatccggtatcagacccctgccatcagagctgagcatacaggacgcgaaattgtggaccttatgtgtcacgccaccttcaccatgcggctgctgtcccccgttagagtgcctaactacaatctcatcattatggatgaggctcattttacagaccccgccagcatcgcggcccgcggctatatttctacgcgggtcgaaatgggggaggctgccggcatcttcatgaccgctacaccgcctggatccagagatccctttccccagagcaacgcccctatcattgacgaggaacgggagatccccgaacgctcctggaattctggccacgagtgggtgaccgatttcaaggggaaaacagtttggtttgtgcctagcattaaggccggaaacgacatcgctgcgtgcctgagaaagaatggcaaaaaggtcattcaactttcccggaaaaccttcgatagcgaatacgtgaagacgcgcacaaacgactgggattttgtggtcaccaccgacatctctgagatgggggccaatttcaaagctgagagagttatcgatccgcggagatgtatgaagcccgtgattctgacagacggagaagagcgcgtgatcctcgccggccctatgcccgtcacccattccagcgccgctcagcggagagggcgcattggccggaaccctaaaaatgaaaacgaccagtacatctatatgggagagcccctggaaaatgatgaggactgcgcccactggaaggaggcgaagatgctgctcgataacattaatacaccggaaggcatcattccttctatgtttgagcccgaaagagagaaagtggacgctatcgatggggaataccgccttcggggagaggccagaaagaccttcgttgacctgatgcgcagaggcgatctgcctgtgtggctcgcctataaagtcgctgccgaggggatcaactacgcggaccggcgctggtgttttgatggaattaagaacaatcagatcctggaagagaacgtggaagttgagatttggacgaaagagggcgaaagaaagaagcttaaaccccggtggctggacgcccgcatctatagcgatcctctcgctctgaaggagttcaaagaattcgccgctgggagaaagtccctgacactcaatcttattaccgagatgggccggctgcccacatttatgacccaaaaaacgagagacgccctggataacctcgctgtgctgcacaccgccgaagcgggaggccgcgcctacaatcatgctctttctgagctgccggagacactcgaaaccctgctgctccttacactgctggccaccgtcacagggggaatcttcctctttctgatgagcggccgggggatcggaaagatgacccttggcatgtgctgcattatcacggcttccattctgctctggtatgcccagatccagcctcactggattgccgcttctatcatcctggagttctttctgattgtgctccttatccccgaacccgagaagcagagaacacctcaagacaaccagctgacctacgtcgtgattgcgatcctgaccgttgtggccgctacaatggccaatgaaatgggcttcctcgagaaaaccaagaaagacctggggcttggaagcattgccacacagcagccggagtccaacatcctggatattgacctccgccccgctagcgcctggacgctgtacgcggtggccaccacatttgtcacccctatgctgcggcattctatcgaaaattccagcgttaacgtgtccctcacagctatcgccaatcaagctaccgtgcttatgggcctggggaagggatggcccctgtctaaaatggatattggcgtccctctcctggccatcgggtgttatagccaggtgaaccccattacgcttaccgcggccctgctcctgctggttgctcactacgccatcattggacctggcctccaggctaaggccacaagagaggctcagaagcgggccgcggccggcatcatgaaaaatccgaccgtggacgggatcacagtcattgatcttgaccccatcccttatgatcccaagttcgaaaaacaactgggacaggtgatgctgctcattctgtgcgtcacccaggtgcttatgatgcgcacgacatgggctctgtgtgaggccctcaccctggctacaggccctatctccaccctgtgggaagggaaccccggaagattttggaataccacaattgccgtttctatggccaacatcttccggggcagctacctcgcgggggctggacttctgttttccatcatgaagaatacgaccaacacacgcagaggcaccggcaacatgggggagacactgggagagaaatggaagagccggctcaatgccctgggcaaatctgaattccaaatttataagaagtccgggatccaggaggtggaccgcacccttgctaaagaaggaattaagagaggcgagacggatcaccatgccgtcagccgggggtctgccaaactgcgctggtttgtggagagaaacatggttacaccggaaggaaaggtggtcgacctcggctgcggccgggggggatggtcctactattgtggcgggctgaaaaatgtgagagaggtgaagggactgaccaagggcgggcctggacacgaagagcccatccccatgagcacctacggctggaacctcgttcgccttcagtctggcgtcgatgtgttcttcattcctcccgaaaaatgcgacacactgctgtgtgatatcggggagagctcccctaatccgaccgtggaggctggacggacactcagagtcctgaaccttgttgaaaattggctgaacaataacacgcagttttgcatcaaggtgctcaatccctacatgccttctgtgattgagaaaatggaagccctgcaacgcaagtatggcggggcgctggtccggaaccccctcagcagaaattccacccatgagatgtactgggtgagcaacgcctccggaaatatcgtttctagcgtgaacatgatttcccgcatgcttatcaaccggttcacaatgagacacaaaaaggctacctatgaacctgacgtcgacctgggctctgggacacgcaatattggaatcgagagcgagattcccaacctggatatcatcggcaagcggattgaaaaaatcaagcaggagcatgaaacctcctggcactacgaccaggatcacccgtataaaacgtgggcctaccatggctcttatgagaccaagcagacagggagcgcttccagcatggtgaatggagttgtgagactcctgaccaaaccttgggacgtccttcccacagtgacccaaatggccatgacagataccacgccttttggccagcagcgcgtgttcaaggaaaaggtcgacacacggacccaggagcccaaagaggggaccaagaaactgatgaagattacagcggaatggctctggaaagagctgggaaagaaaaagacgcctagaatgtgtacccgcgaagagtttacaagaaaggttcggtctaacgccgctctgggcgccatcttcaccgatgagaataaatggaagtccgctcgcgaagccgtggaggacagcagattttgggaactcgtggataaagagcggaacctgcaccttgaagggaagtgcgagacatgtgtctacaatatgatgggaaaaagagagaagaagctgggcgaattcggcaaagctaaggggtctcgggccatttggtacatgtggctcggagcgcgctttctggagttcgaagcccttggctttctgaacgaggaccattggttctccagagaaaatagcctctctggggtggagggagagggcctgcacaaactggggtatatcctccgggatgtttccaagaaagaaggcggagctatgtacgccgacgacaccgctggctgggatacacgcatcaccctggaggaccttaagaacgaagagatggtgacgaatcacatggaaggggagcataagaaactggccgaggccatttttaagctcacctatcaaaacaaagtcgtgagagttcagcggcccacaccgcgcggaaccgtgatggatatcattagcagacgggaccagcgcggctccgggcaagtcggaacatacggcctgaataccttcacgaacatggaagcgcagcttatcagacagatggagggggaaggcgtgttcaagaatattcagcacctgacagttaccgaggaggtggctgtcaaaaactggctcgcccgggtgggacgcgaaagactgagccggatggccatctctggcgatgactgcgtcgtgaagcctctggatgaccgctttgctaacgccctcacagctctgaatgatatggggaagatcagaaaagacattcaacagtgggagcccagcaagggatggaacgattggacccaggttcccttctgctcccatcactttcatgaacttatcatgaaagacggccgggtgctggtcgtgccttgtagaaatcaggatgagctcattgggcgcgcccggatctctcaaggagcgggctggagcctgagagaaacggcctgccttgggaagtcctatgctcagatgtggtctctgatgtacttccaccgccgggacctcagactggccgctaacgccatttgtagcgcggtgccgtcccactgggttcccacctctcgcacaacctggagcatccatgccaaacacgagtggatgacaaccgaggacatgctgacagtgtggaatcgggtctggattagagaaaacccttggatggaggataagacccccgtggaatcctgggaggaaatcccttatctcggcaagcgcgaggaccagtggtgcggaagcctgatcggccttacgtctcgggctacatgggccaaaaatattcaggctgccatcaaccaagttagatccctgattgggaatgaggaatacaccgattacatgcccagcatgaagcgctttcggagagaggaagaggaagctggagtgctctggtga

SEQ ID NO: 20076 - RNA, 9876 nt, synthetic construct
  misc_feature 1..9876: note = derived and/or modified CDS sequence (opt5) from DENV-2__FJ461314__SS-prME
  source 1..9876: mol_type = other RNA
agcgccggcatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccctgaagatcctgattggcgttatcattacgtggatcgggatgaactcccgcagcacatctctttccgtcagcctcgtgctggtgggaatcgtcaccctgtacctcggcgtgatggttcaggctgattctgggtgtgtggtctcctggaaaaataaggagctgaagtgcggaagcggcattttcatcaccgacaacgtgcacacatggaccgaacaatataaatttcagcctgagtccccctctaaacttgccagcgccattcagaaagctcaggaagaggggatctgtggcattcggtccgttacaagactggagaatctcatgtggaagcaaatcacgccggaactgaaccacatcctggccgagaatgaagtgaaacttaccattatgacaggagatatcaagggcattatgcaggctgggaaacgctctctccggcctcagcccaccgagctgaagtacagctggaagacatggggaaaagccaagatgctgtccaccgaaagctataaccagacgttcctcatcgacggccctgagaccgcggagtgccccaatacaaacagagcctggaactctctggaagtcgaggattacgggtttggagtgttcaccacaaacatttggcttaaactgaaggaaaaacaagacgctttttgtgactccaagctcatgagcgccgctatcaaggataatcgcgccgttcatgcggacatgggctattggatcgagtctgccctgaacgatacctggaaaattgagaaggcttccttcatcgaagtgaaaaattgccactggcctaagagccatacactgtggtctaacggcgtccttgagagcgaaatgattatccccaaaaacctcgccgggccggtgtcccagcacaattaccggcctggataccacacccagattgctggcccctggcatctggggaagctggagatggacttcgatttttgtgacggaacgacagtgatcgtcaccgaagattgcggcaacagagggcccagcctccgcaccacaaccgcctctggaaagctgattacggagtggtgctgtcggtcctgcacacttcctccgctgagatatcggggcgaggacggctgttggtacgggatggaaatccgccccctcaaagagaaggaagagaatctggttaacagcctggtgaccgccggacacggccaagtggataatttctcccttggggtcctcggaatggctctgtttctggaagagatgctcagaacacgggtgggcaccaaacatgcgatcctgcttgttgccgtgtctttcgtcacactgattaccgggaacatgagctttaaggacctcggaagagtggttgtgatggtcggcgctacgatggccgatgacatcggcatgggggtgacctatctggccctgcttgctgccttcaaagttcgccctacatttgcggctggactgctcctgcggaagctcacctccaaggagctgatgatgacaaccattggcatcgtgcttctgtctcagagcacgattcccgaaacagtcctcgagctgaccgatgccctggcccttgggatgatggtgctgaaaatcgtgagaaatatggaaaagtaccagctcgctgtcacaatcatggccattctgtgcgttcctaacgcggtgatcctccagaatgcttggaaagtgtcctgtaccattctggccgtcgtgtctgttagcccccttctgctcacctccagccaacagaagacagactggatccctctggccctgacgattaaaggacttaaccccaccgctatcttcctgacaaccctctctcgcacaaataagaaaagatcctggccgctgaacgaggccatcatggctgtgggcatggtcagcattctcgcctcttccctgcttaagaatgacatccctatgaccgggcccctggtggcgggaggcctgctcacggtttgctatgtgctgacaggccggagcgccgatcttgaactggagcgcgctaccgacgtcaagtgggaggatcaggccgaaatttctgggtccagccctatcctctccattaccatcagcgaggacggatctatgagcattaaaaacgaagaggaggaacagacactgaccatcctcatcagaacaggcctgcttgtgatttccgggctgtttcccatctctattccgatcacggctgccgcctggtacctgtgggaggtcaagaaacaacgggctggagtgctctgggatgttccttctccccctcccatgggcaaggcggaactggaggacggggcctatcgcattaaacagaagggaatccttggctactcccagatcggcgctggggtgtacaaggaaggaaccttccacacaatgtggcatgtcaccagaggcgccgtgctgatgcacaaagggaagcggattgagccctcctgggccgatgttaaaaaggacctcatcagctatggaggcgggtggaaactggagggagaatggaaggagggcgaagaggtgcaggtcctcgctctggaacctggcaagaatccgcgcgccgtgcaaacaaaacccgggctttttaagaccaacacgggaaccattggcgcggtgtccctggatttctctcctgggacaagcggatcccccatcattgacaaaaagggcaaagttgtcgggctgtacggaaacggcgtggtgaccagaagcggcgcttatgtctctgccatcgcccagacagagaagtccatcgaggataatcctgaaattgaggacgatatctttcggaagcgcagactcaccattatggacctgcaccccggggctggaaaaacaaagcggtaccttcctgccatcgtgagagaagcgattaaacgcggcctgcggacgctcatcctggctccgaccagagttgtggccgccgagatggaagaggctctccgcgggctgcccattcggtatcagacccctgccatcagagctgagcataccggacgcgaaatcgtcgaccttatgtgtcacgccaccttcacaatgcggctgctgagccccgtgagagttcctaactacaatctcattatcatggatgaggcgcatttcacggaccccgcctctattgctgcccgcggctatatctccacccgggtggaaatgggggaggctgccggcatttttatgacagccaccccgcctggaagcagagatcccttcccccaatccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctgagaaagaatggcaaaaaggtgatccagcttagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatcctgaccgacggagaggaacgcgtgattctcgctggccctatgcccgtgacacatagctctgccgcgcagcggagagggcgcatcggccggaaccctaaaaatgaaaacgaccagtacatttatatgggagagcccctggaaaatgatgaggactgcgctcactggaaggaggccaagatgctgctcgataacatcaataccccggaaggcattatccctagcatgttcgagcccgaaagagagaaagtcgacgccattgatggggaataccgccttcggggagaggctagaaagacgtttgtggacctgatgcgcagaggcgatctgcctgtttggctcgcctataaagtggcggccgaggggatcaactacgctgaccggcgctggtgtttcgatggaatcaagaacaatcaaattctggaagagaacgtcgaagtggagatctggacaaaagagggcgaaagaaagaaacttaaaccccggtggctggacgcccgcatttattccgatcctctcgctctgaaggagtttaaagagttcgccgctgggagaaagtctctgaccctcaatcttatcacagagatgggccggctgcccaccttcatgacgcagaaaaccagagacgccctggataacctcgcggttctgcacacagccgaagctggaggccgcgcctacaatcatgctcttagcgagctgccggagaccctcgaaacactgctgctccttaccctgctggccacagtgaccgggggaatttttctcttcctgatgtccggccgggggatcggaaagatgacgcttggcatgtgctgcatcattacagcctctatcctgctctggtatgctcagattcagcctcactggatcgcggccagcattatcctggagtttttcctgatcgtcctccttattcccgaacccgagaagcaaagaacccctcaggacaaccagctgacctacgtggtcatcgctattctgacagtggttgccgccaccatggctaatgaaatgggctttctcgagaaaacaaagaaagacctggggcttggatccatcgccacgcagcaaccggagagcaacattctggatatcgacctccgccccgcgtctgcctggaccctgtacgctgtggccacaaccttcgtgacacctatgctgcggcattccattgaaaatagctccgtcaacgtttctctcaccgctatcgccaatcaggcgacggtgcttatgggcctggggaagggatggcccctgagcaaaatggatatcggcgtgcctctcctggccattgggtgttattcccaggtcaaccccatcacccttacagctgccctgctcctgctggtggctcactacgccattatcggacctggcctccaggctaaggccaccagagaggcgcaaaagcgggccgctgccggcattatgaaaaatccgacagttgacgggatcaccgtgatcgatcttgaccccattccttatgatcccaagtttgaaaaacagctgggacaggtcatgctgctcatcctgtgcgtgacgcaagtccttatgatgcgcacaacctgggctctgtgtgaggccctcacactggccaccggccctatttctaccctgtgggaagggaaccccggaagattctggaatacaacgatcgcggtgagcatggctaacatttttcggggctcctacctcgccggggctggacttctgttcagcatcatgaagaataccacaaacacccgcagaggcacaggcaacatgggggagaccctgggagagaaatggaagtctcggctcaatacgctgggcaaatccgaatttcagatctataaaaagagcgggattcaggaggttgaccgcacacttgccaaagaaggaatcaagagaggcgagaccgatcaccatgccgtgtctcgggggtccgctaaactgcgctggttcgtcgagagaaacatggtgaccccggaaggaaaggttgtggacctcggctgcggcagagggggatggagctactattgtggcgggctgaaaaatgtccgggaggtgaagggactgacaaagggcgggcctggacacgaagaacccattcccatgtctacctacggctggaacctcgtgcgccttcagagcggcgttgatgtctttttcatccctcccgaaaaatgcgacacactgctgtgtgatattggggagtcctctcctaatccgacggtggaggccggacggaccctcagagtgctgaaccttgtcgaaaattggctgaacaataacacacaattctgcatcaaggttctcaatccctacatgcctagcgtgatcgagaaaatggaagcgctgcagcgcaagtatggcggggccctggtgcggaaccccctctccagaaatagcacccatgagatgtactgggtctccaacgcttctggaaatattgtgagctccgttaacatgatctctcgcatgcttattaaccggtttacaatgagacacaaaaaggccacctatgaacctgacgtggacctgggcagcgggacgcgcaatatcggaattgagtccgagatccccaacctggatattatcggcaagcggatcgagaagattaagcaggagcatgaaacctcttggcactacgaccaggatcacccgtataaaacatgggcttaccatggcagctatgagaccaagcaaacagggtccgccagctctatggtcaatggagtggttagactcctgaccaaaccttgggacgtgcttcccacagtcacccagatggcgatgacggatacaacccctttcggccagcagcgcgtgtttaaggaaaaggtggacacccggacacaagagcccaaagaggggacgaagaaactgatgaagatcaccgccgaatggctctggaaagagctgggaaagaaaaagacacctagaatgtgtacccgcgaagagttcacaagaaaggtccggtccaacgctgccctgggcgctatttttaccgatgagaataaatggaaaagcgcccgcgaagctgttgaggactctagattctgggaactcgtggataaagagcggaacctgcaccttgaagggaagtgcgagacatgtgtgtacaatatgatgggaaaaagagagaagaagctgggcgaatttggcaaagccaaggggtcccgggcgatctggtacatgtggctcggagcccgcttcctggagtttgaagctcttggcttcctgaacgaggaccattggtttagcagagaaaattctctctccggggtcgagggagagggcctgcacaaactggggtatattctccgggatgtgagcaagaaagaaggcggagccatgtacgctgacgacaccgccggctgggatacgcgcatcaccctggaggaccttaagaacgaagagatggttacaaatcacatggaaggggagcataagaaactggccgaggcgatcttcaagctcacctatcagaacaaagtggtcagagtgcagcggcccacaccgcgcggaaccgttatggatattatctccagacgggaccaacgcggcagcgggcaggtcggaacgtacggcctgaatacatttaccaacatggaagctcagcttattagacagatggagggggaaggcgtcttcaagaatatccaacacctgacagtgaccgaggaggttgccgtgcagaactggctcgcccgggtcggacgcgaaagactgtctcggatggctattagcggcgatgactgcgtggtcaaacctctggatgaccgcttcgccaacgctctcacggccctgaatgatatggggaagatcagaaaggacatccagcagtgggagccctccaaaggatggaacgattggacccaagtgcccttttgctctcatcacttccatgaacttattatgaaggacggccgggttctggtggtcccttgtagaaatcaggatgagctcatcgggcgcgcgcggattagccagggagccggctggtccctgagagaaacagcttgccttgggaaatcttatgcccagatgtggagcctgatgtactttcaccgccgggacctcagactggctgccaacgcgatctgttccgccgtgccgtctcactgggtgcccaccagccgcacaacctggtccattcatgctaagcacgagtggatgacaaccgaggacatgctgacggtttggaatcgggtgtggatcagagaaaacccttggatggaggataaaacacccgtcgaaagctgggaggaaattccttatctcggcaagcgcgaggaccaatggtgcggatctctgatcggccttacctcccgggccacctgggctaagaatatccaggccgctattaaccaggtgagaagcctgatcgggaatgaggaatacacagattacatgccctctatgaaacgcttccggagagaggaagaggaagccggagttctctggtga

SEQ ID NO: 20077 - RNA, 9876 nt, synthetic construct
  misc_feature 1..9876: note = derived and/or modified CDS sequence (opt5) from DENV-2__FJ410221__SS-prME
  source 1..9876: mol_type = other RNA
agcgccggaatgatcattatgctgatccccaccgtgatggctttccacctgaccacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaatgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcggaggggtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctatcatggccgatgacattggcatcggggtgacgtatctcgccctgctggctgccttcaaggttcgccctacctttgcggctggacttctgctccggaagctgacatccaaagagctcatgatgaccacaattggcatcgtgctgctttctcaaagcaccatccccgaaacggtcctggagctcacagatgccctggccctggggatgatggtgcttaagattgtgagaaatatggaaaaataccagctggctgtcaccatcatggccattctctgcgttcctaacgcggtgatcctgcagaatgcttggaaggtgtcctgtacaattctcgccgtcgtgtctgttagccccctgcttctgacctccagccagcagaagaccgactggatccctctcgccctgacaatcaagggactgaaccccacggctattttccttaccacactgtctcgcaccaataaaaagagatcctggccgctcaacgaggccatcatggctgtgggcatggtcagcattctggcctcttccctcctgaagaatgacatccctatgacagggccccttgtggcgggaggcctgctgaccgtttgctatgtgctcacgggccggagcgccgatctggaacttgagcgcgctacagacgtcaaatgggaggatcaggccgaaatttctgggtccagccctatcctgtccattaccatcagcgaggacggatctatgagcatcaagaacgaagaggaggaacagaccctcacaattctgatcagaaccggcctcctggtgatttccgggctttttcccatctctattccgatcacagctgccgcctggtacctgtgggaggtcaaaaagcagcgggctggagtgctgtgggatgttccttctccccctcccatgggcaaagcggaactcgaggacggggcctatcgcatcaagcaaaaggggattctgggctactcccagatcggcgctggggtgtacaaagaaggaacgttccacaccatgtggcatgtcacaagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagaccaagcccgggctgtttaaaacaaacaccggaacgattggcgcggtgtcccttgatttctctcctgggaccagcggatcccccatcatcgacaagaaaggcaaggttgtcgggctgtacggaaacggcgtggtgacaagaagcggcgcttatgtctctgccattgcccaatccgaaaagagcatcgaggataatcctgaaattgaggacgatatctttcggaaacgcagactgaccattatggacctccaccccggggctggaaagacaaaacggtacctgcctgccatcgtgagagaagcgattaagcgcggccttcggaccctgatcctcgctccgacaagagttgtggccgccgagatggaagaggctctgcgcgggctccccatccggtatcagacgcctgccattagagtcgagcataccggacgcgaaatcgtggacctgatgtgtcacgctacattcaccatgcggcttctgtctcccgttagagtgcctaactacaatctgattatcatggatgaggcccatttcaccgaccccgcgtccattgccgctcgcggctatatcagcacacgggtcgaaatgggggaggccgctggcatctttatgacggccaccccgcctggatccagagatcccttcccccagtctaacgcccctattatcgacgaggaacgggagattcccgaacgcagctggaactccggccacgagtgggtgacagattttaaagggaagaccgtttggttcgtgcctagcatcaaggctggaaacgacattgcggcctgcctccgcaaaaatggcaagaaagtcatccaactgtctcggaagacatttgattccgaatacgtgaaaacccgcacgaacgactgggatttcgtggtcacaaccgacatcagcgagatgggggctaattttaaggccgagagagttattgatccgcggagatgtatgaaacccgtgatccttaccgacggagaggaacgcgtgattctggccggccctatgcccgtcacacattctagcgctgcccagcggagagggcgcatcggccggaaccctaagaatgaaaacgaccagtacatttatatgggagagcccctcgaaaatgatgaggactgcgcgcactggaaggaggctaaaatgctgctggataacatcaataccccggaaggcattatcccttccatgttcgagcccgaaagagagaaggtggacgccatcgatggggaataccgcctccggggagaggccagaaaaacatttgttgaccttatgcgcagaggcgatctgcctgtgtggctggcttataaggtcgccgcggaggggattaactacgccgaccggcgctggtgtttcgatggaatcaaaaacaatcagattctcgaagagaacgtggaagttgagatctggaccaaggagggcgaaagaaagaaactgaagccccggtggcttgacgctcgcatttattctgatcctctggccctcaaagagtttaaggagttcgctgccgggagaaaaagcctgacgctgaatctcatcacagagatgggccggcttcccaccttcatgacacaaaagaccagagacgctctggataacctggccgtgctccacacggcggaagccggaggccgcgcttacaatcatgccctgtccgagcttccggagaccctggaaacactcctgctgctcacccttctggctacagtcaccgggggaatctttctgttcctcatgtctggccgggggattggaaagatgacactgggcatgtgctgcatcattaccgccagcatccttctgtggtatgcccagattcagcctcactggatcgctgcgtccatcattctcgagtttttcctgatcgtgctgctcattcccgaacccgagaaacagagaacgcctcaagacaaccagcttacatacgtcgtgatcgccattctgaccgttgtggctgccaccatggccaatgaaatgggctttctggagaagaccaagaaggacctcgggctgggaagcatcgctacccagcagccggagtctaacattcttgatatcgacctgcgccccgcctccgcgtggacactctacgccgtggctacgaccttcgtcacacctatgctgcggcatagcatcgaaaattcctctgttaacgtgagcctgaccgccattgctaatcaagccacagtgctcatgggccttgggaaaggatggcccctgtccaagatggatatcggcgtccctctgctcgcgattgggtgttattctcaggtgaaccccatcaccctgacggccgcccttctgctcctggttgcccactacgctattatcggacctggcctgcaggccaaggctaccagagaggcccagaaacgggcggccgctggcatcatgaagaatccgacagtggacgggattaccgtcatcgatctcgaccccattccttatgatcccaaatttgaaaagcaacttggacaggtgatgctgctgatcctctgcgtcacacaggtgctgatgatgcgcaccacgtgggccctttgtgaggctctgacactcgccaccggccctattagcacactgtgggaagggaaccccggaagattctggaataccaccatcgccgtttccatggcgaacatctttcggggcagctacctggctggggccggactccttttctctattatgaaaaatacaacgaacacccgcagaggcacaggcaacatcggggagaccctgggagagaagtggaaatcccggctgaatgctctcggcaagagcgaatttcaaatttataagaaatctgggatccaggaggtggaccgcacactggccaaggaaggaattaaaagaggcgagaccgatcaccatgccgtctcccgggggagcgctaaacttcgctggttcgtggagagaaacatggttacgccggaaggaaaagtggtcgacctgggctgcggcagagggggatggtcttactattgtggcgggctcaagaatgtgcgggaggtgaagggactgacaaaaggcgggcctggacacgaggaacccatccccatgagcacctacggctggaacctggttcgcctccagtccggcgtcgatgtgtttttcatccctcccgaaaagtgcgacacccttctgtgtgatattggggagtctagccctaatccgacagtggaggccggacggaccctgagagtcctcaacctggttgaaaattggcttaacaataacacacagttctgcatcaaagtgctgaatccctacatgccttccgtgattgagaagatggaagcgctccaacgcaaatatggcggggccctggtccggaaccccctgagcagaaattccacgcatgagatgtactgggtgtctaacgctagcggaaatatcgtttcctctgtgaacatgattagccgcatgctcatcaaccggtttaccatgagacacaagaaggccacatatgaacctgacgtcgaccttggctccgggacccgcaatgtgggaattgagtctgagatccccaacctggatatcattggcaaacggatcgaaaagattaaacaggagcatgaaacaagctggcactacgaccaggatcacccgtataagacctgggcttaccatggctcctatgagacgaaacagaccgggagcgcctcttccatggttaatggagtggtcagactgctcacaaagccttgggacgtgctgcccaccgtgacacaaatggcgatgaccgatacaacccctttcggccagcagcgcgtctttaaggaaaaagttgacacgcggacacaggagcccaaggaggggaccaagaaacttatgaaaatcaccgccgaatggctgtggaaagagctcggcaagaagaagacacctagaatgtgtacgcgcgaagagttcaccagaaaagtgcggagcaacgctgccctgggcgctatttttacagatgagaataagtggaaatctgcccgcgaagctgtggaggactccagattctgggaactggtcgataaggagcggaacctccacctggaagggaaatgcgagacctgtgtgtacaatatgatgggaaagagagagaagaaacttggcgaatttggcaaggccaaagggagccgggcgatctggtacatgtggctgggagcccgcttcctcgagtttgaagctctgggcttccttaacgaggaccattggttttctagagaaaattccctgagcggggttgagggagagggcctccacaagctggggtatatcctgcgggatgtgtccaaaaaggaaggcggagccatgtacgctgacgacacagccggctgggatacccgcattacactcgaggacctgaagaacgaagagatggtcaccaatcacatggaaggggagcataagaaacttgccgaggcgatcttcaaactgacgtatcaaaacaaagtggttagagtgcagcggcccaccccgcgcggaacagtcatggatattatcagcagacgggaccagcgcggctctgggcaagtgggaacctacggcctcaatacatttaccaacatggaagctcagctgattagacagatggagggggaaggcgttttcaaaaatatccagcaccttacggtgacagaggaggtcgccgtgcaaaactggctggcccgggtcggacgcgaaagactcagccggatggctatctccggcgatgactgcgtggttaagcctctggatgaccgcttcgccaacgctctgaccgccctcaatgatatggggaagattagaaaagacatccagcagtgggagccctctaagggatggaacgattggacacaggtgcccttttgcagccatcacttccatgaactgattatgaaagacggccgggtccttgtggtgccttgtagaaatcaagatgagctgatcgggcgcgcgcggatttcccagggagccggctggtctctcagagaaaccgcttgcctgggaaagagctatgcccagatgtggtcccttatgtactttcaccgccgggacctgagactcgctgccaacgcgatctgttctgccgttccgagccactgggtgcccacgtcccgcaccacatggagcattcatgctaaacacgagtggatgaccacagaggacatgctgaccgtctggaatcgggtgtggatcagagaaaacccttggatggaggataagacacccgttgaatcttgggaggaaatcccttatctgggcaagcgcgaggaccagtggtgcggatccctcattggcctgaccagccgggccacgtgggctaaaaatatccaagccgctattaaccaggtgagatctcttatcgggaatgaggaatacacagattacatgccctccatgaagcgcttccggagagaggaagaggaagccggagtcctgtggtga

SEQ ID NO: 20078 - RNA, 9876 nt, synthetic construct
  misc_feature 1..9876: note = derived and/or modified CDS sequence (opt5) from DENV-2__FJ547064__SS-prME
  source 1..9876: mol_type = other RNA
agcgccggaatgatcattatgctgatccccaccgtgatggctttccacctgacgacgcggaatggggagcctcatatggtcgttggcattcaggaaaagggaaagagcctgctttttaagaccgaggacggggtgaatatgtgcacgctgatggccatggatctcggagaactgtgtgaggacaccatcacatacaagtgcccgcttctgcggcaaaacgaacccgaggatattgactgttggtgcaattctaccagcacatgggtgacctatggcacgtgtaccacaaccggggagcaccgcagagaaaagcggtccgtcgcgctcgtgcctcatgttggaatgggactggagacacgcaccgaaacgtggatgtctagcgagggcgcttggaaacacgcccagagaatcgagacatggatcctgcggcatcccgggttcaccattatggccgctatcctcgcctacacaattggaaccacccactttcagcgcgtgctgatcttcattcttctgacagctgtcgccccttccatgacgatgagatgcatcggcatttctaaccgggattttgtggaaggggttagcggaggctcctgggtggacatcgtcctcgagcacgggagctgtgtgaccacaatggcgaagaataagcccaccctggatttcgaacttatcaaaacagaggccaagcagcctgctaccctgcgcaaatattgcattgaagccaagctcacgaacacaaccaccgagtctagatgtccgacacaaggagagccctccctgaaagaagaacaggacaagcggtttgtgtgcaagcatagcatggtcgatcgcggctggggcaatgggtgtggactgttcggcaaagggggaatcgttacctgcgctatgtttacatgcaagaaaaacatggaaggcaagattgtgcagcctgagaatctcgaatacacgatcgtggtcacaccccactctggggaggagcatgccgtgggaaacgacacaggcaaacacggccaggaaattaaggttacccctcaatccagcatcacagaggcggaactgaccgggtatggaacggtgaccatggagtgttctcccagaacaggccttgatttcaatgaaatggtcctgctccagatggagaacaaagcctggctggtgcaccggcagtggtttcttgacctgccgctcccttggctgcccggggctgataagcaggagtccaattggatccaaaaggaaaccctggttacattcaaaaaccctcatgccaagaaacaggacgtggtcgtgctcggaagccaggagggcgctatgcacaccgccctgacgggggccacagaaattcaaatgtcctctggcaatcttctgtttaccggacatctcaagtgccgcctgagaatggacaaacttcagctgaagggcatgagctactccatgtgtacagggaagttcaaagtcgtgaaggagatcgctgagacccagcacggaaccattgttatccgggtgcagtatgaaggcgatgggagcccctgcaaaattcccttcgagatcatggacctcgaaaagagatacgtcctgggacgcctgatcacagtgaaccctattgttacggagaaagattctccggtgaacatcgaagcggagcccccttttggcgactcctacattatcattggggtcgagcccggccaactcaagctgaattggttcaagaaaggaagctctatcggccagatgtttgaaaccacaatgagaggggccaagagaatggctattcttggagataccgcctgggacttcggcagcctcggcggggtgtttacatccatcgggaaagccctccatcaggtgttcggggctatctatggcgccgcgttttctggagttagctggaccatgaagattctgatcggcgtcattatcacgtggattgggatgaactcccgcagcacatctctgtccgtgagccttgtgctcgtcggaatcgtgaccctgtacctgggcgttatggtgcaggctgattctgggtgtgtcgtgtcctggaaaaataaggagctcaagtgcggaagcggcatcttcattaccgacaacgttcacacatggaccgaacaatataaatttcagcctgagtccccctctaagctggccagcgccatccagaaagctcaggaagaggggatttgtggcatccggtccgtgacaagacttgagaatctgatgtggaagcaaattacgccggaactcaaccacatcctggccgagaatgaagtcaaactgaccatcatgacaggagatattaagggcatcatgcaggctgggaaacgctctcttcggcctcagcccaccgagctcaagtacagctggaagacatggggaaaagccaagatgctgtccaccgaaagctataaccagacgttcctgattgacggccctgagaccgcggagtgccccaatacaaacagagcctggaactctctcgaagtggaggattacgggtttggagttttcaccacaaacatctggctgaaacttaaggaaaaacaagacgctttttgtgactccaagctgatgagcgccgctattaaggataatcgcgccgtgcatgcggacatgggctattggatcgagtctgccctcaacgatacctggaaaatcgagaaggcttccttcattgaagtcaaaaattgccactggcctaagagccatacactgtggtctaacggcgtgctggagagcgaaatgatcattcccaaaaaccttgccgggccggtgtcccagcacaattaccggcctggataccacacccagatcgctggcccctggcatctcgggaagctggagatggacttcgatttttgtgacggaacgacagtcattgttaccgaagattgcggcaacagagggcccagcctgcgcaccacaaccgcctctggaaagctcatcacggagtggtgctgtcggtcctgcacactgcctccgcttagatatcggggcgaggacggctgttggtacgggatggaaattcgccccctgaaagagaaggaagagaatctcgtgaacagcctggtgaccgccggacacggccaagtcgataatttctccctgggggtgcttggaatggctctctttctggaagagatgctgagaacacgggttggcaccaaacatgcgatcctcctggtggccgtctctttcgtgacacttatcaccgggaacatgagctttaaggacctgggaagagttgtggtcatggtgggcgctacgatgaccgatgacattggcatgggggttacatatctcgccctgctggccgctttcaaagtgcgccctacctttgccgcgggacttctgctccggaagctgacatccaaggagctcatgatgaccacgatcggcattgtcctgctttctcagagcacaatccccgaaaccgtgctggagctcacagatgctctggccctggggatgatggtgcttaaaattgtcagaaatatggaaaagtaccagctggccgttaccatcatggctatcctctgcgtgcctaacgccgtgattctgcagaatgcgtggaaagtctcctgtaccatcctcgctgtggtttctgtgagccccctgcttctgacatccagccaacagaagacggactggattcctctcgccctgaccatcaaaggactgaaccccacagccattttccttaccacactgtctcgcaccaataagaaaagatcctggccgctcaacgaggctatcatggccgtcggcatggtgagcatcctggcttcttccctcctgaagaatgacattcctatgacggggccccttgttgccggaggcctgctgacagtgtgctatgtcctcaccggccggagcgcggatctggaacttgagcgcgccaccgacgtgaagtgggaggatcaggctgaaatctctgggtccagccctattctgtccatcacaattagcgaggacggatctatgagcatcaaaaacgaagaggaggaacagaccctcacaattctgatcagaacgggcctcctggtcatctccgggctttttcccatttctatcccgattaccgccgctgcctggtacctgtgggaggtgaagaaacaacgggccggagttctgtgggatgtgccttctccccctcccatgggcaaggctgaactcgaggacggggcgtatcgcatcaaacagaagggcattctgggctactcccagatcggcgccggggtctacagagaaggaacattccacaccatgtggcatgtgacacggggcgctgttcttatgcacaaggggaaacgcatcgagccctcctgggccgatgtgaagaaagacctgattagctatggaggcgggtggaagctcgagggagaatggaaagagggcgaagaggtccaggtgctggccctcgaacctggcaagaatccgagagctgtgcaaaccaagcccgggctgtttaaaacgaacaccggaacaatcggcgccgtttcccttgatttctctcctgggaccagcggatcccccattatcgacaagaaaggcaaggtcgtggggctgtacggaaacggcgtggtcacacggagcggcgcgtatgtgtctgctattgcccagaccgagaaatccatcgaggataatcctgaaatcgaggacgatatttttcgcaagagacggctgacaatcatggacctccaccccggggccggaaagacgaaaagatacctgcctgctattgttcgcgaagccatcaagcggggccttagaaccctgattctcgcgccgacacgcgtggtcgctgccgagatggaagaggccctgcgggggctccccatcagatatcagacccctgctattcgcgccgagcataccggacgggaaatcgtggacctgatgtgtcacgctacattcacgatgagacttctgagccccgttcgcgtgcctaactacaatctgatcattatggatgaggcccatttcaccgaccccgcgtctatcgccgctcggggctatatttccacaagagtcgaaatgggggaggccgctggcatctttatgaccgccacaccgcctggaagccgggatcccttcccccaatccaacgcccctattatcgacgaggaacgcgagatccccgaaagatcttggaatagcggccacgagtgggtgaccgattttaaagggaagacggtttggttcgtgccttccattaaagctggaaacgacatcgtcgcgtgcctccggaagaatggcaagaaagtgattcagctgagccgcaagacatttgattctgaatacgtgaaaaccagaaccaacgactgggatttcgtcgttacaaccgacatctccgagatgggggccaattttaaggctgagcgggtgattgatccgagacgctgtatgaaacccgtgatccttacagacggagaggaacgggtcatcctggccggccctatgcccgtgacccatagctctgccgctcagagacgcgggcggattggcagaaaccctaagaatgaaaacgaccagtacatctatatgggagagcccctcgaaaatgatgaggactgcgcccactggaaagaggcgaagatgctgctggataacattaatacgccggaaggcatcattcctagcatgttcgagcccgaacgcgagaaggttgacgctatcgatggggaataccggctcagaggagaggcccgcaaaacatttgtggaccttatgagacggggcgatctgcctgtctggctggcctataaggtggctgccgaggggattaactacgcggaccgcagatggtgtttcgatggaatcaaaaacaatcaaatcctcgaagagaacgttgaagtggagatttggaccaaggagggcgaacggaaaaagctgaagccccgctggcttgacgccagaatctattccgatcctctggctctcaaagagtttaaggagttcgccgctgggcggaaatctctgacactgaatctcattaccgagatgggcagacttcccacgttcatgacccagaagacacgcgacgccctggataacctggctgtcctccacaccgccgaagcgggaggccgggcctacaatcatgctctgagcgagcttccggagacactggaaaccctcctgctgctcacacttctggccaccgtgacagggggaatctttctgttcctcatgtccggcagagggattggaaaaatgacactgggcatgtgctgcatcatcaccgcttctattcttctgtggtatgcccagatccagcctcactggattgccgctagcatcattctcgagtttttcctgatcgtcctgctcatccccgaacccgagaagcaacgcacccctcaggacaaccagcttacatacgtggttattgcgatcctgaccgtggtggccgctacaatggccaatgaaatgggctttctggagaagacgaaaaaggacctcgggctgggatccattgccacccagcaaccggagagcaacatccttgatattgacctgcggcccgcttctgcctggacactctacgcggtcgccaccacattcgttacccctatgctgagacattccatcgaaaatagctccgtgaacgtgtctctgacggctattgccaatcaggctaccgtcctcatgggccttgggaaaggatggcccctgagcaagatggatatcggcgtgcctctgctcgccatcgggtgttattcccaggttaaccccattacactgaccgcggcccttctgctcctggtggctcactacgccatcattggacctggcctgcaggctaaagccacacgggaggctcaaaagcgcgccgcggccggcatcatgaagaatccgaccgtcgacgggattacggtgatcgatctcgaccccatcccttatgatcccaaatttgaaaagcagcttggacaggtcatgctgctgattctctgcgtgacacaagttctgatgatgagaaccacatgggctctttgtgaggccctgaccctcgctaccggccctatctctacactgtgggaagggaaccccggacggttctggaatacgaccattgccgtgagcatggccaacatctttcgcggctcctacctggcgggggctggactccttttcagcattatgaaaaatacaaccaacacaagacggggcaccggcaacatgggggagacgctgggagagaagtggaaatctcgcctgaatgccctcggcaagtccgaatttcagatctataaaaagagcgggatccaggaggtcgacagaacactggctaaggaaggaattaaacggggcgagaccgatcaccatgccgtgtctcgcgggtccgccaaacttagatggttcgttgagcggaacatggtgaccccggaaggaaaagtcgtggacctgggctgcggcagagggggatggagctactattgtggcgggctcaagaatgtgcgcgaggttaaaggactgacaaagggcgggcctggacacgaggaacccatccccatgtctacctacggctggaacctggtccggctccagagcggcgtggatgtgtttttcattcctcccgaaaagtgcgacacacttctgtgtgatatcggggagtcctctcctaatccgacggtcgaggctggaagaaccctgcgcgttctcaacctggtggaaaattggcttaacaataacattcaattctgcatcaaagtgctgaatccctacatgcctagcgtcatcgagaagatggaagccctccagcggaaatatggcggggcgctggtgagaaaccccctgtcccgcaatagcacacatgagatgtactgggtttccaacgcctctggaaatattgtgagctccgtcaacatgatctctcggatgctcattaacagatttaccatgcgccacaagaaagctacatatgaacctgacgtggaccttggcagcgggacccggaatatcggaacggagtccgagattcccaacctggatatcattggcaagagaatcgaaaagatcaaacaggagcatgaaacctcttggcactacgaccaggatcacccgtataagacatgggcctaccatggcagctatgagaccaaacaaacagggtccgctagctctatggttaatggagtggtccgcctgctcaccaagccttgggacgtgctgcccatggtgacacagatggccatgaccgatacgacacctttcggccagcagcgggtctttaaagaaaaggttgacaccagaacccaagagcccaaggaggggaccaagaaacttatgaaaattacggcggaatggctgtggaaggagctcggcaagaagaaaacccctcgcatgtgtacaagagaagagttcacccggaaggtgcgctccaacgccgctctgggcgccatctttacagatgagaataagtggaaaagcgctagagaagccgtggaggactctcggttctgggaactggtcgataaggagagaaacctccacctggaagggaaatgcgagacctgtgtgtacaatatgatgggaaagcgggagaagaaacttggcgaatttggcaaagctaaagggtcccgcgccatttggtacatgtggctgggagcgagattcctcgagtttgaagccctgggcttccttaacgaggaccattggtttagccgggaaaattctctgtccggggttgagggagagggcctccacaagctggggtatatcctgcgcgatgtgagcaaaaaggaaggcggagctatgtacgccgacgacacagctggctgggataccagaattacgctcgaggacctgaaaaacgaagagatggtcaccaatcacatggaaggggagcataagaaacttgccgaggccatcttcaaactgacatatcagaacaaggtggttcgggtgcagcgccccaccccgagaggaacagtcatggatatcatttcccggcgcgaccaaagaggcagcggacaggtgggaacctacggcctcaatacgtttacaaacatggaagcgcagctgatccggcagatggagggggaaggcgttttcaaaaatattcaacaccttaccgtgacagaggaggtcgctgtgaagaactggctggcccgcgtcggaagagaacggctctctcgcatggccatcagcggcgatgactgcgtggttaaacctctggatgacagattcgctaacgccctgaccgctctcaatgatatggggaagattcggaaggacatccagcagtgggagccctccaaaggatggaacgattggacacaggtgcccttttgctctcatcacttccatgaactgatcatgaaggacggcagagtccttgtggtgccttgtcgcaatcaagatgagctgattgggcgggccagaatcagccagggagcgggctggtccctccgcgaaaccgcctgcctggggaaatcttatgctcagatgtggagccttatgtactttcaccggagagacctgcgcctcgccgctaacgccatttgttccgcggttccgtctcactgggtgcccacaagccggaccacatggtccatccatgccaagcacgagtggatgaccacagaggacatgctgaccgtctggaatagagtgtggattcgcgaaaacccttggatggaggataaaacgcccgttgaaagctgggaggaaatcccttatctgggcaagcgggaggaccagtggtgcggatctctcattggcctgacatccagagctacctgggccaagaatatccaagctgccatcaaccaggtgcgcagccttattgggaatgaggaatacaccgattacatgccctctatgaaacggttcagacgggaggaagaggaagctggagtcctgtggtga

SEQ ID NO: 20079 - RNA, 9876 nt, synthetic construct
  misc_feature 1..9876: note = derived and/or modified CDS sequence (opt5) from DENV-2__FJ410223__SS-prME
  source 1..9876: mol_type = other RNA
agcgccggcatgatcattatgctgatccccaccgtcatggctttccacctgacaacgagaaatggggagcctcatatgattgtcggaatccaggaaaagggcaagtccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggagaacatggggaaaggccaaaatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaagaaaagcaagacgctttttgtgactccaaactgatgagcgccgctatcaaggataatcgggccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccagcacaattacagacctggataccacacccagattgctggcccctggcatctcgggaaactggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaggagaaagaagagaatctcgttaacagcctggtgaccgccggacacggccaagtggataatttctccctgggggtccttggaatggctctctttctggaagagatgctgcggacaagagtgggcaccaagcatgcgatcctcctggttgccgtgtctttcgtcacacttattaccgggaacatgagctttaaagacctgggacgcgtggttgtgatggtcggcgctacgatggccgatgacatcggcatgggggtgacctatctcgccctgctggctgccttcaaggttcggcctacatttgcggctggacttctgctcagaaaactgacctccaaggagctcatgatgacaaccattggcatcgtgctgctttctcagagcacgattcccgaaacagtcctggagctcaccgatgccctggccctggggatgatggtgcttaagatcgtgcgcaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccaacagaaaacagactggatccctctcgccctgacgattaagggactgaaccccaccgctatcttccttacaaccctgtctagaacaaataaaaagcggtcctggccgctcaacgaggccatcatggctgtgggcatggtcagcattctggcctcttccctcctgaaaaatgacatccctatgaccgggccccttgtggcgggaggcctgctgacggtttgctatgtgctcacaggccgcagcgccgatctggaacttgagagagctaccgacgtcaagtgggaggatcaggccgaaatttctgggtccagccctatcctgtccattaccatcagcgaggacggatctatgagcattaagaacgaagaggaggaacagacactcaccatcctgatccggacaggcctcctggtgatttccgggctttttcccatctctattccgatcacggctgccgcctggtacctgtgggaggtcaaaaagcaacgcgctggagtgctgtgggatgttccttctccccctcccatgggcaaagcggaactcgaggacggggcctatagaattaagcagaaaggaatcctgggctactcccagatcggcgctggggtgtacaaggaaggaaccttccacacaatgtggcatgtcacccggggcgccgtgcttatgcacaaggggaaacgcattgagccctcctgggccgatgttaagaaagacctgatcagctatggaggcgggtggaagctcgagggagaatggaaagagggcgaagaggtgcaggtcctggctctcgaacctggcaagaatccgagagccgtgcaaacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccggagcggcgcttatgtctctgccatcgcccagacagagaaatccatcgaggataatcctgaaattgaggacgatatctttcgcaagaagagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccaatccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctcagaaagaatggcaaaaaggtgatccagctgagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaaagagagaaagtcgacgccattgatggggaataccgcctccggggagaggctagaaagacgtttgtggaccttatgcgcagaggcgatctgcctgtttggctggcctataaagtggcggccgaggggatcaactacgctgaccggcgctggtgtttcgatggaatcaagaacaatcaaattctcgaagagaacgtcgaagtggagatctggacaaaagagggcgaaagaaagaagctgaaaccccggtggcttgacgcccgcatttattccgatcctctggctctcaaggagtttaaagagttcgccgctgggagaaagtctctgaccctgaatctcatcacagagatgggccggcttcccaccttcatgacgcagaaaaccagagacgccctggataacctggcggttctccacacagccgaagctggaggccgcgcctacaatcatgctctgagcgagcttccggagaccctggaaacactcctgctgctcgcccttctggccaccgtgacagggggaatttttctgttcctcatgtccggccgggggatcggaaagatgaccctgggcatgtgctgcatcattacggcttctatccttctgtggtatgcgcagattcagcctcactggatcgccgctagcattatcctcgagtttttcctgatcgtcctgctcattcccgaacccgagaagcaaagaacacctcaggacaaccagcttacctacgtggtcatcgccattctgaccgtggttgccgctacaatggccaatgaaatgggctttctggagaaaaccaagaaagacctcgggctgggatccatcgcgacacagcaaccggagagcaacattcttgatatcgacctgcgccccgcctctgcttggacgctctacgccgtggctaccacattcgtgacccctatgctgcggcattccattgaaaatagctccgtcaacgtttctctgacagccatcgcgaatcaggccaccgtgctcatgggccttgggaagggatggcccctgagcaaaatggatatcggcgtgcctctgctcgctattgggtgttattcccaggtcaaccccatcacgctgaccgccgcccttctgctcctggtggcccactacgctattatcggacctggcctgcaggccaaggcgacaagagaggcccaaaagcgggctgccgctggcattatgaaaaatccgaccgttgacgggatcacagtgatcgatctcgaccccattccttatgatcccaagtttgaaaaacagcttggacaggtcatgctgctgatcctctgcgtgacccaagtcctgatgatgcgcacgacatgggccctttgtgaggccctgaccctcgcgacaggccctatttctaccctgtgggaagggaaccccggaagattctggaataccacaatcgctgtgagcatggccaacatttttcggggctcctacctggctggggccggactccttttcagcatcatgaagaatacgaccaacacacgcagaggcaccggcaacatgggggagacactgggagagaaatggaagtctcggctgaatgccctcggcaaatccgaatttcagatctataaaaagagcgggattcaggaggttgaccgcaccctggctaaagaaggaatcaagagaggcgagacggatcaccatgccgtgtctcgggggtccgcgaaacttcgctggttcgtcgagagaaacatggtgacaccggaaggaaaggttgtggacctgggctgcggcagagggggatggagctactattgtggcgggctcaaaaatgtccgggaggtgaagggactgaccaagggcgggcctggacacgaggaacccattcccatgtctacctacggctggaacctggtgcgcctccagagcggcgttgatgtctttttcatccctcccgaaaaatgcgacacacttctgtgtgatattggggagtcctctcctaatccgaccgtggaggccggacggacactgagagtgctcaacctggtcgaaaattggcttaacaataacacgcaattctgcatcaaggttctgaatccctacatgcctagcgtgatcgagaaaatggaagctctccagcgcaagtatggcggggccctggtgcggaaccccctgtccggaaatctcaaaaacgagatgtactgggtcagcaatgcttccggcaacattgtgtctagcgttaacatgatctccagaatgcttattaatcgctttaccatgcggcataagaaggccacatatgaacctgacgtggacctggggtctggaaccagaaacatcggcattgagagcgagacacccaatctggatatcattggcaaacgcatcgaaaagatcaaacaggagcacgaaacctcctggcattacgaccaggatcacccgtataagacgtgggcgtaccacgggtcttatgagaccaaacaaacaggaagcgcctccagcatggtcaacggcgtggttcggctcctgaccaagccttgggacgtgcttcccacagtcacccagatggctatgacagataccacgcctttcgggcagcagagagtgtttaaggaaaaagtggacacacgcacccaagagcccaaggagggaaccaaaaagctgatgaaaattacagccgaatggctctggaaggagctgggcaaaaagaagacgcctcggatgtgtaccagagaagagttcacacgcaaagtcagatctaatgctgccctgggggctatctttaccgatgagaacaagtggaaatccgcccgggaagcggttgaggacagccgcttctgggaactcgtggataaggagagaaatctgcatcttgaaggaaaatgcgagacatgtgtgtacaacatgatgggcaagcgggagaagaaactgggcgaatttgggaaggccaaaggatctagagctatttggtacatgtggctcggcgcccggttcctggagtttgaagctcttgggttcctgaatgaggaccactggttttcccgcgaaaacagcctctctggagtcgagggcgaggggctgcataagctgggctatatcctcagagatgtgtccaaaaaggaaggaggcgccatgtacgccgacgacaccgcggggtgggatacacggattaccctggaggaccttaagaatgaagagatggttacgaaccacatggaaggagagcacaaaaagctggctgaggccatcttcaaactcacctatcagaataaggtggtccgcgtgcagagacccacaccgcggggcaccgttatggatatcattagccgcagagaccaacgggggtccggacaggtgggcacatacgggctgaacacctttacgaatatggaagcccagcttatccgccagatggagggcgaaggagtcttcaaaaacattcaacatctgacagtgaccgaggaggttgctgtgcagaactggctcgccagagtcggccgggaacgcctgagcagaatggctatctctggggatgactgcgtggtcaagcctctggatgaccggttcgccaatgcgctcacagccctgaacgatatgggaaagattcgcaaagacatccagcagtgggagcccagcaagggctggaatgattggacccaagtgcccttttgctcccaccatttccacgaacttatcatgaaagacgggagagttctggtggtcccttgtcggaaccaggatgagctcattggacgggctcgcatctctcagggcgccgggtggagcctgcgggaaacggcttgccttggcaagtcctatgcccagatgtggtctctgatgtactttcatagacgcgacctccggctggtggcgaatgccatttgtagcgctgtgccgtcccactgggttcccacctctagaacaacctggagcatccacgccaaacatgagtggatgacaaccgaggacatgctgacagtgtggaaccgcgtctggattcgggaaaatccttggatggaggataagacccccgtggaatcctgggaggaaatcccttatctcggaaagagagaggaccaatggtgcggcagcctgattgggcttacgtctcgcgctacatgggccaaaaacatccaggctgccatcaatcaggttcggtccctgattggaaacgaggaatacaccgattacatgcccagcatgaagagattccgccgggaggaagaggaagcgggcgtgctctggtga

SEQ ID NO: 20080 - RNA, 9876 nt, synthetic construct
  misc_feature 1..9876: note = derived and/or modified CDS sequence (opt5) from DENV-2__FJ410224__SS-prME
  source 1..9876: mol_type = other RNA
agcgccggaatgatcattatgctgatccccaccgtgatggctttccacctgaccacgagaaacggggagcctcatatgattgtgggaatccaggaaaagggcaagtccctgctttttaagaccgaggacggggttaatatgtgcacgctgatggccatggatctcggagaactgtgtgaggacaccgtgacatacaagtgcccgcttctgcggcaaaacgaacccgaggatattgactgttggtgcaattctaccagcacatgggtgacctatggcacgtgtaccacaaccggggagcacagacgggaaaagcggtccgtcgcgctcgtgcctcatgttggaatgggcctggagacacgcaccgaaacgtggatgtctagcgagggcgcttggaaacacgcccagagaatcgagacatggatcctgcggcatcccgggttcaccattatggccgctatcctcgcctacacaattggaaccacccactttcagcgcgtgctgatcttcattcttctgacagctgtcgccccttccatgacgatgagatgcatcggcatttctaaccgggattttgtggaaggggttagcggaggctcctgggtggacatcgtcctcgagcacgggagctgtgtgaccacaatggcgaagaataagcccaccctggatttcgaacttatcaaaacagaggccaagcagcctgctaccctgcgcaaatattgcattgaagccaagctcacgaacacaaccaccgagtctagatgtccgacacaaggagagccctccctgaaagaagaacaagacaagcggtttgtgtgcaagcatagcatggtcgatcgcggctggggcaatgggtgtggactgttcggcaaagggggaatcgttacctgcgctatgtttacatgcaagaaaaacatggaaggcaagattgtgcagcctgagaatctcgaatacacgatcgtggtcacaccccactctggggaggagcatgccgtgggaaacgacacaggcaaacacggcaaggaaattaaagttacccctcagtccagcatcacagaggcggaactgaccgggtatggaacggtgaccatggagtgttctcccagaacaggccttgatttcaatgaaatggtcctgctccaaatggagaacaaggcctggctggtgcaccggcagtggtttcttgacctgccgctcccttggctgcccggggctgataagcaggagtccaattggatccagaaagaaaccctggttacattcaagaaccctcatgccaaaaagcaagacgtggtcgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgttatccgggtgcagtatgaaggcgatgggagcccctgcaagattcccttcgagatcatggacctcgagaagcggtacgtcctgggacgcctgatcacagtgaaccctattgttacggagaaggattctccggtgaacatcgaagcggagcccccttttggcgactcctacattatcattggggtcgagcccggccagctcaagctgaattggttcaaaaagggaagctctatcggccaaatgtttgaaaccacaatgagaggggccaaaagaatggctattcttggagataccgcctgggacttcggcagcctcgggggagtgtttacatccatcggcaaggccctccatcaggtgttcggggctatctatggcgccgcgttttctggagttagctggaccatgaaaattctgatcggcgtcattatcacgtggattgggatgaactcccgcagcacatctctgtccgtgagccttgtgctcgtcggaaccgtgaccctgtacctgggcgttatggtgcaggctgattctgggtgtgtcgtgtcctggaagtccaaggagctcaaatgcggatccggcatcttcatcacagacaatgttcacacctggacagaacagtataagtttcaacctgagtctcccagcaaactggcctccgccattcagaaggctcaggaagaggggatctgtggcattcggtctgtgacgagacttgagaacctgatgtggaaacagatcaccccggaactcaatcacattctggccgagaacgaagtcaagctgacaatcatgaccggagatatcaaaggcattatgcaagctgggaagcgcagccttcggcctcagcccacagagctcaagtactcctggaaaacctggggaaaggccaaaatgctgagcacggaatcttataatcagaccttcctgatcgacggccctgagacagcggagtgccccaacaccaatagagcctggaactccctcgaagtggaggattacgggtttggagttttcacaaccaatatttggctgaaacttaaagaaaagcaggacgctttttgtgacagcaagctgatgtctgccgctatcaaagataaccgcgccgtgcatgcggacatgggctattggattgagtccgccctcaatgatacatggaagatcgagaaagctagcttcatcgaagtcaagaactgccactggcctaaatctcataccctgtggagcaatggcgtgctggagtccgaaatgattatccccaagaaccttgccgggccggtgagccaacacaactaccggcctggataccacacgcagattgctggcccctggcatctcgggaagctggagatggacttcgatttttgtgacggaacaaccgtcatcgttaccgaagattgcggcaatagagggccctctctgcgcacaaccacggcctccggaaaactcattacagagtggtgctgtcggagctgcaccctgcctccgcttagatatcggggcgaggacggctgttggtacgggatggaaatccgccccctgaaggagaaagaagagaacctcgtcaattccctggtgacagccggacacggccaggtcgataacttctctctgggggtgcttggaatggctctctttctggaagagatgctgagaacccgggttggcacaaagcatgcgattctcctggtggccgtcagcttcgtgacccttatcacggggaatatgtcctttaaagacctgggaagagttgtggtcatggtgggcgctaccatggccgatgacatcggcatgggggttacatatctcgccctgctggctgccttcaaggtgcgccctacctttgcggctggacttctgctccggaagctgacatctaaagagctcatgatgaccacgattggcatcgtcctgcttagccaatccacaattcccgaaaccgtgctggagctcacagatgccctggccctggggatgatggtgcttaagatcgtcagaaacatggaaaaataccagctggctgttaccattatggccatcctctgcgtgcctaatgcggtgatcctgcagaacgcttggaaggtctcttgtaccattctcgccgtggttagcgtgagccccctgcttctgacaagctctcagcagaagacggactggatccctctcgccctgaccattaagggactgaatcccacagctatcttccttaccacactgtcccgcaccaacaaaaagagaagctggccgctcaatgaggccattatggctgtcggcatggtgtctatcctggcctccagcctcctgaagaacgacatccctatgacggggccccttgttgcgggaggcctgctgacagtgtgctatgtcctcaccggccggtctgccgatctggaacttgagcgcgctaccgacgtgaaatgggaggatcaggccgaaatttccgggagctcccctatcctgagcattacaatctctgaggacggaagcatgtccattaagaatgaagaggaggaacagaccctcacaatcctgattagaacgggcctcctggtcatctctgggctttttcccatcagcattccgatcaccgctgccgcctggtacctgtgggaggtgaaaaagcagcgggctggagttctgtgggatgtgccttctccccctcccatgggcaaagcggaactcgaggacggggcctatcgcattaagcaaaagggaatcctgggctacagccagattggcgctggggtctacaaagaaggaacattccacaccatgtggcatgtgacaagaggcgccgttcttatgcacaaggggaaacggatcgagcccagctgggccgatgtgaagaaagacctgatctcctatggaggcgggtggaagctcgagggagaatggaaggagggcgaagaggtccaggtgctggctctcgaacctggcaaaaacccgcgcgccgtgcagaccaagcccgggctgtttaaaacgaataccggaacaattggcgcggtttctcttgatttcagccctgggacctccggaagccccatcattgacaagaaaggcaaggtcgtggggctgtacggaaacggcgtggtcacaagatctggcgcttatgtgtccgccatcgcccaaaccgaaaagagcattgaggataaccctgaaatcgaggacgatatctttcggaaacgcagactgacaattatggacctccaccccggggctggaaagacgaaacggtacctgcctgccatcgttagagaagcgattaagcgcggccttcggaccctgatcctcgctccgacaagagtggtcgccgccgagatggaagaggctctgcgcgggctccccattcggtatcagacccctgccatcagagctgagcataccggacgcgaaattgtggacctgatgtgtcacgccacattcacgatgcggcttctgtctcccgttagagtgcctaattacaacctgatcatcatggatgaggcgcatttcaccgaccccgcctccattgctgcccgcggctatatcagcacacgggtcgaaatgggggaggctgccggcatttttatgaccgccacaccgcctggatccagagatcccttcccccagtctaatgctcctatcattgacgaggaacgggagatccccgaacgcagctggaactccggccacgagtgggtgaccgattttaaagggaagacggtttggttcgtgcctagcatcaaggcgggaaatgacattgccgcttgcctccgcaaaaacggcaagaaagtcatccaactgtctcggaagacatttgattccgaatacgtgaaaacccgcaccaatgactgggatttcgtggtcacaaccgacattagcgagatgggggccaactttaaggccgagagagttatcgatccgcggagatgtatgaaacccgtgattcttacagacggagaggaacgcgtgatcctggctggccctatgcccgtcacccattctagcgccgcgcagcggagagggcgcatcggccggaatcctaagaacgaaaatgaccagtacatttatatgggagagcccctcgaaaacgatgaggactgcgctcactggaaggaggccaaaatgctgctggataatatcaacacgccggaaggcattatcccttccatgttcgagcccgaaagagagaaggtggacgccattgatggggaataccgcctccggggagaggctagaaaaacatttgttgaccttatgcgcagaggcgatctgcctgtgtggctggcctataaggtcgcggccgaggggatcaattacgctgaccggcgctggtgtttcgatggaattaaaaacaaccagatcctcgaagagaatgtggaagttgagatctggaccaaggagggcgaaagaaagaaactgaagccccggtggcttgacgcccgcatttattctgatcctctggctctcaaagagtttaaggagttcgccgctgggagaaaaagcctgacactgaacctcatcaccgagatgggccggcttcccacgttcatgacccaaaagacaagagacgccctggataatctggcggtgctccacaccgccgaagctggaggccgcgcctacaaccatgctctgtccgagcttccggagacactggaaaccctcctgctgctcacacttctggccaccgtcacagggggaatttttctgttcctcatgtctggccgggggatcggaaagatgacactgggcatgtgctgcattatcaccgccagcatccttctgtggtatgctcagattcagcctcactggatcgcggcctccattatcctcgagtttttcctgattgtgctgctcatccccgaacccgagaaacagagaacccctcaagacaatcagcttacatacgtcgtgatcgctattctgaccgttgtggccgccacaatggctaacgaaatgggctttctggagaagacgaaaaaggacctcgggctgggaagcatcgccacccagcagccggagtctaatattcttgatatcgacctgcgccccgcgtccgcctggacactctacgctgtggccaccacattcgtcacccctatgctgcggcatagcattgaaaactcctctgttaatgtgagcctgacggctatcgccaaccaagcgaccgtgctcatgggccttgggaaaggatggcccctgtccaagatggatattggcgtccctctgctcgccatcgggtgttattctcaggtgaatcccatcacactgaccgctgcccttctgctcctggttgctcactacgccattatcggacctggcctgcaggctaaggccacaagagaggcgcagaaacgggccgctgccggcattatgaagaacccgaccgtggacgggatcacggtcattgatctcgaccccatcccttatgatcccaaatttgaaaagcaacttggacaggtgatgctgctgatcctctgcgtcacacaggtgctgatgatgcgcaccacatgggctctttgtgaggccctgaccctcgccaccggccctattagcacactgtgggaagggaatcccggaagattctggaacacgaccatcgcggtttccatggctaatatttttcggggcagctacctggccggggctggactccttttctctatcatgaaaaacacaaccaatacacgcagaggcaccggcaacattggggagacgctgggagagaagtggaaatcccggctgaacgccctcggcaagagcgaatttcaaacatataagaaatctgggatccaggaggtggaccgcaccctggccaaggaaggaatcaaaagaggcgagaccgatcaccatgctgtctcccgggggagcgccaaacttcgctggttcgtggagagaaatatggttacaccggaaggaaaagtggtcgacctgggctgcggcagagggggatggtcttactattgtggcgggctcaagaacgtgagagaggtgaagggactgaccaaaggcgggcctggacacgaggaacccattcccatgagcacatacggctggaatctggttcgcctccagtccggcgtcgatgtgtttttcatccctcccgaaaagtgcgacacgcttctgtgtgatattggggagtctagccctaacccgaccgtggaggcgggacggacactgagagtcctcaatctggttgaaaactggcttaataacaatacccagttctgcatcaaagtgctgaacccctacatgccttccgtgattgagaagatggaagccctccaacgcaaatatggcggggctctggtccggaatcccctgagcagaaactccacacatgagatgtactgggtgtctaatgccagcggaaacatcgtttcctctgtgaatatgatcagccgcatgctcattaaccggtttaccatgagacacaagaaggctacgtatgaacctgacgtcgaccttggctccgggacccgcaacatcggaattgagtctgagatccccaatctggatattatcggcaaacggattgaaaagatcaaacaggagcatgaaacaagctggcactacgaccaggatcacccgtataagacctgggcctaccatggctcctatgagacaaaacagaccgggagcgcgtcttccatggtgaacggagttgtgagactgctcacaaagccttgggacgtcctgcccaccgtgacgcaaatggccatgacagataccacccctttcggccagcagcgcgtgtttaaggaaaaagtcgacacacggacgcaggagcccaaggaggggaccaagaaacttatgaaaatcacagctgaatggctgtggaaagagctcggcaagaagaagacccctagaatgtgtacacgcgaagagttcaccagaaaagttcggagcaatgccgctctgggcgccatttttacagatgagaacaagtggaaatctgctcgcgaagccgtggaggactccagattctgggaactggtggataaggagcggaatctccacctggaagggaaatgcgagacctgtgtctacaacatgatgggaaagagagagaagaaacttggcgaatttggcaaggcgaaagggagccgggccatctggtacatgtggctgggagctcgcttcctcgagtttgaagccctgggcttccttaatgaggaccattggttttctagagaaaactccctgagcggggtggagggagagggcctccacaagctggggtatattctgcgggatgtttccaaaaaggaaggcggagctatgtacgccgacgacacggccggctgggatacccgcatcacactcgaggacctgaagaatgaagagatggtgaccaaccacatggaaggggagcataagaaacttgcggaggctattttcaaactgacatatcaaaataaagtcgtgagagttcagcggcccaccccgcgcggaacggtgatggatatcatcagcagacgggaccagcgcggctctgggcaagtcggaacatacggcctcaacacctttacaaatatggaagcccagctgattagacagatggagggggaaggcgtgttcaaaaacatccagcaccttaccgttacggaggaggtggccgtccaaaattggctggctcgggtgggacgcgaaagactcagccggatggccatttccggcgatgactgcgtcgtgaagcctctggatgaccgcttcgctaacgccctgaccgcgctcaacgatatggggaagatcagaaaagacattcagcagtgggagccctctaagggatggaatgattggacacaggttcccttttgcagccatcacttccatgaactgatcatgaaagacggccgggtgcttgtcgtgccttgtagaaaccaagatgagctgatcgggcgcgcccggatttcccagggagctggctggtctctcagagaaaccgcctgcctggggaagtcctatgctcagatgtggtcccttatgtactttcaccgccgggacctgagactcgccgcgaatgccatctgttctgctgtgccgagccactgggttcccacatcccgcaccacatggagcattcatgccaaacacgagtggatgaccacggaggacatgctgacagtgtggaaccgggtctggatcagagaaaatccttggatggaggataagacccccgtggaatcttgggaggaaattccttatctgggcaagcgcgaggaccagtggtgcggatccctcatcggcctgaccagccgggctacatgggccaaaaacattcaagctgccatcaatcaggttagatctcttatcgggaacgaggaatacaccgattacatgccctccatgaagcgcttccggagagaggaagaggaagcgggagtgctgtggtga

SEQ ID NO: 20081 - RNA, 9876 nt, synthetic construct
  misc_feature 1..9876: note = derived and/or modified CDS sequence (opt5) from DENV-2__FJ461321__SS-prME
  source 1..9876: mol_type = other RNA
tccgctggaatgatcattatgctgatccccacagtgatggctttccacctgacaacgagaaatggggagcctcatatgattgtcggaatccaggaaaagggcaagtccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtcttccgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcattccgtcggaaacgacacaggcaaacacggcatggaaatcaaggtgacccctcagagctctatcacagaggccgaactgaccgggtatggaacggttaccatggagtgttcccccagaacaggccttgatttcaatgaaatggtgctgctccaaatggagaacaaagcgtggctggtccaccggcagtggtttcttgacctgccgctcccttggctgcccggggccgataagcaggagagcaattggattcagaaggaaaccctggtgacattcaaaaaccctcatgctaagaaacaagacgttgtggtcctcggatcccaggagggcgccatgcacaccgctctgacgggggccacagaaatccagatgtctagcggcaatcttctgtttaccggacatctcaagtgccgcctgagaatggacaaacttcaactgaagggcatgtcctacagcatgtgtacagggaagttcaaagtggtcaaggagattgccgagacccagcacggaaccatcgtgattcgggttcagtatgaaggcgatgggtctccctgcaaaatccccttcgagatcatggacctcgaaaagagatacgtgctgggacgcctgattacagtcaaccctatcgtgacggagaaagattccccggttaacattgaagctgagcccccttttggcgacagctacatcattatcggggtggagcccggccagctcaagctgaattggttcaagaaaggatctagcattggccaaatgtttgaaaccacaatgagaggggcgaagagaatggccatccttggagataccgcttgggacttcggctccctcgggggagtctttacatctatcggcaaagccctccatcaggtgttcggggccatttatggcgctgcctttagcggagtgtcctggaccatgaagatcctgattggcgttatcattacgtggatcgggatgaacagccgctctacatccctgagcgtctctcttgtgctcgtgggaatcgtcaccctgtacctgggcgtgatggttcaggcggattccgggtgtgtggtcagctggaaaaataaggagctcaagtgcggatccggcattttcatcaccgacaacgtgcacacatggaccgaacagtataaatttcaacctgagtctcccagcaagctggcttccgccattcagaaagcccaggaagaggggatctgtggcattcggtctgttacaagacttgagaatctgatgtggaagcagatcacgccggaactcaaccacatcctggctgagaatgaagtgaaactgaccattatgacaggagatatccgcggcattatgcaagccgggaagcggagccttagacctcagcccaccgagctcaaatactcctggaagacatggggaaaggctaaaatgctgagcaccgaatcttataaccagacgttcctgatcgacggccctgagaccgccgagtgccccaatacaaaccgcgcgtggaactccctcgaagtcgaggattacgggtttggagtgttcaccacaaacatttggctgaaacttaaagaaaagcaggacgccttttgtgacagcaaactgatgtctgctgccatcaaggataatcgggctgttcatgccgacatgggctattggatcgagtccgcgctcaacgatacctggaagattgagaaagccagcttcatcgaagtgaagaattgccactggcctaaatctcatacactgtggagcaacggcgtcctggagtccgaaatgattatccccaagaaccttgctgggccggtgagccaacacaattacagacctggataccacacccagattgccggcccctggcatctcgggaaactggagatggacttcgatttttgtgacggaacgacagtgatcgtcaccgaagattgcggcaaccgcgggccctctctgcggaccacaaccgcttccggaaagctcattacggagtggtgctgtagaagctgcacactgcctccgcttcggtatcgcggcgaggacggctgttggtacgggatggaaatcagacccctgaaggagaaagaagagaatctcgttaactccctggtgaccgccggacacggccaggtggataatttctctctgggggtccttggaatggccctctttctggaagagatgctgcggacaagagtgggcaccaagcatgctatcctcctggttgcggtgagcttcgtcacacttattaccgggaacatgtcctttaaagacctgggacgcgtggttgtgatggtcggcgccacgatggctgatgacatcggcatgggggtgacctatctcgccctgctggccgctttcaaggttcggcctacatttgccgcgggacttctgctcagaaaactgacctctaaggagctcatgatgacaaccattggcatcgtgctgcttagccaatccacgattcccgaaacagtcctggagctcaccgatgctctggccctggggatgatggtgcttaagatcgtgcgcaatatggaaaaataccagctggccgtcacaatcatggctattctctgcgttcctaacgccgtgatcctgcagaatgcgtggaaggtgtcttgtaccattctcgctgtcgtgagcgttagccccctgcttctgaccagctctcagcagaagacggactggatccctctcgccctgacgattaagggactgaaccccaccgccatcttccttacaaccctgtccagaacaaataaaaagcggagctggccgctcaacgaggctatcatggccgtgggcatggtctctattctggcttccagcctcctgaaaaatgacatccctatgaccgggccccttgtggccggaggcctgctgacggtttgctatgtgctcacaggccgctctgcggatctggaacttgagagagccaccaacgtcaagtgggaggaccaggctgaaatttccgggagctcccctatcctgagcattaccatctctgaggatggaagcatgtccattaagaatgaagaggaggaacagacactcaccatcctgatccggacaggcctcctggtgatttctgggctttttcccatcagcattccgatcacggccgctgcctggtacctgtgggaggtcaaaaagcagcgcgccggagtgctgtgggacgttccttctccccctcccatgggcaaagctgaactcgaggatggggcgtatagaattaagcaaaaaggaatcctgggctacagccagatcggcgccggggtgtacaaggaaggaaccttccacacaatgtggcatgtcacccggggcgctgtgcttatgcacaaggggaaacgcattgagcccagctgggccgacgttaagaaagatctgatctcctatggaggcgggtggaagctcgagggagaatggaaagagggcgaagaggtgcaggtcctggccctcgaacctggcaagaacccgagagctgtgcagacaaagcccgggctgtttaaaaccaacacgggaaccattggcgccgtgtctcttgacttcagccctgggacatccggaagccccatcattgataagaaaggcaaggttgtcgggctgtacggaaatggcgtggtgacccggtctggcgcgtatgtctccgctatcgcccaaacagagaaaagcatcgaggacaaccctgaaattgaggatgacatctttcgcaagagacggctgaccattatggatctccaccccggggccggaaagacaaaaagatacctgcctgctatcgtgcgcgaagccattaagcggggccttagaacgctgatcctcgcgccgacccgcgttgtggctgccgagatggaagaggccctgcgggggctccccattagatatcagacccctgctatccgcgccgagcataccggacgggaaatcgtcgacctgatgtgtcacgctaccttcacaatgagacttctgtctcccgtgcgcgttcctaattacaacctgattatcatggacgaggcccatttcacggatcccgcgtccattgccgctcggggctatatcagcaccagagtggaaatgggggaggccgctggcatttttatgacagccaccccgcctggatcccgggaccccttcccccagtctaatgcccctatcatcgatgaggaacgcgagattcccgaaagaagctggaactccggccacgagtgggtcacagactttaaagggaagaccgtgtggttcgttcctagcatcaaagctggaaatgatattgcggcctgcctccggaagaacggcaagaaagtgatccaactgtctcgcaagacgtttgactccgaatacgtcaaaacaagaaccaatgattgggacttcgtggtgaccacagatattagcgagatgggggctaactttaaggccgagcgggtcatcgacccgagacgctgtatgaaacccgttatccttaccgatggagaggaacgggtgattctggccggccctatgcccgtgacacattctagcgctgcccagagacgcgggcggatcggcagaaatcctaagaacgaaaatgaccagtacatttatatgggagagcccctcgaatccgacgaggattgcgcgcactggaaagaggctaagatgctgctggacaacatcaataccccggaaggcattatcccttctatgttcgagcccgaacgcgagaaggtcgatgccattgacggggaataccggctcagaggagaggcccgcaaaacgtttgtggatcttatgagacggggcgacctgcctgtttggctggcttataaggtggccgcggaggggatcaactacgccgatcgcagatggtgtttcgacggaatcaaaaacaatcagattctcgaagagaacgtcgaagtggagatctggacaaaggagggcgaacggaaaaagctgaagccccgctggcttgatgctagaatttatagcgaccctctggccctcaaagagtttaaggagttcgctgccgggcggaaatccctgaccctgaatctcatcacagagatgggcagacttcccaccttcatgacgcaaaagacccgcgatgctctggacaacctggccgttctccacacagcggaagccggaggccgggcttacaatcatgccctgtctgagcttccggagaccctggaaacactcctgctgctcacccttctggctacagtgaccgggggaatttttctgttcctcatgagcggcagagggatcggaaaaatgacgctgggcatgtgctgcatcattacagcctccatccttctgtggtatgcccagattcagcctcactggatcgctgcgagcattatcctcgagtttttcctgatcgtcctgctcattcccgaacccgagaagcagcgcacccctcaagataaccagcttacctacgtggtcatcgccattctgacagtggttgctgccaccatggccaatgaaatgggctttctggagaagaccaagaaggacctcgggctgggatctatcgctacgcagcagccggagtccaacattcttgacatcgatctgcggcccgccagcgcgtggaccctctacgccgtggctacaaccttcgtgacacctatgctgagacattccattgaaaattctagcgtcaacgtttccctgaccgccatcgctaatcaagccacggtgctcatgggccttgggaaaggatggcccctgtctaagatggacatcggcgtgcctctgctcgcgattgggtgttatagccaggtcaaccccatcaccctgacagccgcccttctgctcctggtggcccactacgctattatcggacctggcctgcaggccaaagctacccgggaggcccagaagcgcgcggccgctggcattatgaagaatccgacagttgatgggatcaccgtgatcgacctcgatcccattccttatgaccccaaatttgaaaagcaacttggacaggtcatgctgctgatcctctgcgtgacgcaggtcctgatgatgagaacaacctgggccctttgtgaggctctgacactcgccaccggccctatttccaccctgtgggaagggaaccccggacggttctggaatacaacgatcgccgtgagcatggcgaacatttttcgcggctcttacctggctggggccggactccttttctccatcatgaaaaataccacaaacaccagacggggcacaggcaacatcggggagaccctgggagagaagtggaaaagccgcctgaatgctctcggcaagtctgaatttcaaatttataaaaagtccgggatccaggaggttgatagaacgctggccaaggaaggaattaaacggggcgagacagaccaccatgccgtgagccgcgggtctgctaaacttagatggttcgtcgagcggaacatggtgaccccggaaggaaaagttgtggatctgggctgcggcagagggggatggagctactattgtggcgggctcaagaatgtccgcgaggtgaaaggactgaccaagggcgggcctggacacgaggaacccatccccatgtccacatacggctggaacctggtgcggctccagtctggcgttgacgtctttttcattcctcccgaaaagtgcgatacccttctgtgtgacatcggggagagctcccctaatccgacagtggaggccggaagaacgctgcgcgtgctcaacctggtcgaaaattggcttaacaataacacccagttctgcatcaaagttctgaatccctacatgcctagcgtgattgagaagatggaagcgctccaacggaaatatggcggggccctggtgagaaaccccctgtcccgcaattctacacatgagatgtactgggtcagcaacgcttccggaaatatcgtgtctagcgttaacatgatttcccggatgctcatcaacagatttaccatgcgccacaagaaagccacatatgaacctgatgtggaccttggctctgggacccggaatattggaatcgagagcgagattcccaacctggacatcatcggcaagagaattgaaaagatcaaacaggagcatgaaacgtcctggcactacgatcaggaccacccgtataagacctgggcttaccatggcagctatgagacaaaacagaccgggtctgcctccagcatggtcaatggagtggttcgcctgctcacaaagccttgggatgtgctgcccaccgtcacacaaatggcgatgaccgacacgacacctttcggccagcagcgggtgtttaaagaaaaggtggataccagaacccaggagcccaaggaggggaccaagaaacttatgaaaattacggccgaatggctgtggaaggagctcggcaagaagaaaacccctcgcatgtgtacaagagaagagttcacccggaaggtccgctctaacgctgccctgggcgctatctttacagacgagaataagtggaaatccgccagagaagctgttgaggatagccggttctgggaactggtggacaaggagagaaacctccacctggaagggaaatgcgagacctgtgtgtacaatatgatgggaaagcgggagaagaaacttggcgaatttggcaaagccaaagggtctcgcgcgatttggtacatgtggctgggagccagattcctcgagtttgaagctctgggcttccttaacgaggatcattggttttcccgggaaaatagcctgtccggggtcgagggagagggcctccacaagctggggtatatcctgcgcgacgtgagcaaaaaggaaggcggagccatgtacgctgatgacacagccggctgggacaccagaatcacgctcgaggatctgaaaaacgaagagatggttaccaatcacatggaaggggagcataagaaacttgccgaggcgattttcaaactgacatatcaaaacaaggtggtccgggtgcagcgccccaccccgagaggaacagttatggacatcatttctcggcgcgatcagagaggcagcgggcaagtgggaacctacggcctcaatacgtttacaaacatggaagctcagctgatccggcagatggagggggaaggcgtcttcaaaaatattcagcaccttaccgtgacagaggaggttgccgtgcataactggctggcccgcgtcggaagagaacggctctcccgcatggctatctctggcgacgattgcgtggtcaagcctctggacgatagattcgccaacgctctgaccgccctcaatgacatggggaaaatccggaaggatattcaacagtgggagcccagcaagggatggaacgactggacacaggtgcccttttgctcccaccatttccacgaactgatcatgaaagatggccggattcttgttgtgccttgtcgcaatcaggacgagctgatcgggcgggcgagaatttctcaaggagccggctggagcctccgcgaaaccgcttgcctggggaagtcctatgcccagatgtggtctcttatgtactttcaccggagagatctgcgcctcgctgccaacgcgatctgtagcgccgtcccgtcccattgggtgcccacaagccggaccacatggtctattcacgctaaacatgagtggatgaccacagaggacatgctgaccgtgtggaatagagtttggatccgcgaaaacccttggatggaggacaagacgcccgtggaatcctgggaggaaatcccttatctgggcaaacgggaggatcagtggtgcggaagcctcattggcctgacatctagagccacctgggctaagaatatccaggccgctattaaccaagtccgctcccttatcgggaatgaggaatacaccgactacatgcccagcatgaagcggttcagacgggaggaagaggaagccggagtgctgtggtga

SEQ ID NO: 20082 - RNA, 9876 nt, synthetic construct
  misc_feature 1..9876: note = derived and/or modified CDS sequence (opt5) from DENV-2__FJ410228__SS-prME
  source 1..9876: mol_type = other RNA
agcgccggcatgatcattatgctgatccccaccgtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatccgcggcattatgcaagctgggaagcggtctcttagacctcagcccaccgagctcaaatacagctggaagacatggggaaaggccaaaatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaagaaaagcaggacgctttttgtgactccaaactgatgagcgccgctatcaaggataatcgggccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattacagacctggataccacacccagattgctggcccctggcatctcgggaaactggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaggagaaagaagagaatctcgttaacagcctggtgaccgccggacacggccaggtggataatttctccctgggggtccttggaatggctctctttctggaagagatgctgcggacaagagtgggcaccaagcatgcgatcctcctggttgccgtgtctttcgtcacacttattaccgggaacatgagctttaaagacctgggacgcgtggttgtgatggtcggcgctacgatggccgatgacatcggcatgggggtgacctatctcgccctgctggctgccttcaaggttcggcctacatttgcggctggacttctgctcagaaaactgacctccaaggagctcatgatgacaaccattggcatcgtgctgctttctcaaagcacgattcccgaaacagtcctggagctcaccgatgccctggccctggggatgatggtgcttaagatcgtgcgcaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagaccgactggatccctctcgccctgacgattaagggactgaaccccaccgctatcttccttacaaccctgtctagaacaaataaaaagcggtcctggccgctcaacgaggccatcatggctgtgggcatggtcagcattctggcctcttccctcctgaaaaatgacatccctatgaccgggccccttgtggcgggaggcctgctgacggtttgctatgtgctcacaggccgcagcgccgatctggaacttgagagagctaccgacgtcaagtgggaggatcaggccgaaatttctgggtccagccctatcctgtccattaccatcagcgaggacggatctatgagcattaagaacgaagaggaggaacagacactcaccatcctgatccggacaggcctcctggtgatttccgggctttttcccatctctattccgatcacggctgccgcctggtacctgtgggaggtcaaaaagcagcgcgctggagtgctgtgggatgttccttctccccctcccatgggcaaagcggaactcgaggacggggcctatagaattaagcaaaaaggaatcctgggctactcccagatcggcgctggggtgtacaaggaaggaaccttccacacaatgtggcatgtcacccggggcgccgtgcttatgcacaaggggaaacgcattgagccctcctgggccgatgttaagaaagacctgatcagctatggaggcgggtggaagctcgagggagaatggaaagagggcgaagaggtgcaggtcctggctctcgaacctggcaagaatccgagagccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccggagcggcgcttatgtctctgccatcgcccaaacagagaaatccatcgaggataatcctgaaattgaggacgatatctttcgcaagagacggctgaccattatggacctccaccccggggctggaaagacaaaaagatacctgcctgccatcgtgcgcgaagcgattaagcggggccttagaacgctgatcctcgctccgacccgcgttgtggccgccgagatggaagaggctctgcgggggctccccattagatatcagacccctgccatccgcgctgagcataccggacgggaaatcgtcgacctgatgtgtcacgccaccttcacaatgagacttctgagccccgtgcgcgttcctaactacaatctgattatcatggatgaggcgcatttcacggaccccgcctctattgctgcccggggctatatctccaccagagtggaaatgggggaggctgccggcatttttatgacagccaccccgcctggaagccgggatcccttcccccagtccaacgctcctatcatcgacgaggaacgcgagattcccgaaagatcttggaatagcggccacgagtgggtcacagattttaacgggaaaaccgtgtggttcgttccttccatcaaggcgggaaatgacattgccgcttgcctccggaaaaacggcaagaaggtgatccaactgagccgcaaaacgtttgattctgaatacgtcaagacaagaaccaatgactgggatttcgtggtgaccacagacatttccgagatgggggccaactttaaagccgagcgggtcatcgatccgagacgctgtatgaagcccgttatccttaccgacggagaggaacgggtgattctggctggccctatgcccgtgacacatagctctgccgcgcagagacgcgggcggatcggcagaaatcctaaaaacgaaaatgaccagtacatttatatgggagagcccctcgaaaacgatgaggactgcgctcactggaaggaggccaaaatgctgctggataatatcaacaccccggaaggcattatccctagcatgttcgagcccgaacgcgagaaggtcgacgccattgatggggaataccggctcagaggagaggctcgcaagacgtttgtggaccttatgagacggggcgatctgcctgtttggctggcctataaagtggcggccgaggggatcaactacgctgaccgcagatggtgtttcgatggaatcaagaataaccagattctcgaagagaatgtcgaagtggagatctggacaaaagagggcgaacggaagaaactgaagccccgctggcttgacgccagaatttattccgatcctctggctctcaaggagtttaaagagttcgccgctgggcggaagtctctgaccctgaacctcatcacagagatgggcagacttcccaccttcatgacgcagaagacccgcgacgccctggataatctggcggttctccacacagccgaagctggaggccgggcctacaaccatgctctgagcgagcttccggagaccctggaaacactcctgctgctcacccttctggccacagtgaccgggggaatttttctgttcctcatgtccggcagagggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagcgcacccctcaagacaatcagcttacctacgtggtcatcgctattctgacagtggttgccgccaccatggctaacgaaatgggctttctggagaagacaaagaaagacctcgggctgggatccatcgccacgcagcagccggagagcaatattcttgatatcgacctgcggcccgcgtctgcctggaccctctacgctgtggccacaaccttcgtgacacctatgctgagacattccattgaaaacagctccgtcaatgtttctctgaccgctatcgccaaccaagcgacggtgctcatgggccttgggaagggatggcccctgagcaaaatggatatcggcgtgcctctgctcgccattgggtgttattcccaggtcaatcccatcaccctgacagctgcccttctgctcctggtggctcactacgccattatcggacctggcctgcaggctaaggccacccgggaggcgcagaaacgcgccgctgccggcattatgaagaacccgacagttgacgggatcaccgtgatcgatctcgaccccattccttatgatcccaagtttgaaaaacaacttggacaggtcatgctgctgatcctctgcgtgacgcaggtcctgatgatgagaacaacctgggctctttgtgaggccctgacactcgccaccggccctatttctaccctgtgggaagggaatcccggacggttctggaacacaacgatcgcggtgagcatggctaatatttttcgcggctcctacctggccggggctggactccttttcagcatcatgaagaacaccacaaacaccagacggggcacaggcaatatcggggagaccctgggagagaaatggaagtctcgcctgaacgccctcggcaaatccgaatttcaaatttataagaaaagcgggatccaggaggttgacagaacgctggccaaggaaggaattaagcggggcgagacagatcaccatgctgtgtctcgcgggtccgccaaacttagatggttcgtcgagcggaatatggtgaccccggaaggaaaggttgtggacctgggctgcggcagagggggatggagctactattgtggcgggctcaaaaacgtccgcgaggtgaagggactgaccaaaggcgggcctggacacgaggaacccatccccatgtctacatacggctggaatctggtgcggctccagagcggcgttgatgtctttttcattcctcccgaaaagtgcgacacccttctgtgtgatatcggggagtcctctcctaacccgacagtggaggcgggaagaacgctgcgcgtgctcaatctggtcgaaaactggcttaataacaatacccagttctgcatcaaggttctgaacccctacatgcctagcgtgattgagaaaatggaagccctccaacggaagtatggcggggctctggtgagaaatcccctgtcccgcaacagcacacatgagatgtactgggtctccaatgcctctggaaacatcgtgagctccgttaacatgatttctcggatgctcatcaatagatttaccatgcgccacaaaaaggctacatatgaacctgacgtggaccttggcagcgggacccggaacattggaatcgagtccgagattcccaatctggatatcatcggcaaaagaattgaaaagatcaagcaggagcatgaaacgtcttggcactacgaccaggatcacccgtataaaacctgggcctaccatggcagctatgagacaaagcagaccgggtccgcgagctctatggtcaacggagtggttcgcctgctcacaaaaccttgggacgtgctgcccaccgtcacacaaatggccatgaccgatacgacacctttcggccagcagcgggtgtttaaggaaaaagtggacaccagaacccaggagcccaaggaggggacaaagaaacttatgaagattacggctgaatggctgtggaaagagctcggaaagaaaaagacccctcgcatgtgtacaagagaagagttcacccggaaagtccgctccaatgccgctctgggcgccatctttacagatgagaacaagtggaaaagcgctagagaagccgttgaggactctcggttctgggaactggtggataaagagagaaatctccacctggaagggaagtgcgagacctgtgtgtacaacatgatgggaaaacgggagaagaaacttggcgaatttggcaaggcgaaggggtcccgcgccatttggtacatgtggctgggagctagattcctcgagtttgaagccctgggcttccttaatgaggaccattggtttagccgggaaaactctctgtccggggtcgagggagagggcctccacaaactggggtatatcctgcgcgatgtgagcaagaaagaaggcggagctatgtacgccgacgacacagccggctgggataccagaatcacgctcgaggacctgaagaatgaagagatggttaccaaccacatggaaggggagcataagaaacttgcggaggctattttcaaactgacatatcaaaataaagtggtccgggtgcagcgccccaccccgagaggaacagttatggatatcatttcccggcgcgaccagagaggcagcgggcaagtgggaacctacggcctcaacacgtttacaaatatggaagcccagctgatccggcagatggagggggaaggcgtcttcaagaacattcagcaccttaccgtgacagaggaggttgccgtgcataactggctggctcgcgtcggaagagaacggctctctcgcatggccatcagcggcgatgactgcgtggtcaaacctctggatgacagattcgctaatgccctgaccgcgctcaacgatatggggaagatccggaaagacattcaacagtgggagccctccaagggatggaatgattggacgcaagtccccttttgctctcaccatttccacgaactgatcatgaaggacggccggattcttgttgtgccttgtcgcaaccaggatgagctgatcgggcgggccagaattagccaaggagctggctggtccctccgcgaaaccgcctgcctggggaaatcttatgctcagatgtggagccttatgtactttcaccggagagacctgcgcctcgccgcgaatgccatctgttccgctgtcccgtctcattgggtgcccacaagccggaccacatggtccattcacgccaagcatgagtggatgaccacagaggacatgctgaccgtgtggaacagagtttggatccgcgaaaatccttggatggaggataaaacgcccgtggaaagctgggaggaaatcccttatctgggcaagcgggaggaccagtggtgcggatctctcattggcctgacatccagagctacctgggccaaaaacatccaggctgccattaatcaagtccgcagccttatcgggaacgaggaatacaccgattacatgccctctatgaagcggttcagacgggaggaagaggaagcgggagtgctgtggtga

SEQ ID NO: 20083 - RNA, 9876 nt, synthetic construct
  misc_feature 1..9876: note = derived and/or modified CDS sequence (opt5) from DENV-2__FJ410233__SS-prME
  source 1..9876: mol_type = other RNA
agcgccggcatgatcattatgctgatccccaccgtcatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcaacttttgtgatggaacgacagtgatcgtcaccgaagactgcggcaatagagggcccagcctgcgcaccacaaccgcctctggaaagctcattacggagtggtgctgtcggtcctgcacactgcctccgcttagatatcggggcgaggatggctgttggtacgggatggaaatccgccccctgaaagagaaggaagagaacctcgttaatagcctggtgaccgccggacacggccaagtggacaacttctccctgggggtccttggaatggctctctttctggaagagatgctgagaacacgggtgggcaccaaacatgcgatcctcctggttgccgtgtctttcgtcacacttattaccgggaatatgagctttaaggatctgggaagagtggttgtgatggtcggcgctacgatgaccgacgatatcggcatgggggtgacatatctcgccctgctggccgctttcaaagttcgccctacctttgccgcgggacttctgctccggaagctgacatccaaggagctcatgatgaccacgattggcatcgtgctgctttctcagagcacaattcccgaaaccgtcctggagctcacagacgctctggccctggggatgatggtgcttaaaatcgtgagaaacatggaaaagtaccagctggccgtcaccatcatggctattctctgcgttcctaatgccgtgatcctgcagaacgcgtggaaagtgtcctgtaccattctcgctgtcgtgtctgttagccccctgcttctgacatccagccaacagaagacggattggatccctctcgccctgaccattaaaggactgaatcccacagccatcttccttaccacactgtctcgcaccaacaagaaaagatcctggccgctcaatgaggctatcatggccgtgggcatggtcagcattctggcttcttccctcctgaagaacgacatccctatgacggggccccttgtggccggaggcctgctgacagtttgctatgtgctcaccggccggagcgcggacctggaacttgagcgcgccaccgatgtcaagtgggaggaccaggctgaaatttctgggtccagccctatcctgtccattacaatcagcgaggatggatctatgagcattaaaaatgaagaggaggaacagaccctcacaatcctgatcagaacgggcctcctggtgatttccgggctttttcccatctctattccgatcaccgccgctgcctggtacctgtgggaggtcaagaaacaacgggccggagtgctgtgggacgttccttctccccctcccatgggcaaggctgaactcgaggatggggcgtatcgcattaaacagaagggaatcctgggctactcccagatcggcgccggggtgtacaaggaaggaacattccacaccatgtggcatgtcacaagaggcgctgtgcttatgcacaaagggaagcggattgagccctcctgggccgacgttaaaaaggatctgatcagctatggaggcgggtggaaactcgagggagaatggaaggagggcgaagaggtgcaggtcctggccctcgaacctggcaagaacccgcgcgctgtgcaaaccaaacccgggctgtttaagacgaacaccggaacaattggcgccgtgtcccttgacttctctcctgggaccagcggatcccccatcattgataaaaagggcaaagttgtcgggctgtacggaaatggcgtggtgacaagaagcggcgcgtatgtctctgctatcgcccagaccgagaagtccatcgaggacaaccctgaaattgaggatgacatctttcggaagcgcagactgacaattatggatctccaccccggggccggaaaaacgaagcggtacctgcctgctatcgtgagagaagccattaaacgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaattacaacctgattatcatggacgaggcccatttcaccgatcccgcgtctattgccgctcgcggctatatctccacacgggtggaaatgggggaggccgctggcatttttatgaccgccacaccgcctggaagcagagaccccttcccccaatccaatgcccctatcatcgatgaggaacgggagattcccgaacgctcttggaacagcggccacgagtgggtcaccgactttaaggggaaaacggtgtggttcgttccttccatcaaggctggaaatgatattgcggcctgcctcagaaagaacggcaaaaaggtgatccagctgagccggaaaacatttgactctgaatacgtcaagacccgcaccaatgattgggacttcgtggtgacaaccgatatttccgagatgggggctaactttaaagccgagagagtcatcgacccgcggagatgtatgaagcccgttatccttacagatggagaggaacgcgtgattctggccggccctatgcccgtgacccatagctctgctgcccagcggagagggcgcatcggccggaatcctaaaaacgaaaatgaccagtacatttatatgggagagcccctcgaaaacgacgaggattgcgcgcactggaaggaggctaagatgctgctggacaatatcaacacgccggaaggcattatccctagcatgttcgagcccgaaagagagaaagtcgatgccattgacggggaataccgcctccggggagaggccagaaagacatttgtggatcttatgcgcagaggcgacctgcctgtttggctggcttataaagtggccgcggaggggatcaactacgccgatcggcgctggtgtttcgacggaatcaagaataaccaaattctcgaagagaatatggaagtcgagatctggaccaaagagggcgaaagaaagaagctgaaaccccggtggcttgatgctcgcatttattccgaccctctggccctcaaggagtttaaagagttcgctgccgggagaaagtctctgacactgaacctcatcaccgagatgggccggcttcccacgttcatgacccagaaaacaagagatgctctggacaatctggccgtgctccacaccgcggaagccggaggccgcgcttacaaccatgccctgagcgagcttccggagacactggaaaccctcctgctgctcacacttctggctaccgttacagggggaatttttctgttcctcatgtccggccgggggatcggaaagatgacactgggcatgtgctgcatcattaccgcctctatccttctgtggtatgcccagattcagcctcactggatcgctgcgagcattatcctcgagtttttcctgatcgtgctgctcattcccgaacccgagaagcaaagaacccctcaggataatcagcttacatacgtcgtgatcgccattctgaccgtcgtggctgccacaatggccaacgaaatgggctttctggagaaaacgaagaaagacctcgggctgggatccatcgctacccgccagccggagagcaatattcttgacatcgatctgcggcccgcctctgcgtggacactctacgccgttgctaccacattcgtgacccctatgctgagacattccattgaaaacagctccgtgaatgtctctctgacggccatcgctaaccaagccaccgttctcatgggccttgggaagggatggcccctgagcaaaatggacatcggcgtgcctctgctcgcgattgggtgttattcccaggtgaatcccatcacactgaccgccgcccttctgctcctggtcgcccactacgctattatcggacctggcctgcaggccaaggctacacgggaggcccagaagcgcgcggccgctggcattatgaaaaacccgaccgtggatgggatcacggttatcgacctcgatcccattccttatgaccccaagtttgaaaaacaacttggacaggtgatgctgctggtcctctgcgtgacacaggtcctgatgatgagaaccacatgggccctttgtgaggctctgaccctcgccaccggccctatctctacactgtgggaagggaatcccggacggttctggaacacgaccattgccgtgagcatggcgaatatctttcgcggctcctacctggctggggccggactccttttcagcattatgaagaacacaaccaacacaagacggggcaccggcaatatgggggagacgctgggagagaaatggaagtctcgcctgaacgctctcggcaaatccgaatttcaaatctataaaaagagcgggatccaggaggttgatagaacactggccaaagaaggaattaagcggggcgagaccgaccaccatgccgtgtctcgcgggtccgctaaacttagatggttcgtcgagcggaatatggtgaccccggaaggaaaggttgtggatctgggctgcggcagagggggatggagctactattgtggcgggctcaaaaacgtccgcgaggtgaagggactgacaaagggcgggcctggacacgaagaacccatccccatgtctacctacggctggaatctggtgcggctccagagcggcgttgacgtctttttcattcctcccgaaaaatgcgatacacttctgtgtgacatcggggagtcctctcctaacccgacggtggaggccggaagaaccctgcgcgtgctcaatctggtcgaaaactggcttaataacaatacacagttctgcattaaggttctgaacccctacatgcctagcgtgatcgagaaaatggaagcgctccaacggaagtatggcggggccctggtgagaaatcccctgtcccgcaacagcacccatgagatgtactgggtctccaatgcttctggaaacatcgtgagctccgttaacatgatttctcggatgctcatcaatagatttacaatgcgccacaaaaaggccacctatgaacctgatgtggaccttggcagcgggacgcggaacattggaatcgagtccgagattcccaatctggacatcattggcaagagaatcgagaagatcaagcaggagcatgaaacctcttggcactacgatcaggaccacccgtataaaacatgggcttaccatggcagctatgagaccaagcagacagggtccgccagctctatggtcaacggagtggttcgcctgctcaccaaaccttgggatgtgctgcccacagtcacccaaatggcgatgacggacacaacccctttcggccagcagcgggtgtttaaggaaaaggtggataccagaacacaggagcccaaagaggggacgaagaaacttatgaagattaccgccgaatggctgtggaaagagctcggaaagaaaaagacacctcgcatgtgtaccagagaagagttcacacggaaggtccgctccaatgctgccctgggcgctatctttaccgacgagaacaaatggaaaagcgccagagaagctgttgaggattctcggttctgggaactggtggacaaagagagaaatctccacctggaagggaagtgcgagacatgtgtgtacaacatgatgggaaaacgggagaagaaacttggcgaatttggcaaagccaaggggtcccgcgcgatttggtacatgtggctgggagccagattcctcgagtttgaagctctgggcttccttaatgaggatcattggtttagccgggaaaactctctgtccggggtcgagggagagggcctccacaaactggggtatatcctgcgcgacgtgagcaagaaagaaggcggagccatgtacgctgatgacaccgccggctgggacacgagaattaccctcgaggatctgaagaatgaagagatggttacaaaccacatggaaggggagcataagaaacttgccgaggcgatcttcaagctgacctatcaaaataaagtggtccgggtgcagcgccccacaccgagaggaaccgttatggacatcatttcccggcgcgatcagagaggcagcgggcaagtgggaacgtacggcctcaacacatttaccaatatggaagctcagctgatccggcagatggagggggaaggcgtcttcaagaacattcagcaccttacagtgaccgaggaggttgccgtgaaaaactggctggcccgcgtcggaagagaacggctctctcgcatggctatcagcggcgacgattgcgtggtcaagcctctggacgatagattcgccaatgctctgacggccctcaacgacatggggaagattcggaaagatatccaacagtgggagccctccaagggatggaatgactggacccaggtgcccttttgctctcatcacttccatgaactgatcatgaaagatggcagagttcttgtggtcccttgtcgcaaccaggacgagctgattgggcgggcgagaatcagccaaggagccggctggtccctccgcgaaacagcttgcctggggaagtcttatgcccagatgtggagccttatgtactttcaccggagagatctgcgcctcgctgccaatgcgatttgttccgccgtgccgtctcactgggtgcccaccagccggacaacctggtccatccatgctaaacacgagtggatgacaaccgaggacatgctgacggtttggaacagagtgtggattcgcgaaaatccttggatggaggacaagacacccgtcgaaagctgggaggaaatcccttatctgggcaagcgggaggatcagtggtgcggatctctcattggcctgacctccagagccacctgggctaaaaacatccaggccgctatcaatcaagtgcgcagccttattgggaacgaggaatacacagactacatgccctctatgaagcggttcagacgggaggaagaggaagccggagttctgtggtga

SEQ ID NO: 20084 - RNA, 9876 nt, synthetic construct
  misc_feature 1..9876: note = derived and/or modified CDS sequence (opt5) from DENV-2__FJ410237__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatgaccgatgacatcggcatgggggtgacatatctcgccctgctggccgctttcaaagttcgccctacctttgccgcgggacttctgctccggaagctgacatccaaggagctcatgatgaccacgattggcatcgtgctgctttctcagagcacaattcccgaaaccgtcctggagctcacagatgctctggccctggggatgatggtgcttaaaatcgtgagaaatatggaaaagtaccagctggccgtcaccatcatggctattctctgcgttcctaacgccgtgatcctgcagaatgcgtggaaagtgtcctgtaccattctcgctgtcgtgtctgttagccccctgcttctgacatccagccaacagaagacggactggatccctctcgccctgaccattaaaggactgaaccccacagccatcttccttaccacactgtctcgcaccaataagaaaagatcctggccgctcaacgaggctatcatggccgtgggcatggtcagcattctggcttcttccctcctgaagaatgacatccctatgacggggccccttgtggccggaggcctgctgacagtttgctatgtgctcaccggccggagcgcggatctggaacttgagcgcgccaccgacgtcaagtgggaggatcaggctgaaatttctgggtccagccctatcctgtccattacaatcagcgaggacggatctatgagcattaaaaacgaagaggaggaacagaccctcacaatcctgatcagaacgggcctcctggtgatttccgggctttttcccatctctattccgatcaccgccgctgcctggtacctgtgggaggtcaagaaacaacgggccggagtgctgtgggatgttccttctccccctcccatgggcaaggctgaactcgaggacggggcgtatcgcattaaacagaagggaatcctgggctactcccagatcggcgccggggtgtacaaggaaggaacattccacaccatgtggcatgtcacaagaggcgctgtgcttatgcacaaagggaagcggattgagccctcctgggccgatgttaaaaaggacctgatcagctatggaggcgggtggaaactcgagggagaatggaaggagggcgaagaggtgcaggtcctggccctcgaacctggcaagaatccgcgcgctgtgcaaaccaaacccgggctgtttaagacgaacaccggaacaattggcgccgtgtcccttgatttctctcctgggaccagcggatcccccatcattgacaaaaagggcaaagttgtcgggctgtacggaaacggcgtggtgacaagaagcggcgcgtatgtctctgctatcgcccagaccgagaagtccatcgaggataatcctgaaattgaggacgatatctttcggaagcgcagactgacaattatggacctccaccccggggccggaaaaacgaagcggtacctgcctgctatcgtgagagaagccattaaacgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaactacaatctgattatcatggatgaggcccatttcaccgaccccgcgtctattgccgctcgcggctatatctccacacgggtggaaatgggggaggccgctggcatttttatgaccgccacaccgcctggaagcagagatcccttcccccaatccaacgcccctatcatcgacgaggaacgggagattcccgaacgctcttggaatagcggccacgagtgggtcaccgattttaaggggaaaacggtgtggttcgttccttccatcaaggctggaaacgacattgcggcctgcctcagaaagaatggcaaaaaggtgatccagctgagccggaaaacatttgattctgaatacgtcaagacccgcaccaacgactgggatttcgtggtgacaaccgacatttccgagatgggggctaattttaaagccgagagagtcatcgatccgcggagatgtatgaagcccgttatccttacagacggagaggaacgcgtgattctggccggccctatgcccgtgacccatagctctgctgcccagcggagagggcgcatcggccggaaccctaaaaatgaaaacgaccagtacatttatatgggagagcccctcgaaaatgatgaggactgcgcgcactggaaggaggctaagatgctgctggataacatcaatacgccggaaggcattatccctagcatgttcgagcccgaaagagagaaagtcgacgccattgatggggaataccgcctccggggagaggccagaaagacatttgtggaccttatgcgcagaggcgatctgcctgtttggctggcttataaagtggccgcggaggggatcaactacgccgaccggcgctggtgtttcgatggaatcaagaacaatcaaattctcgaagagaacgtcgaagtggagatctggaccaaagagggcgaaagaaagaagctgaaaccccggtggcttgacgctcgcatttattccgatcctctggccctcaaggagtttaaagagttcgctgccgggagaaagtctctgacactgaatctcatcaccgagatgggccggcttcccacgttcatgacccagaaaacaagagacgctctggataacctggccgttctccacaccgcggaagccggaggccgcgcttacaatcatgccctgagcgagcttccggagacactggaaaccctcctgctgctcacacttctggctaccgtgacagggggaatttttctgttcctcatgtccggccgggggatcggaaagatgacactgggcatgtgctgcatcattaccgcctctatccttctgtggtatgcccagattcagcctcactggatcgctgcgagcattatcctcgagtttttcctgatcgtcctgctcattcccgaacccgagaagcaaagaacccctcaggacaaccagcttacatacgtggtcatcgccattctgaccgtggttgctgccacaatggccaatgaaatgggctttctggagaaaacgaagaaagacctcgggctgggatccatcgctacccagcaaccggagagcaacattcttgatatcgacctgcgccccgcctctgcgtggacactctacgccgtggctaccacattcgtgacccctatgctgcggcattccattgaaaatagctccgtcaacgtttctctgacggccatcgctaatcaggccaccgtgctcatgggccttgggaagggatggcccctgagcaaaatggatatcggcgtgcctctgctcgcgattgggtgttattcccaggtcaaccccatcacactgaccgccgcccttctgctcctggtggcccactacgctattatcggacctggcctgcaggccaaggctacaagagaggcccaaaagcgggcggccgctggcattatgaaaaatccgaccgttgacgggatcacggtgatcgatctcgaccccattccttatgatcccaagtttgaaaaacagcttggacaggtcatgctgctgatcctctgcgtgacacaagtcctgatgatgcgcaccacatgggccctttgtgaggctctgaccctcgccaccggccctatttctacactgtgggaagggaaccccggaagattctggaatacgaccatcgccgtgagcatggcgaacatttttcggggctcctacctggctggggccggactccttttcagcatcatgaagaatacaaccaacacacgcagaggcaccggcaacatgggggagacgctgggagagaaatggaagtctcggctgaatgctctcggcaaatccgaatttcagatctataaaaagagcgggattcaggaggttgaccgcacactggccaaagaaggaatcaagagaggcgagaccgatcaccatgccgtgtctcgggggtccgctaaacttcgctggttcgtcgagagaaacatggtgaccccggaaggaaaggttgtggacctgggctgcggcagagggggatggagctactattgtggcgggctcaaaaatgtccgggaggtgaagggactgacaaagggcgggcctggacacgaagaacccattcccatgtctacctacggctggaacctggtgcgcctccagagcggcgttgatgtctttttcatccctcccgaaaaatgcgacacacttctgtgtgatattggggagtcctctcctaatccgacggtggaggccggacggaccctgagagtgctcaacctggtcgaaaattggcttaacaataacacacaattctgcatcaaggttctgaatccctacatgcctagcgtgatcgagaaaatggaagcgctccagcgcaagtatggcggggccctggtgcggaaccccctgtccagaaatagcacccatgagatgtactgggtctccaacgcttctggaaatattgtgagctccgttaacatgatctctcgcatgctcattaaccggtttacaatgagacacaaaaaggccacctatgaacctgacgtggaccttggcagcgggacgcgcaatatcggaattgagtccgagatccccaacctggatattatcggcaagcggatcgagaagattaagcaggagcatgaaacctcttggcactacgaccaggatcacccgtataaaacatgggcttaccatggcagctatgagaccaagcaaacagggtccgccagctctatggtcaatggagtggttagactgctcaccaaaccttgggacgtgctgcccacagtcacccagatggcgatgacggatacaacccctttcggccagcagcgcgtgtttaaggaaaaggtggacacccggacacaagagcccaaagaggggacgaagaaacttatgaagatcaccgccgaatggctgtggaaagagctcggaaagaaaaagacacctagaatgtgtacccgcgaagagttcacaagaaaggtccggtccaacgctgccctgggcgctatttttaccgatgagaataaatggaaaagcgcccgcgaagctgttgaggactctagattctgggaactggtggataaagagcggaacctccacctggaagggaagtgcgagacatgtgtgtacaatatgatgggaaaaagagagaagaaacttggcgaatttggcaaagccaaggggtcccgggcgatctggtacatgtggctgggagcccgcttcctcgagtttgaagctctgggcttccttaacgaggaccattggtttagcagagaaaattctctgtccggggtcgagggagagggcctccacaaactggggtatattctgcgggatgtgagcaagaaagaaggcggagccatgtacgctgacgacaccgccggctgggatacgcgcatcaccctcgaggacctgaagaacgaagagatggttacaaatcacatggaaggggagcataagaaacttgccgaggcgatcttcaagctgacctatcagaacaaagtggtcagagtgcagcggcccacaccgcgcggaaccgttatggatattatctccagacgggaccaacgcggcagcgggcaggtcggaacgtacggcctcaatacatttaccaacatggaagctcagctgattagacagatggagggggaaggcgtcttcaagaatatccaacaccttacagtgaccgaggaggttgccgtgaaaaactggctggcccgggtcggacgcgaaagactctctcggatggctattagcggcgatgactgcgtggtcaagcctctggatgaccgcttcgccaacgctctgacggccctcaatgatatggggaagatcagaaaagacatccagcagtgggagccctccaagggatggattgattggacccaggtgcccttttgctctcatcacttccatgaactgatcatgaaagacggccgggttcttgtggtcccttgtagaaaccaagatgagctgattgggcgcgcgcggatcagccagggagccggctggtccctcagagaaacagcttgcctggggaagtcttatgcccagatgtggagccttatgtactttcaccgccgggacctgagactcgctgccaatgcgatttgttccgccgtgccgtctcactgggtgcccaccagccgcacaacctggtccatccatgctaaacacgagtggatgacaaccgaggacatgctgacggtttggaaccgggtgtggattagagaaaatccttggatggaggataagacacccgtcgaaagctgggaggaaatcccttatctgggcaagcgcgaggaccagtggtgcggatctctcatcggcctgacctcccgggccacctgggctaaaaacattcaagccgctatcaatcaggtgagaagccttattgggaacgaggaatacgccgattacatgccctctatgaagcgcttccggagagaggaagaggaagcgggagttctgtggtga

SEQ ID NO: 20085 - RNA, 9876 nt, synthetic construct
  misc_feature 1..9876: note = derived and/or modified CDS sequence (opt5) from DENV-2__FJ410241__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgaaaacaagagtgggcaccaagcatgcgatcctcctggttgccgtgtctttcgtcacacttattaccgggaacatgagctttaaagacctgggacgggtggttgtgatggtcggcgctacgatggccgatgacatcggcatgggggtgacctatctcgccctgctggctgccttcaaggttagacctacatttgcggctggacttctgctccgcaagctgacctccaaagagctcatgatgacaaccattggcatcgtgctgctttctcagagcacgattcccgaaacagtcctggagctcaccgatgccctggccctggggatgatggtgcttcggatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccaacagaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacaacgggctggagtgctgtgggatgttccttctccccctcccatgggcaaggcggaactcgaggacggggcctatcgcattaaacagaagggaatcctgggctactcccagatcggcgctggggtgtacaaggaaggaaccttccacacaatgtggcatgtcaccagaggcgccgtgcttatgcacaaagggaagcggattgagccctcctgggccgatgttaaaaaggacctgatcagctatggaggcgggtggaaactcgagggagaatggaaggagggcgaagaggtgcaggtcctggctctcgaacctggcaagaatccgcgcgccgtgcaaacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgaccagaagcggcgcttatgtctctgccatcgcccagacagagaagtccatcgaggataatcctgaaattgaggacgatatctttcggaagcgcagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccaatccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctcagaaagaatggcaaaaaggtgatccagctgagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaaagagagaaagtcgacgccattgatggggaataccgcctccggggagaggctagaaagacgtttgtggaccttatgcgcagaggcgatctgcctgtttggctggcctataaagtggcggccgaggggatcaactacgctgaccggcgctggtgtttcgatggaatcaagaacaatcaaattctcgaagagaacgtcgaagtggagatctggacaaaagagggcgaaagaaagaagctgaaaccccggtggcttgacgcccgcatttattccgatcctctggctctcaaggagtttaaagagttcgccgctgggagaaagtctctgaccctgaatctcatcacagagatgggccggcttcccaccttcatgacgcagaaaaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaagcaaagaacccctcaggacaaccagcttacctacgtggtcatcgctattctgacagtggttgccgccaccatggctaatgaaatgggctttctggagaaaacaaagaaagacctcgggctgggatccatcgccacgcagcaacttgagagcaacattctggatatcgacctccgcccggcgtctgcctggaccctgtacgctgtggccacaaccttcgtgacacccatgctgcggcattccattgaaaatagctccgtcaacgtttctctcaccgctatcgccaatcaggcgacggtgcttatgggcctggggaagggatggcctctgagcaaaatggatatcggcgtgcccctcctggccattgggtgttattcccaggtcaaccctatcacccttacagctgccctgctcctgctggtggctcactacgccattatcggacccggcctccaggctaaggccaccagagaggcgcaaaagcgggccgctgccggcattatgaaaaatcctacagttgacgggatcaccgtgatcgatcttgacccgattccctatgatcctaagtttgaaaaacagctgggacaggtcatgctgctcatcctgtgcgtgacgcaagtccttatgatgcgcacaacctgggctctgtgtgaggccctcacactggccaccggccccatttctaccctgtgggaagggaaccctggaagattctggaatacaacgatcgcggtgagcatggctaacatttttcggggctcctacctcgccggggctggacttctgttcagcatcatgaagaataccacaaacacccgcagaggcacaggcaacatgggggagaccctgggagagaaatggaagtctcggctcaatgccctgggcaaatccgaatttcagatctataaaaagagcgggattcaggaggttgaccgcacgcttgccaaagaaggaatcaagagaggcgagacagatcaccatgctgtgtctcgggggtccgccaaactgcgctggttcgtcgagagaaacatggtgacccccgaaggaaaggttgtggacctcggctgcggcagagggggatggagctactattgtggcgggctgaaaaatgtccgggaggtgaagggactgaccaagggcgggccgggacacgaagaacctattcccatgtctacatacggctggaacctcgtgcgccttcagagcggcgttgatgtctttttcattccccctgaaaaatgcgacaccctgctgtgtgatattggggagtcctctcccaatcctacagtggaggcgggacggacgctcagagtgctgaaccttgtcgaaaattggctgaacaataacacccaattctgcatcaaggttctcaatccgtacatgcccagcgtgatcgagaaaatggaagccctgcagcgcaagtatggcggggctctggtgcggaaccctctctccagaaatagcacacatgagatgtactgggtctccaacgcctctggaaatattgtgagctccgttaacatgatctctcgcatgcttattaaccggtttaccatgagacacaaaaaggctacatatgaacccgacgtggacctgggcagcgggacccgcaatatcggaattgagtccgagatccctaacctggatattatcggcaagcggatcgagaagatcaagcaggagcatgaaacgtcttggcactacgaccaggatcacccctataaaacctgggcctaccatggcagctatgagacaaagcaaaccgggtccgcgagctctatggtcaatggagtggttagactcctgacaaaaccgtgggacgtgcttcctaccgtcacacagatggccatgaccgatacgacacccttcggccagcagcgcgtgtttaaggaaaaggtggacacccggacccaagagcctaaagaggggacaaagaaactgatgaagatcacggctgaatggctctggaaagagctgggaaagaaaaagacccccagaatgtgtacacgcgaagagttcaccagaaaggtccggtccaacgccgctctgggcgccatttttacagatgagaataaatggaaaagcgctcgcgaagccgttgaggactctagattctgggaactcgtggataaagagcggaacctgcaccttgaagggaagtgcgagacctgtgtgtacaatatgatgggaaaaagagagaagaagctgggcgaatttggcaaagcgaaggggtcccgggccatctggtacatgtggctcggagctcgcttcctggagtttgaagcccttggcttcctgaacgaggaccattggtttagcagagaaaattctctctccggggtcgagggagagggcctgcacaaactggggtatattctccgggatgtgagcaagaaagaaggcggagctatgtacgccgacgacacagccggctgggatacccgcatcacgctggaggaccttaagaacgaagagatggttaccaatcacatggaaggggagcataagaaactggcggaggctatcttcaagctcacatatcagaacaaagtggtcagagtgcagcggcctacaccccgcggaacagttatggatattatctccagacgggaccaacgcggcagcgggcaggtcggaacctacggcctgaatacgtttacaaacatggaagcccagcttattagacagatggagggggaaggcgtcttcaagaatatccaacacctgaccgtgacagaggaggttgccgtgcagaactggctcgctcgggtcggacgcgaaagactgtctcggatggccattagcggcgatgactgcgtggtcaaaccgctggatgaccgcttcgctaacgccctcaccgcgctgaatgatatggggaagatcagaaaggacatccagcagtgggagccttccaaaggatggaacgattggacgcaagtgcccttttgctctcatcacttccatgaacttattatgaaggacggccgggttctggtggtcccctgtagaaatcaggatgagctcatcgggcgcgcccggattagccagggagctggctggtccctgagagaaaccgcctgccttgggaaatcttatgctcagatgtggagcctgatgtactttcaccgccgggacctcagactggccgcgaacgccatctgttccgctgtgccttctcactgggtgccgacaagccgcaccacatggtccattcatgccaagcacgagtggatgaccacagaggacatgctgaccgtttggaatcgggtgtggatcagagaaaacccctggatggaggataaaacgcctgtcgaaagctgggaggaaattccctatctcggcaagcgcgaggaccaatggtgcggatctctgatcggccttacatcccgggctacctgggccaagaatatccaggctgccattaaccaggtgagaagcctgatcgggaatgaggaatacaccgattacatgccttctatgaaacgcttccggagagaggaagaggaagcgggagttctctggtga

SEQ ID NO: 20086 - RNA, 9876 nt, synthetic construct
  misc_feature 1..9876: note = derived and/or modified CDS sequence (opt5) from DENV-2__FJ410259__SS-prME
  source 1..9876: mol_type = other RNA
agcgccggaatgatcattatgctgatccccaccgtgatggctttccacctgaccacgcggaatggggagcctcatatgattgttggaatccaggaaaagggaaagtccctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgttacctgcgctatgtttacatgcaagaaaaacatggaaggcaagatcgtccagcctgagaatctcgaatacacgattgtggtgacaccccactctggggaggagcatgccgtcggaaacgacacaggcaaacacggcatggaaatcaaggtgacccctcagtccagcacaaccgaggcggaactgacggggtatggaaccgttacaatggagtgttctcccagaaccggccttgatttcaatgaaatggtgctgctccaaatggagaacaaagcctggctggtccaccggcagtggtttcttgacctgccgctcccttggctgcccggggctgataagcaggagtccaattggatccagaaggaaacactggtgaccttcaaaaaccctcatgccaagaaacaagacgttgtggtcctcggaagccaggagggcgctatgcacacggccctgacaggggccaccgaaattcagatgtcctctggcaatcttctgtttacaggacatctcaagtgccgcctgagaatggacaaacttcaactgaagggcatgagctactccatgtgtaccgggaagttcaaagtggtcaaggagatcgctgagacccagcacggaacaattgtgatccgggttcagtatgaaggcgatgggagcccctgcaaaattcccttcgagatcatggacctcgaaaagagatacgtgctgggacgcctgatcacggtcaaccctattgtgaccgagaaagattctccggttaacatcgaagcggagcccccttttggcgactcctacattatcattggggtggagcccggccagctcaagctgaattggttcaagaaaggaagctctatcggccaaatgtttgaaacaaccatgagaggggctaagagaatggctattcttggagatacagcctgggacttcggcagcctcgggggagtctttacctccatcggcaaagccctccatcaggtgttcggggctatctatggcgccgcgttttctggagtgagctggacgatgaagattctgatcggcgttattatcacatggattgggatgaactcccgcagcacctctctgtccgtcagccttgtgctcgtgggaatcgtcaccctgtacctgggcgtgatggttcaggctgattctgggtgtgtggtctcctggaaaaataaggagctcaagtgcggaagcggcatcttcattacagacaacgtgcacacctggacagaacagtataaatttcaacctgagtccccctctaagctggccagcgccatccagaaagctcaggaagaggggatttgtggcatccggtccgttacgagacttgagaatctgatgtggaagcagattaccccggaactcaaccacatcctggccgagaatgaagtgaaactgacaatcatgaccggagatattcgcggcatcatgcaagctgggaagcggtctcttagacctcagcccacagagctcaaatacagctggaagacctggggaaaggccaaaatgctgtccacggaaagctataaccagaccttcctgattgacggccctgagacagcggagtgccccaataccaaccgcgcctggaactctctcgaagtcgaggattacgggtttggagtgttcacaaccaacatctggctgaaacttaaagaaaagcaggacgctttttgtgactccaaactgatgagcgccgctattaaggataatcgggccgttcatgcggacatgggctattggatcgagtctgccctcaacgatacatggaagatcgagaaggctagcttcattgaagtgaagaattgccactggcctaaaagccataccctgtggtctaacggcgtcctggagagcgaaatgatcattcccaagaaccttgccgggccggtgtcccaacacaattacagacctggataccacacgcagatcgctggcccctggcatctcgggaaactggagatggacttcgatttttgtgacggaacaaccgtgattgtcaccgaagattgcggcaaccgcgggcccagcctgcggacaaccacggcctctggaaagctcatcacagagtggtgctgtagatcctgcaccctgcctccgcttcggtatcgcggcgaggacggctgttggtacgggatggaaattagacccctgaaggagaaagaagagaatctcgttaacagcctggtgacagccggacacggccaggtggataatttctccctgggggtccttggaatggctctctttctggaagagatgctgcggaccagagtgggcacaaagcatgcgatcctcctggccgctgtttctttcgtgacccttatcacggggaacatgagctttaaagacctgggacgcgtcgtggttatggtgggcgccaccatggccgatgacattggcatgggggtcacatatctcgctctgctggccgcgttcaaggtgcggcctacctttgctgccggacttctgctcagaaaactgacatccaaggagctcatgatgaccacgatcggcattgttctgctttctcaaagcacaatccccgaaaccgtgctggagctcacagatgccctggctctggggatgatggtccttaagattgtgcgcaatatggaaaaataccagctggccgtgaccatcatggcgatcctctgcgtccctaacgctgttattctgcagaatgcctggaaggtgtcctgtaccatcctcgccgtggtctctgtgagccccctgcttctgacatccagccagcagaagacggactggattcctctcgctctgaccatcaagggactgaaccccacagccattttccttaccacactgtctagaaccaataaaaagcggtcctggccgctcaacgaggctatcatggccgttggcatggtgagcatcctggcgtcttccctcctgaaaaatgacattcctatgacggggccccttgtcgccggaggcctgctgacagtgtgctatgttctcaccggccgcagcgctgatctggaacttgagagagccaccgacgtgaagtgggaggatcaggctgaaatctctgggtccagccctattctgtccatcacaattagcgaggacggatctatgagcatcaagaacgaagaggaggaacagaccctcacaattctgatccggacgggcctcctggtcatctccgggctttttcccatttctatcccgattaccgccgccgcttggtacctgtgggaggtgaaaaagcagcgcgcgggagtcctgtgggatgtgccttctccccctcccatgggcaaagccgaactcgaggacggggcttatagaatcaagcaaaaaggcattctgggctactcccagatcggcgccggggtttacaaggaaggaacattccacaccatgtggcatgtgacacggggcgccgtccttatgcacaaggggaaacgcatcgagccctcctgggctgatgtgaagaaagacctgattagctatggaggcgggtggaagctcgagggagaatggaaagagggcgaagaggttcaggtgctggccctcgaacctggcaagaatccgagagcggtccagaccaagcccgggctgtttaaaacgaacaccggaacaatcggcgctgtgtcccttgatttctctcctgggaccagcggatcccccattatcgacaagaaaggcaaggtggttgggctgtacggaaacggcgtcgtgacacggagcggcgcctatgtgtctgccattgctcaaaccgagaaatccatcgaggataatcctgaaatcgaggacgatatttttcgcaagagacggctgacaatcatggacctccaccccggggccggaaagacgaaaagatacctgcctgcgattgtccgcgaagctatcaagcggggccttagaaccctgattctcgccccgacacgcgtggttgccgctgagatggaagaggccctgcgggggctccccatcagatatcagacccctgctattcgcgccgagcataccggacgggaaatcgtggacctgatgtgtcacgcgacattcacgatgagacttctgagccccgtccgcgtgcctaactacaatctgatcattatggatgaggcccatttcaccgaccccgcttctatcgccgctcggggctatatttccacaagagttgaaatgggggaggccgccggcatctttatgaccgctacaccgcctggaagccgggatcccttcccccagtccaacgcgcctattatcgacgaggaacgcgagatccccgaaagatcttggaatagcggccacgagtgggtgaccgattttaaagggaagacggtctggttcgtgccttccattaaagccggaaacgacatcgctgcctgcctccggaagaatggcaagaaagttattcaactgagccgcaagacatttgattctgaatacgtgaaaaccagaaccaacgactgggatttcgtcgtgacaaccgacatctccgagatgggggccaattttaaggctgagcgggtgattgatccgagacgctgtatgaaacccgtcatccttacagacggagaggaacgggttatcctggccggccctatgcccgtgacccatagctctgcggctcagagacgcgggcggattggcagaaaccctaagaatgaaaacgaccagtacatctatatgggagagcccctcgaaaatgatgaggactgcgcccactggaaagaggccaagatgctgctggataacattaatacgccggaaggcatcattcctagcatgttcgagcccgaacgcgagaaggtggacgctatcgatggggaataccggctcagaggagaggcccgcaaaacatttgtcgaccttatgagacggggcgatctgcctgtgtggctggcgtataaggttgccgctgaggggattaactacgccgaccgcagatggtgtttcgatggaatcaaaaacaatcagatcctcgaagagaacgtggaagtcgagatttggaccaaggagggcgaacggaaaaagctgaagccccgctggcttgacgctagaatctattccgatcctctggccctcaaagagtttaaggagttcgctgccgggcggaaatctctgacactgaatctcattaccgagatgggcagacttcccacgttcatgacccaaaagacacgcgacgcgctggataacctggccgtgctccacaccgctgaagccggaggccgggcttacaatcatgccctgagcgagcttccggagacactggaaaccctcctgctgctcacacttctggccaccgttacagggggaatctttctgttcctcatgtccggcagagggattggaaaaatgacactgggcatgtgctgcatcatcaccgcttctattcttctgtggtatgcgcagatccagcctcactggattgccgctagcatcattctcgagtttttcctgatcgtgctgctcatccccgaacccgagaagcagcgcacccctcaagacaaccagcttacatacgtcgtgattgccatcctgaccgtcgtggccgctacaatggccaatgaaatgggctttctggagaagacgaaaaaggacctcgggctgggatccattgcgacccagcagccggagagcaacatccttgatattgacctgcggcccgcctctgcttggacactctacgccgttgctaccacattcgtgacccctatgctgagacattccatcgaaaatagctccgtgaacgtctctctgacggccattgcgaatcaagccaccgttctcatgggccttgggaaaggatggcccctgagcaagatggatatcggcgtgcctctgctcgctatcgggtgttattcccaggtgaaccccattacactgaccgccgcccttctgctcctggtcgcccactacgctatcattggacctggcctgcaggccaaagcgacacgggaggcccagaagcgcgctgccgctggcatcatgaagaatccgaccgtggacgggattacggttatcgatctcgaccccatcccttatgatcccaaatttgaaaagcaacttggacaggtgatgctgctgattctctgcgtcacacaggtgctgatgatgagaaccacatgggccctttgtgaggccctgaccctcgcgaccggccctatctctacactgtgggaagggaaccccggacggttctggaatacgaccattgctgtcagcatggccaacatctttcgcggctcctacctggctggggccggactccttttcagcattatgaaaaatacaaccaacacaagacggggcaccggcaacatcggggagacgctgggagagaagtggaaatctcgcctgaatgccctcggcaagtccgaatttcaaatctataaaaagagcgggattcaggaggtggacagaacactggctaaggaaggaatcaaacggggcgagaccgatcaccatgccgtttctcgcgggtccgcgaaacttagatggttcgtggagcggaacatggtcaccccggaaggaaaagtggttgacctgggctgcggcagagggggatggagctactattgtggcgggctcaagaatgtgcgcgaggtcaaaggactgacaaagggcgggcctggacacgaggaacccattcccatgtctacctacggctggaacctggtgcggctccagagcggcgtggatgtctttttcatccctcccgaaaagtgcgacacacttctgtgtgatattggggagtcctctcctaatccgacggtcgaggccggaagaaccctgcgcgtgctcaacctggtggaaaattggcttaacaataacacacagttctgcatcaaagtcctgaatccctacatgcctagcgttatcgagaagatggaagctctccaacggaaatatggcggggccctggtgagaaaccccctgtcccgcaatagcacccatgagatgtactgggtgtccaacgcttctggaaatattgtcagctccgtgaacatgatctctcggatgctcattaacagatttacaatgcgccacaagaaagccacctatgaacctgacgttgaccttggcagcgggacgcggaatatcggaattgagtccgagatccccaacctggatattatcggcaagagaatcgaaaagattaaacaggagcatgaaacctcttggcactacgaccaggatcacccgtataagacatgggcgtaccatggcagctatgagaccaaacagacagggtccgccagctctatggtgaatggagtcgtgcgcctgctcaccaagccttgggacgttctgcccacagtgacccaaatggctatgacggatacaacccctttcggccagcagcgggtctttaaagaaaaggtggacaccagaacacaggagcccaaggaggggacgaagaaacttatgaaaatcaccgccgaatggctgtggaaagagctcggcaagaagaaaacacctcgcatgtgtaccagagaagagttcacacggaaggtgcgctccaacgctgccctgggcgctatttttaccgatgagaataagtggaaaagcgccagagaagcggtcgaggactctcggttctgggaactggttgataaggagagaaacctccacctggaagggaaatgcgagacatgtgtgtacaatatgatgggaaagcgggagaagaaacttggcgaatttggcaaagccaaagggtcccgcgctatctggtacatgtggctgggagccagattcctcgagtttgaagctctgggcttccttaacgaggaccattggtttagccgggaaaattctctgtccggggtggagggagagggcctccacaagctggggtatattctgcgcgatgtcagcaaaaaggaaggcggagccatgtacgccgacgacaccgcgggctgggatacgagaatcaccctcgaggacctgaaaaacgaagagatggtgacaaatcacatggaaggggagcataagaaacttgctgaggccatcttcaaactgacctatcaaaacaaggttgtgcgggtccagcgccccacaccgagaggaaccgtgatggatattatctcccggcgcgaccagagaggcagcgggcaagttggaacgtacggcctcaatacatttaccaacatggaagcccagctgattcggcagatggagggggaaggcgtgttcaaaaatatccagcaccttacagtcaccgaggaggtggctgttcataactggctggcccgcgtgggaagagaacggctctctcgcatggctattagcggcgatgactgcgtcgtgaagcctctggatgacagattcgccaacgcgctgacggccctcaatgatatggggaaaatccggaaggacatccaacagtgggagccctccaagggatggaacgattggacccaggtccccttttgctctcaccatttccacgaactgattatgaaagacggcagaatccttgtggttccttgtcgcaatcaggatgagctgattgggcgggctagaatcagccaaggagccggctggtccctccgcgaaacagcttgcctggggaagtcttatgcccagatgtggagccttatgtactttcaccggagagacctgcgcctcgcggccaacgctatttgttccgccgtgccgtctcattgggtccccaccagccggacaacctggtccatccacgctaaacatgagtggatgacaaccgaggacatgctgacggtgtggaatagagtgtggattcgcgaaaacccttggatggaggataagacacccgttgaaagctgggaggaaatcccttatctgggcaaacgggaggaccagtggtgcggatctctcatcggcctgacctccagagccacctgggctaagaatattcaggccgcgatcaaccaagtgcgcagccttattgggaatgaggaatacacagattacatgccctctatgaagcggttcagacgggaggaagaggaagccggagtcctgtggtga

SEQ ID NO: 20087 - RNA, 9876 nt, synthetic construct
  misc_feature 1..9876: note = derived and/or modified CDS sequence (opt5) from DENV-2__FJ547067__SS-prME
  source 1..9876: mol_type = other RNA
agcgccggcatgatcattatgctgatccccaccgtgatggctttccacctgacaacgcggaatggggagcctcatatgattgttggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaggacaagcggtttgtgtgcaagcatagcatggtggatcgcggctggggcaatgggtgtggactgttcggcaaagggggaattgttacctgcgctatgtttacatgcaagaaaaacatggaaggcaagatcgtccagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcggcggggtctttacatccatcgggaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccatttctttcgtgacacttatcaccgggaacatgagctttaaggacctgggaagagtcgtggttatggtgggcgctacgatggccgatgacattggcatgggggtcacctatctcgccctgctggctgccttcaaagtgcgccctacatttgcggctggacttctgctccggaagctgacctccaaggagctcatgatgacaaccatcggcattgttctgctttctcagagcacgatccccgaaacagtgctggagctcaccgatgccctggccctggggatgatggtccttaaaatcgtgagaaatatggaaaagtaccagctggctgtgacaattatggccatcctctgcgtccctaacgcggttattctgcagaatgcttggaaagtgtcctgtaccatcctcgccgccgtgtctgtcagccccctgcttctgacctccagccaacagaagacagactggattcctctcgctctgacgatcaaaggactgaaccccaccgccatcttccttacaaccctgtctcgcacaaataagaaaagatcctggccgctcaacgaggctattatggccgtgggcatggttagcatcctggcgtcttccctcctgaagaatgacattcctatgaccgggccccttgtggccggaggcctgctgacggtctgctatgtgctcacaggccggagcgctgatctggaacttgagcgcgccaccgacgttaagtgggaggaacaggctgagatctctgggtccagccctattctgtccatcaccattagcgaagatggatctatgagcatcaaaaacgaggaggaggaacagacactcaccatcctgattagaacaggcctcctggtgatctccgggctttttcccatttctatcccgattacggccgccgcttggtacctgtgggaagtcaagaaacaacgggcgggagtgctgtgggacgtcccttctccccctcccatgggcaaggccgagctcgaagatggggcttatcgcatcaaacagaagggaatcctgggctactcccagattggcgccggggtgtacaaggagggaaccttccacacaatgtggcatgttaccagaggcgccgtgcttatgcacaaagggaagcggatcgagccctcctgggctgacgtcaaaaaggatctgattagctatggaggcgggtggaaactcgaaggagagtggaaggaaggcgaggaagtgcaggttctggccctcgagcctggcaagaatccgcgcgcggtgcaaacaaaacccgggctgtttaagaccaacacgggaaccatcggcgctgtctcccttgacttctctcctgggacaagcggatcccccattatcgataaaaagggcaaagtggtggggctgtacggaaacggcgttgtcaccagaagcggcgcctatgtgtctgccatcgctcagacagagaagtccattgaagacaatcctgagatcgaagatgacatttttcggaagcgcagactgaccatcatggatctccaccccggggccggaaaaacaaagcggtacctgcctgcgattgtgagagaggctatcaaacgcggccttcggacgctgattctcgccccgaccagagtcgtggccgctgaaatggaggaggccctgcgcgggctccccatccggtatcagacccctgctatcagagccgaacataccggacgcgagattgttgacctgatgtgtcacgcgaccttcacaatgcggcttctgagccccgtgagagtccctaactacaatctgatcattatggacgaagcccatttcacggatcccgcttctatcgccgctcgcggctatatttccacccgggtggagatgggggaggccgccggcatctttatgacagctaccccgcctggaagcagagaccccttcccccaatccaacgcgcctatcattgatgaagaacgggaaatccccgagcgctcttggaatagcggccacgaatgggttacagactttaaggggaaaaccgtgtggttcgtcccttccattaaggccggaaacgatatcgctgcctgcctcagaaagaatggcaaaaaggtgattcagctgagccggaaaacgtttgactctgagtacgttaagacacgcaccaacgattgggacttcgtggtcaccacagatatctccgagatgggggccaattttaaagctgaaagagtgatcgacccgcggagatgtatgaagcccgtgattcttaccgatggagaggaacgcgtcatcctggccggccctatgcccgttacacatagctctgcggctcagcggagagggcgcattggccggaaccctaaaaatgagaacgaccagtacatctatatgggagaacccctcgagaatgacgaggattgcgcccactggaaggaagccaagatgctgctggacaacattaataccccggagggcatcattcctagcatgttcgaacccgagagagaaaaagtggatgctatcgacggggagtaccgcctccggggagaggccagaaagacgtttgtggatcttatgcgcagaggcgacctgcctgtctggctggcgtataaagtggccgctgaagggatcaactacgccgatcggcgctggtgtttcgacggaattaagaacaatcaaatcctcgaggaaaacgttgaggtggagatttggacaaaagaaggcgagagaaagaagctgaaaccccggtggcttgatgctcgcatctattccgaccctctggccctcaaggaatttaaagagttcgctgccgggagaaagtctctgaccctgaatctcattacagaaatgggccggcttcccaccttcatgacgcagaaaaccagagatgcgctggacaacctggccgtcctccacacagctgaggccggaggccgcgcttacaatcatgccctgagcgagcttccggaaaccctggagacactcctgctgctcacccttctggccacagtgaccgggggaatctttctgttcctcatgtccggccgggggatcggaaagatgacgctgggcatgtgctgcattatcacagcttctattcttctgtggtatgcgcagatccagcctcactggattgccgctagcatcatcctcgaatttttcctgattgttctgctcatccccgagcccgaaaagcaaagaacccctcaggataaccagcttacctacgtggtcattgccatcctgacagtggtcgccgctaccatggccaatgagatgggctttctggagaaaacaaagaaagacctcgggctgggatccattgcgacgcagcaaccggaaagcaacatccttgacattgatctgcgccccgcctctgcttggaccctctacgccgtggctacaaccttcgttacacctatgctgcggcattccatcgagaatagctccgtgaacgtgtctctgaccgccatcgcgaatcaggccacggtcctcatgggccttgggaagggatggcccctgagcaaaatggacattggcgttcctctgctcgctatcgggtgttattcccaggtgaaccccattaccctgacagccgcccttctgctcctggtggcccactacgctatcattggacctggcctgcaggccaaggcgaccagagaagcccaaaagcgggctgccgctggcatcatgaaaaatccgacagtcgatgggatcaccgtgattgacctcgatcccatcccttatgaccccaagtttgagaaacagcttggacaggttatgctgctgattctctgcgtgacgcaagtcctgatgatgcgcacaacctgggccctttgtgaagccctgacactcgcgaccggccctatctctaccctgtgggaggggaaccccggaagattctggaatacaacgattgctgtgagcatggccaacatctttcggggctcctacctggctggggccggactccttttcagcatcatgaagaataccacaaacacccgcagaggcacaggcaacatgggggagaccctgggagaaaaatggaagtctcggctgaatgccctcggcaaatccgagtttcaggtctataaaaagagcgggattcaggaagtggatcgcacgctggctaaagagggaatcaagagaggcgagacagaccaccatgccgtttctcgggggtccgcgaaacttcgctggttcgtggaaagaaacatggtcaccccggagggaaaggtggttgatctgggctgcggcagagggggatggagctactattgtggcgggctcaaaaatgtgcgggaagtcaagggactgaccaagggcgggcctggacacgaggaacccattcccatgtctacatacggctggaacctggtgcgcctccagagcggcgtggacgtctttttcatccctcccgagaaatgcgatacccttctgtgtgacattggggagtcctctcctaatccgacagtcgaagccggacggacgctgagagtgctcaacctggtggagaattggcttaacaataacacccaattctgcatcaaggtcctgaatccctacatgcctagcgttatcgagaagatggaggctctccagcgcaagtatggcggggccctggtgcggaaccccctgtccagaaatagcacacatgaaatgtactgggtgtccaacgcttctggaaatattgtcagctccgtgaacatgatctctcgcatgctcattaaccggtttaccatgagacacaaaaaggccacatatgagcctgatgttgaccttggcagcgggacccgcaatatcggaattgagtccgaaatccccaacctggacattatcggcaagcggatcgagaaaattaagcaggaacatgagacgtcttggcactacgatcaggaccacccgtataaaacctgggcgtaccatggcagctatgaaacaaagcaaaccgggtccgccagctctatggtgaatggagtcgtgagactgctcacaaaaccttgggatgttctgcccaccgtgacacagatggctatgaccgacacgacacctttcggccagcagcgcgtctttaaggagaaggtggatacccggacccaagagcccaaagaagggacaaagaaacttatgaagatcacggccgagtggctgtggaaagaactcggaagaaagaaaacccctcgcatgtgtacaagagaggagttcacccggaaggtgcgctccaacgctgccctgggcgctatttttacagacgaaaataagtggaaaagcgccagagaggcggtcgaagattctcggttctgggagctggttgacaaggaaagaaacctccacctggaggggaaatgcgagacctgtgtgtacaatatgatgggaaagcgggagaagaaacttggcgagtttggcaaggccaaagggtcccgcgctatctggtacatgtggctgggagccagattcctcgaatttgaggctctgggcttccttaacgaagatcattggtttagccgggaaaattctctgtccggggtggagggagaaggcctccacaagctggggtatattctgcgcgacgtcagcaaaaaggagggcggagccatgtacgccgatgacacagcgggctgggacaccagaatcacgctcgaagatctgaaaaacgaggaaatggtgaccaatcacatggagggggagcataagaaacttgctgaagccatcttcaaactgacatatcagaacaaggttgtgcgggtccagcgccccaccccgagaggaacagtgatggacattatctcccggcgcgatcaaagaggcagcgggcaggttggaacctacggcctcaatacgtttacaaacatggaggcccagctgattcggcagatggaaggggagggcgtgttcaaatctatccaacaccttaccgtcacagaggaagtggctgttcagaattggctggcccgcgtgggaagagagcggctcagccgcatggctatttccggcgacgattgcgtcgtgaagcctctggacgatagattcgccaacgcgctgaccgccctcaacgacatggggaaaatccggaaggatatccagcagtgggaaccctctaagggatggaatgactggacgcaagtccccttttgcagccatcacttccatgagctgattatgaaagatggcagagtgcttgttgtgccttgtcgcaaccaggacgaactgatcgggcgggctagaatttcccagggagccggctggtctctccgcgagaccgcttgcctgggaaagagctatgcccagatgtggtcccttatgtactttcaccggagagatctgcgcctcgcggccaatgctatctgttctgccgtcccgagccactgggtgcccacatcccggaccacatggagcattcatgctaaacacgagtggatgaccacagaagacatgctgaccgtgtggaacagagtttggatccgcgagaatccttggatggaagacaagacgcccgtggagtcttgggaagagattccttatctgggcaaacgggaggatcaatggtgcggatccctcatcggcctgacaagcagagccacctgggctaagaacatccaggccgcgattaatcaggtccgctctcttatcgggaacgaagagtacaccgactacatgccctccatgaagcggttcagacgggaagaggaagaggccggagtgctgtggtga

SEQ ID NO: 20088 - RNA, 9876 nt, synthetic construct
  misc_feature 1..9876: note = derived and/or modified CDS sequence (opt5) from DENV-2__JN819418__SS-prME
  source 1..9876: mol_type = other RNA
acagccggcgtgatcattatgctgatccccacagctatggccttccacctcacgacccggaatggggagcctcatatgattgtcggacggcaggaaaagggcaaatccctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttgtgtgcaagcattccatggtggatagaggctggggcaacgggtgtggactgttcggcaaagggggaattgtcacatgcgccatgtttacgtgcaaaaagaatatggaaggcaaagttgtgctccctgagaacctggaatacaccatcgtgattacaccccacagcggggaggagcatgcggtcggaaatgacaccggcaagcacggcaaagaaatcaagatcacacctcagtcttccattaccgaggccgaacttacggggtatggaaccgtgacaatggagtgtagcccccggaccggcctggatttcaacgaaatggttctcctgcagatggaggacaaggcttggcttgtgcaccgccaatggtttctggatctcccgctgccttggctgcccggggccgacacacagggatctaattggatccagaaggagaccctcgtcacgttcaagaaccctcatgctaaaaagcaggacgtggttgtgctgggctcccaagaaggggccatgcacacagcccttaccggcgctacagagattcagatgagctccggaaatctgctctttaccggccatctgaaatgcagacttcggatggataagctgcagctcaaagggatgtcttacagcatgtgtaccggaaagttcaagatcgtcaaagaaattgcggagacacaacacggcacgatcgtgatcagagtccagtatgagggggacggatccccctgcaagattcccttcgaaatcatggatctggagaaacgccatgtgctgggccggctcattaccgttaaccctatcgtgacagaaaaggacagcccggtcaacattgaggccgaacccccttttggggattcttacatcattatcggcgtggagcccggacagctgaaacttaattggttcaagaagggctccagcatcgggcagatgtttgagaccacaatgagaggagctaaacgcatggccattctgggcgacaccgcctgggatttcgggtctctcggaggcgtttttacgagcatcgggaaggctctgcaccaagtgttcggcgccatttacggagcggctttttccggcgtctcttggacaatgaaaatcctgattggggtgatcatcacctggattggaatgaacagccggtccaccagcctttctgtgtccctcgttctggtcggcgtggtgacactgtatctcggggccatggtccaggccgacagcggatgtgtggtttcttggaagaataaagaactgaagtgcggctccgggatcttcattaccgataacgtgcacacatggacggagcagtacaagtttcagcctgaaagcccctccaaacttgcttctgccatccaaaaggctcatgaggaaggcatttgtggaatcagaagcgtcacccgcctggagaatctcatgtggaaacagatcacaccggagctgaaccacattctgtccgaaaatgaggtgaaacttaccatcatgacaggcgacattaaagggatcatgcaggccggaaagcggtctctcagacctcagcccaccgaactgaaatatagctggaagacgtggggcaaggcgaaaatgctgtccaccgagagccataaccaaacattcctcattgatgggcctgaaaccgccgagtgccccaatacaaaccgcgcttggaactctctggaggttgaagactacggatttggcgtgttctccaccaacatctggcttaagctgcgggagaaacaggacgtcttttgtgatagcaagctcatgtctgccgctatcaaagacaatagagccgtgcacgcggatatgggctattggattgaatccgccctgaacgacacatggaagatggagaaggctagcttcatcgaggttaaatcttgccactggcctaagagccataccctgtggtccaatggggtgcttgaaagcgagatgattatccccaaaaacttcgccggaccggtctctcagcacaactaccgccctggctatcatacgcagacagctgggccctggcacctcggaaagctggaaatggattttgacttctgtgagggcaccaccgtggtggtcacagaagattgcgggaatcggggaccctccctgagaaccacgacagccagcggcaaactcattaccgagtggtgctgtcggtcctgcacactgcctccgcttcgctacagaggcgaggacgggtgttggtacggaatggaaatccggcccctgaaggagaaggaagagaacctcgttaattctctggtgaccgccggccatgggcaaattgataactttagcctgggagtgcttggcatggctctcttcctggaagagatgctgagaacacgcgtcgggaccaaacacgcgatcctcctggtggccgtttcctttatgacgcttatcaccggaaatatgtctttccgggacctgggcagagtgatggtcatggtgggcgctacaatgaccgatgacattgggatgggagttacatatctcgccctgctggccgcttttaaggtgcgccctaccttcgccgcgggccttctgctcagaaaactgacgagcaaggagctcatgatggctacaatcgggattgccctgctttcccagtctaccatccccgaaacaattctggagctcaccgatgccctggctctgggaatgatggtccttaaaatcgtgcggaacatggaaaagtaccagctggccgttaccatcatggcgattagctgcgtgcctaatgctgtcatcctccaaaacgcctggaaggtgtcctgtacaattctggccgctgtgagcgtctctcccctcctgcttacgtccagccagcagaaagccgactggatccctctggctctcaccattaagggcctgaatcccacagccatctttctgaccacactttctcgcacctccaaaaagagaagctggccgctgaacgaggcgatcatggccgttgggatggtgtctattctcgcttccagcctgctcaaaaatgacatccctatgacgggacccctggtggccggcggccttctgacagtctgctatgtgctgaccgggcggtccgctgatctcgaactggagcgcgccgccgacgttaagtgggaggatcaggctgaaattagcggatctagccctatcctttccattaccatctctgaggacggcagcatgtccattaaaaacgaagaggaggaacaaacactgaccatcctcatcagaacagggctgctcgtgatttctggactgttccccgtcagcatcccgattacggcggccgcttggtacctttgggaggtgaagaagcagcgggccggcgttctgtgggatgtgccttctccccctcccgtcgggaaagccgaactggaggacggagcttatcgcatcaagcagagaggcattctcggctacagccagatcggggccggagtgtataaagaaggcacctttcacacaatgtggcatgtcaccagaggggcggtgctgatgcaccgcggaaagagaatcgagcccagctgggctgatgttaaaaaggaccttatttcctacggcgggggatggaagctggagggcgaatggaaagagggcgaagaggtgcaagtcctcgccctggaacctgggaagaatccgcgggccgtgcagacaaaacccggactcttcaagaccaacacgggcaccatcggggctgttagcctggatttttctcctggaacatccggcagccccattgtggacagaaaagggaaggtcgtgggactttacggcaatggcgtggttacccgctctggggcctatgtctccgcgatcgctcagacagaaaagagcattgaggataaccctgaaatcgaggacgatatcttccggaaaaagagactgaccattatggacctgcatcccggagccggcaaaacaaagcgctacctccctgccatcgtgcgggaagctattaaaagagggctgcgcacgcttatcctggccccgacccgggtggtcgctgccgagatggaagaggcgctcagaggactgcccattcgctatcagacccctgccatccgggctgagcacaccggcagagaaattgtggacctcatgtgtcatgccaccttcacaatgcggctgctttcccccgttcgcgtgcctaactacaatctgatcatcatggatgaggctcactttacggaccccgcctctattgccgctagagggtatatcagcacccgggtcgaaatgggcgaggcggccggaattttcatgacagctaccccgcctggctcccgcgatccctttccccaaagcaacgcccctatcatggacgaggaaagagagattcccgaacggtcttggaactccgggcacgagtgggtgacagatttcaagggaaagaccgtttggtttgtgcctagcatcaaagccggcaacgacatcgctgcctgcctgagaaagaatgggaaaaaggtcattcagctctctcgcaaaacgttcgatagcgaatacgtgaagacacgggcgaacgactgggattttgttgtgaccaccgacatctccgagatgggagctaatttcaaggccgagagagtcattgatccgcgccggtgtatgaaacccgtgatcctgacagacggcgaagagagagtgattcttgccgggcctatgcccgtcacccattctagcgctgcccagcgccggggcagaatcggacgcaaccctaagaatgaaaacgaccaatatatctacatgggcgagcccctggaaaatgatgaggactgcgcgcactggaaagaggccaagatgctcctggataacattaatacaccggaagggatcattccttccatgtttgagcccgaaagagagaaagttgacgctatcgatggagaataccggctgcgcggcgaggccagaaagaccttcgtggacctcatgcggcgcggggatcttcctgtgtggctggcttatagagtcgccgctgagggaattaactacgccgaccggagatggtgttttgatggcatcaaaaataaccagattctggaagagaacgtggaagttgagatctggacgaaggagggggaacgcaagaaactcaagccccggtggctggacgcgagaatctattctgatcctcttgccctgaaagagttcaaggagttcgctgccggccgcaaaagcctcacactgaatctgattaccgagatgggacggctccccacatttatgacccagaaggctagagacgcccttgataacctggccgtgctgcatacggctgaagcgggcgggcgggcctacaatcacgctctctccgagctgccggagacccttgaaacactgctcctgctgaccctccttgccacagtcaccggaggcatcttcctgtttctgatgagcgggaagggaattggcaaaatgacactcggcatgtgctgcatcattaccgcctctatcctgctttggtatgctcagatccaacctcactggattgccgcgtccatcattctggagttctttctcatcgtgctgctgattcccgaacccgagaagcagcgcacgcctcaggacaaccagctcacatacgttgtgatcgccatccttaccgtcgtggctgccaccatggctaatgaaatggggttcctggagaaaacaaagaaagacctgggactcggcagcattaccacacaagagtccgaatctaacatcctggatattgaccttagaccggccagcgcgtggacgctgtatgccgtcgctaccacatttgtgacccccatgctccggcattccatcgaaaattctagcgttaacgtgtccctgacagccattgctaatcaggccaccgtgctgatggggctcggaaagggctggcctcttagcaagatggatatcggggtccccctgctggctattggatgttactctcaggttaaccctatcacgctcaccgccgcgctgcttctgctcgtggcccactacgctatcattggccccggcctgcaggccaaagctacacgcgaagcccaaaagagagccgcggctgggatcatgaaaaatcctaccgtggacggaattacagtcatcgatctggacccgattccctatgatcctaagttcgagaaacagctcggccaggtgatgcttctgatcctgtgcgttacccaggtgctcatgatgcggacgacatgggccctgtgtgaagctcttaccctggccacagggcccatctccaccctctgggagggaaaccctggccgcttttggaataccacaattgccgtcagcatggctaacatcttcagagggtcttacctggccggagcgggcctgctcttttccattatgaagaatacgaccaacacacggcgcggcaccgggaatatcggagagacacttggcgaaaagtggaaaagcagactgaacgccctggggaagtctgagttccaaatttataaaaagagcggaatccaggaagtggaccggaccctcgctaaagagggcatcaagagaggggagacggatcatcacgccgtctcccgcggatctgctaaactgcggtggtttgtggaaagaaacatggttacacccgagggcaaggtggtcgaccttggctgcgggcgcggaggctggagctactattgtgggggactgaagaatgtgcgggaagttaaaggcctcaccaaagggggaccgggccatgaggaacctattcccatgtccacctacggctggaacctggtgagactgcagagcggggtcgatgtgttcttcacaccccctgagaaatgcgacaccctcctttgtgatatcggagagtcctctcccaatcctacaattgaagccggccgcacgctgcgggtgctgaacctcgttgagaattggctgaacaataacacccaattttgcatcaaggtccttaatccgtatatgcccagcgtgattgagaagatggagacactgcagagaaagtacgggggagcgctcgtgcgcaaccctctgtccagaaattctacccacgaaatgtactgggtcagcaacgccacaggcaatatcgtttcctctgtgaacatgatcagcagaatgctgattaatcgcttcaccatgaagcacaaaaaggctacgtatgagcccgacgtggacctcgggtccggaacccggaacatcggcattgagagcgaaatccctaaccttgatattatcggcaaaagaattgagaagatcaaacaggaacatgagacatcttggcactacgaccaggatcatccctataagacctgggcctaccacgggtcctatgaaacaaagcaaaccggaagcgcttcttccatggtcaatggcgtggttcgcctgctgacaaaaccgtgggacgtggtccctatggtgacccagatggccatgacggatacaaccccctttgggcagcagagagttttcaaggagaaagtggacacccggacacaagagcctaaggaaggaacgaaaaagctcatgaagatcaccgctgagtggctgtggaaagaacttggcaagaaaaagacaccccgcatgtgtaccagagaggagtttacacggaaagtcagaagcaacgccgcgctgggggccattttcaccgatgaaaataagtggaaatctgctcgggaggccgtggaagacggacgcttttgggagctcgtggatagagaacggaacctgcacctggagggcaagtgcgagacatgtgtctacaatatgatgggcaagcgcgagaagaagctcggggagttcggaaaagctaagggctccagagccatctggtatatgtggctgggggcccggtttcttgagttcgaggcgctgggatttctcaacgaagaccattggttcagccgcgaaaattccctgagcggcgttgagggggaaggccttcacaaactgggatacattctcagagatgtgtctaagaaggagggcggggctatgtacgccgacgacaccgccggatgggatacgcggatcaccctggaagacctgaaaaacgaggaaatggtgacaaatcatatggagggcgagcacaagaaactcgctgaagccatttttaagctgacctatcagaacaaagtcgtgcgcgttcagagacctacaccccgggggaccgtgatggatatcatcagccgcagagaccagcggggatccggccaagtcgggacgtacggccttaatacattcaccaacatggaggctcagctgattcgccagatggaaggagagggcatcttcaagtctattcaacatctcacagtgaccgaggaaatcgccgttcagaattggctggcgagagtggggcgggagagacttagccgcatggccatttccggagatgactgcgtcgtgaagccgctggatgaccggtttgcttctgccctcacggctctgaacgatatgggcaaagttagaaaggacatccagcagtgggaacctagccgcgggtggaatgattggacccaagtgcccttctgctcccaccactttcatgagctgatcatgaaagacggacgggtcctcgtggtcccctgtagaaaccaggatgaactgattggccgcgcccggatctctcagggggcgggctggagccttaaggagacagcctgcctgggaaaatcctatgctcagatgtggaccctcatgtacttccacagacgcgacctgcggcttgccgctaacgccatttgtagcgctgtgccttctcattgggttccgacatccagaaccacatggagcatccacgccaagcacgagtggatgaccacggaagacatgctggcggtgtggaatcgcgtctggattcaagagaacccctggatggaagataagacacctgtggagtcttgggaagaggtgccctatctcggcaaacgggaggaccagtggtgcgggtccctgatcggactgaccagcagagccacctgggctaagaatattcagacagccatcaaccaggttcggtccctcatcggcaatgaagagtacaccgattatatgccttctatgaaaagatttcgccgggaagaggaagaggccggggtgctgtggtga

SEQ ID NO: 20089 - RNA, 9876 nt, synthetic construct
  misc_feature 1..9876: note = derived and/or modified CDS sequence (opt5) from DENV-2__EU482640__SS-prME
  source 1..9876: mol_type = other RNA
acagccggaatcattatcatgatgattcccacagtgatggctttccacctgacgacccggaatggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacaacggtcgccccttccatgaccatgcggtgcatcggaatttctaaccgcgactttgtggaaggcgttagcgggggatcctgggtggatatcgtcctggagcacggcagctgtgtgacaaccatggcgaaaaataagcccacactcgacttcgaactgatcaagaccgaggccaaacaccctgctacgcttagaaagtactgcattgaagccaaactgacaaacaccaccacagcttctcggtgtccgacccagggggagccctccctcaatgaggaacaagataagcgctttgtgtgcaaacatagcatggtcgacagaggatggggcaacggctgtgggctgttcggaaagggcgggatcgttacatgcgccatgtttacgtgcaagaaaaatatggagggaaagattgtgcagcctgaaaacctggagtataccatcgtgattacaccccactctggcgaagagaatgcggtcgggaacgataccggaaaacatggcaaggagatcaaagtgacacctcagtccagcatcaccgaagccgagctcacgggctacgggaccgttacaatggaatgttctccccggaccggactggacttcaatgagatggtgcttctgcagatggaaaacaaggcttggctcgtccaccgccaatggtttctggatcttccgctgccttggctccccggcgccgacacacaggggtccaactggattcagaaagagaccctggtgacgttcaagaatcctcacgctaagaaacaggatgttgtggtcctgggaagccaagagggcgccatgcatacagccctcaccggggctacagaaatccagatgtcctctggcaacctgctttttaccggacacctgaagtgcagactccggatggacaaactgcagcttaagggcatgagctattccatgtgtaccgggaaattcaaggtggtcaaggagattgcggaaacacaacatggaacgatcgtgattagagttcagtacgagggcgacgggagcccctgcaaaatccccttcgagatcatggatctggaaaagcgccacgtgctcggacggctgattaccgtcaatcctatcgtgacagagaaagactctccggttaacattgaagccgagcccccttttggcgattcctacatcattatcggggtggaacccggccagctgaagctcagctggttcaaaaagggatctagcattggccagatgtttgagaccacaatgagaggggctaagcgcatggccatcctgggagacaccgcctgggatttcggctcccttgggggagtctttacgtctatcggcaaagctctgcatcaagtgttcggggccatttatggcgcggcttttagcggagtgtcctggacaatgaagatcctcattggcgttgtcatcacctggattgggatgaatagccggtctacctccctgagcgtgtctctggtgcttgtcggagtggttacactctacctgggcgtgatggtccaggccgactccgggtgtgtggttagctggaaaaacaaggagctgaaatgcggatccggcatcttcatcaccgataatgtgcacacatggacggaacagtataagtttcagcctgagtctcccagcaagctcgcctccgctattcaaaaagcccacgaagaggggatctgtggcattagatctgtcacccgcctggaaaaccttatgtggcggcagatcacaccggagctgaatcatattctcagcgagaacgaagtgaagctgaccatcatgacaggagacatcaaaggcattatgcaggctgggaagagatccctgcgccctcagcccaccgagcttaaatacagctggaaggcctggggaaaagcgaagatgctctctacggaactgcacaatcataccttcctgatcgatggccctgagacagccgaatgccccaacaccaatcgggcttggaactccctcgaggttgaggactatgggtttggagtgttcacaaccaatatttggctgaaacttaaagaaagacaagatgtcttttgtgacagcaagctgatgtctgccgctatcaaagactcccgcgccgtgcacgcggatatgggctactggattgagagcgccctcaacgacacatggaagatcgaaaaggcttctttcatcgaggtcaagagctgccactggcctaagtcccataccctgtggagcaacggcgtgctggagtctgaaatgattatccccaaaaatttcgccgggccggtttcccagcacaactatcggcctggataccatacgcagacagctggcccctggcaccttgggagactcgagatggattttgacttctgtgaaggaaccaccgtggtggtcacagaggattgcggcaatcgggggcccagcctgcgcaccacgacagcctccggaaagctgattaccgaatggtgctgtagatcttgcacactccctccgctgcggtacagaggcgaggacggctgttggtatgggatggagatccgcccccttaaagaaaaggaggaaaacctggtgaatagcctcgttaccgccggacatggccagattgataacttttccctgggggtgctgggaatggctcttttcctcgaggaaatgctgcggacaagaatcggcaccaaacacgcgattctgctcgtcgccgtgtcttttgttacgctgatcaccgggaatatgagcttccgcgaccttggaagagtgatggtcatggtgggcgctacaatgaccgatgacatcggcatgggggttacatacctggccctcctggccgcttttaaggtgcggcctaccttcgccgcgggactgcttctgcgcaagctcacgtccaaagagctgatgatgacaaccattggcatcgtcctcctgtctcaaagcacagtgcccgagaccattcttgaactgaccgatgctctcgccctggggatgatggtgctgaagatcgtcagaaacatggagaaatatcagcttgccgttacaattatggctatcctgtgcgtgcctaatgccgtgatcctccagaacgcgtggaaggtctcctgtacgaccctggctgtggttagcgtgtctcccctcctgcttacatccagccggcaaaaagccgactggattcctctggccctcaccatcaagggactgaatcccacagctatttttctgaccacgctttctcgcacatccaagaaaagaagctggccgctgaacgaagccatcatggctgtcggcatggtgtctattctcgcctccagcctgctcaagaatgatatccctatgaccgggcccctggttgcgggaggccttctgaccgtgtgctacgtcctgacaggccggtccgccgacctcgagctggaacgcgctgccgacgtgagatgggaggagcaggctgaaatcagcgggtctagccctattctttccatcaccatttctgaggatggaagcatgtccatcaaaaacgaagaggaggaacagacactgacgattctcatccggaccggcctgctcgtcatttctgggctgttccccgtgagcatcccgatcacagccgccgcttggtatctttgggaggttaagaaacagcgcgcgggagtgctgtgggacgtcccttctccccctcccgtgggcaaggccgaactggaggatggggcttacagaattaaacaaaagggaatcctcggctatagccagattggcgccggggtttacaaggaaggaacctttcacacaatgtggcatgtgacccggggcgccgtcctgatgcacaaagggaagagaatcgagcccagctgggctgacgtgaaaaaggatcttatttcctacggaggcgggtggaaactggagggagaatggaaggagggcgaagaggtgcaggttctcgccctggaacctggcaagaatccgcgcgcggtccagacgaaacccggactcttcaagaccaacacaggaaccatcggcgctgtgagcctggacttttctcctgggacatccggaagccccatcgtggataaaaagggcaaagtcgtggggctttatggaaacggcgttgtgacccggtctggcacatacgtctccgccattgcccaaacggaaaagtccatcgaggacaatcctgaaattgaggatgacatcttcagaaagaaacgcctgaccattatggatctgcatcccggggctggaaagacaaaacggtatctccctgccatcgtgagagaagcgatcaagcgcggcctgcggacccttattctggctccgaccagagttgtggccgccgagatggaagaggctctccgcgggctgcccatccggtaccagacccctgccattagagctgagcacacgggacgggaaatcgtcgacctcatgtgtcatgccaccttcacaatgcgcctgctttcccccattagagtgcctaactataatctgatcattatggatgaggcgcactttaccgaccccgcctctatcgctgcccggggctacatcagcacacgcgttgaaatgggggaggctgccggcattttcatgaccgccacgccgcctggatccagagacccctttccccagagcaacgctcctatcatggatgaggaacgggagattcccgaaagatcttggaactccggccacgagtgggtgacagacttcaaagggaagaccgtctggtttgtgcctagcatcaaggcgggaaacgatattgccgcttgcctgcgcaaaaatggcaagaaagtgatccagctctctcggaagaccttcgacagcgaatatatcaaaacaagaaccaacgattgggactttgtcgttacaaccgatatttccgagatgggggccaatttcaaggccgagcgcgtgatcgacccgcggagatgtatgaagcccgtgattctgacggatggagaagaacgcgtcatccttgctggccctatgcccgtgacacattctagcgccgcgcaacggagagggcgcgttggcagaaaccctaaaaatgaaaacgaccagtacatttacatgggagagcccctggaaaatgatgaggactgcgctcactggaaggaggccaaaatgctcctggacaacatcaataccccggaaggcatcattccttccatgtttgagcccgaacgggagaaggtggatgccatcgacggggaatatcgcctgagaggagaggctcggaaaacattcgtcgatctcatgcgcagaggcgaccttcctgtgtggctggcctaccgggttgcggccgaggggattaactatgctgatagacgctggtgttttgacggagtgaagaacaatcagatcctggaagagaacgtcgaagtggagatttggaccaaagagggcgaacggaagaagctcaaacccagatggctggatgcccgcatctactctgaccctcttgctctgaaggagttcaaagagttcgccgctgggagaaagagcctcacgctgaatctgattaccgagatgggcagactccccacatttatgacccaaaaagcccggaacgcgcttgataatctggccgtcctgcatacagctgaagccggaggccgcgcttataaccacgccctctccgagctgccggagacccttgaaacactgctcctgctgaccctccttgccacggtgacagggggaatcttcctgtttctgatgagcggcaaggggatcggaaagatgaccctcggcatgtgctgcattatcaccgcttctattctgctttggtacgcgcagatccagcctcactggattgccgcttccatcatcctggagttctttctcattgttctgctgatccccgaacccgagaaacagagaacacctcaagacaatcagctcacctatgtggtgattgccatccttacagtcgttgccgctacgatggccaacgaaatgggcttcctggagaagaccaaaaaggattttgggctgggaagcattacaacccagcagccggagtccaatatcctcgacatcgatctgcggcccgcgtctgcctggacactttacgctgtggccaccacgttcattacccctatgctgcgccatagcatcgaaaactcctctgtgaatgtcagcctcacagctattgccaaccaagcgaccgtgctgatgggcctggggaaaggatggcccctctccaagatggacatcggcgttcctcttctggccattgggtgttacagccaggtgaatcccatcacactgaccgctgccctcctgcttctggtcgctcactatgccattatcggacctggcctccaggctaaggccacgagagaggcgcagaaacgggccgctgccggcatcatgaagaacccgacagtggacgggattaccgtcatcgatctggaccccattccttacgatcccaaatttgaaaagcaactgggacaggtgatgctccttgttctgtgcgtgacacaggtcctgatgatgcgcaccacctgggctctctgtgaggccctgacacttgccacgggccctatctctaccctgtgggaagggaatcccggaagattctggaacacaaccattgcggtgtccatggctaatatctttcggggcagctatctcgccggggctggactgctgttctctatcatgaaaaacacagccaacacccgcagaggcacgggcaatacaggggagaccctcggagagaagtggaagaaccggcttaatgccctgggcaaatccgaatttcagatttacaagaaaagcgggatccaagaggttgacagaaccctggctaaggaaggaattaaacgcggcgagacagatcatcacgccgtgtctcgggggagcgcgaagctcagatggttcgtcgagcgcaacctggtgaccccggaaggaaaagtggttgaccttggctgcggcagaggcgggtggtcctattactgtggagggctgaagaatgtcaaggaggtgaaagggctcacaaagggcgggcctggacatgaggaacccatccccatgtctacgtatggctggaacctggtgagactgcagagcggcgtcgatgttttctttacccctcccgaaaaatgcgacacactcctttgtgatattggggagtccagccctaatccgaccgtggaggccggacgcacactgcgggtgctgaacctcgtcgaaaattggctgaacaataacacccagttctgcatcaaggtgcttaatccctacatgccttccgttatcgagaaaatggaagctctgcaaagaaagtacggcggggccctcgtgcgcaaccccctgtctcggaatagcacgcacgagatgtattgggtctccaacgcttctggaaacattgtgagctccgttaatatgatctctagaatgctgattaaccgctttaccatgcggcacaagaaagccacatacgaacctgacgtggatctcggcagcgggaccagaaatatcggaattgagtccgagacacccaaccttgacatcatcggcaagcgcattgagaagatcaagcaggagcatgaaaccagctggcactatgatcaggaccatccgtacaaaacatgggcgtatcacggctcttacgagaccaagcagacggggtccgccagctctatggtcaatggagtggtgagactgctgacaaagccttgggacgtcattcccatggttacccaaatggctatgaccgatacaacgcctttcggccagcagcgggtgtttaaagaaaaggtggacacccgcacacaggagcccaaagaggggaccaagaaactcatgaagatcacagccgaatggctgtggaaggagcttggcaaaaagaaaacccctagaatgtgtacacgggaagagttcaccagaaaggtccggtccaacgctgccctgggcgctatttttacggatgagaataaatggaaaagcgcccgcgaagcggtggaggactctgggttctgggaactcgttgataaagagagaaacctgcacctggaaggaaagtgcgagacctgtgtgtataatatgatgggcaagcgggagaaaaagctcggcgaatttgggaaagccaagggatcccgcgctatctggtacatgtggctgggcgccagattccttgagtttgaagctctggggttcctcaacgaggaccattggtttagccgggaaaattccctgagcggagtcgagggcgaggggcttcacaaactgggctacattctccgcgatgtgtctaagaaggaaggaggcgccatgtatgccgacgatacagcggggtgggacaccagaatcacactggaggatctgaaaaacgaagagatggttaccaatcatatggaaggagagcacaagaaactcgctgaggccatcttcaagctgacgtaccaaaacaaagtggtccgggtgcagcgccccacaccgagaggcaccgttatggacattatcagccggcgcgaccagagagggtccggacaggtggtcacatatggccttaataccttcacgaacatggaagcccaactgattcggcagatggagggggaaggcgtgtttaagtctatccagcaactcaccgtcacagaggagattgctgtgaagaactggctggcccgcgttggaagagaacggcttagcagaatggctatctccggcgatgactgcgtggtcaaacctctggatgaccgcttcgcctctgcgctcaccgccctgaatgatatggggaaggtgcggaaagacatccagcagtgggagcccagcagaggatggaacgattggacacaggtgcccttttgctcccatcacttccacgaactgattatgaaggacggccgcgttctcgtggtcccttgtcggaatcaagatgagctgatcgggagagctcgcatttctcagggagccggctggagcatgcgggaaaccgcttgccttgggaaatcctacgcccagatgtggagcctgatgtattttcatagacgcgacctccggctggcggccaacgctatctgttctgccgtgccgtcccactgggttcccacaagcagaaccacgtggtctattcatgctacacacgagtggatgaccaccgaggatatgcttacagtgtggaatcgcgtctggatccaggaaaacccttggatggaggacaagacccccgtggaatcctgggaggaaatcccttacctgggcaagcgggaggatcaatggtgcggaagcctcattggcctgacatccagagccacgtgggctaaaaatatccagaccgccattaaccaggtccggtctctgatcgggaatgaggaatatacagactacatgcccagcatgaagagattccgccgggaggaagaggaagcgggagtgctctggtga

SEQ ID NO: 20090 - RNA, 9876 nt, synthetic construct
  misc_feature 1..9876: note = derived and/or modified CDS sequence (opt5) from DENV-2__EU482641__SS-prME
  source 1..9876: mol_type = other RNA
agcgccggaatgatcattatgctgatccccaccgtgatggctttccacctgacaacgcggaatggggagcctcatatgattgtcggaatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccatcacaggggagcaccgcagagaaaagcggtccgtggcgctcgtccctcatgtgggaatgggcctggagacccgcacagaaacctggatgtctagcgagggcgcttggaaacacgcccagagaattgagacgtggatcctgcggcatcccgggttcacaattatggccgctatcctcgcctacaccattggaacaacccactttcagcgcgttctgatcttcattcttctgaccgctgtggccccttccatgacaatgagatgcatcggcatctctaaccgggattttgtcgaaggggtgagcggaggctcctgggttgacattgtgctcgagcacgggagctgtgtcacgaccatggcgaagaataagcccacactggatttcgaacttatcaaaaccgaggccaagcagcctgctacactgcgcaaatattgcattgaagccaagctcaccaacacgacaaccgagtctagatgtccgacccaaggagagccctccctgaaagaagaacaagacaagcggtttgtgtgcaagcatagcatggtggatcgcggctggggcaatgggtgtggactgttcggcaaagggggaatcgtcacatgcgctatgtttacctgcaagaaaaacatggaaggcaagattgttcagcctgagaatctcgaatacacaatcgtggtgacgccccactctggggaggagcatgccgtcggaaacgacaccggcaaacacggcatggaaatcaaggtgacacctcagtccagcattaccgaggcggaactgacagggtatggaaccgttacgatggagtgttctcccagaaccggccttgatttcaatgaaatggtgctgctccaaatggagaacaaagcctggctggtccaccggcagtggtttcttgacctgccgctcccttggctgcccggggctgataagcaggagtccaattggatccagaaggaaacactggtgaccttcaaaaaccctcatgccaagaaacaagacgttgtggtcctcggaagccaggagggcgctatgcacacagccctgaccggggccacggaaattcagatgtcctctggcaatcttctgtttacaggacatctcaagtgccgcctgagaatggacaaacttcaactgaagggcatgagctactccatgtgtaccgggaagttcaaagtggtcaaggagatcgctgagacacagcacggaaccattgtgatccgggttcagtatgaaggcgatgggagcccctgcaaaatccccttcgagattatggacctcgaaaagagatacgtgctgggacgcctgatcaccgtcaaccctattgtgacagagaaagattctccggttaacatcgaagcggagcccccttttggcgactcctacattatcattggggtggagcccggccagctcaagctgaattggttcaagaaaggaagctctatcggccaaatgtttgaaacgaccatgagaggggccaagagaatggctatccttggagatacagcctgggacttcggcagcctcgggggagtctttacctccattggcaaagccctccatcaggtgttcggggctatctatggcgccgcgttttctggagtgagctggacaatgaagattctgatcggcgttattatcacctggatcgggatgaactcccgcagcacgtctctgtccgtcagccttgtgctcgtgggaattgtcacactgtacctgggcgtgatggttcaggctgattctgggtgtgtggtctcctggaaaaataaggagctcaagtgcggaagcggcatcttcattaccgacaacgtgcacacctggacagaacagtataaatttcaacctgagtccccctctaagctggccagcgccatccagaaagctcaggaagaggggatttgtggcatccggtccgttaccagacttgagaatctgatgtggaagcagatcacaccggaactcaaccacattctggccgagaatgaagtgaaactgacgatcatgaccggagatattcgcggcatcatgcaagctgggaagcggtctcttagacctcagcccacagagctcaaatacagctggaagacctggggaaaggccaaaatgctgtccacagaaagctataaccagaccttcctgattgacggccctgagacggcggagtgccccaataccaaccgcgcctggaactctctcgaagtcgaggattacgggtttggagtgttcacaaccaacatctggctgaaacttaaagaaaagcaggacgctttttgtgactccaaactgatgagcgccgctatcaaggataatcgggccgttcatgcggacatgggctattggattgagtctgccctcaacgatacatggaagatcgagaaggctagcttcattgaagtgaagaattgccactggcctaaaagccataccctgtggtctaacggcgtcctggagagcgaaatgatcattcccaagaaccttgccgggccggtgtcccaacacaattacagacctggataccacacacagatcgctggcccctggcatctcgggaaactggagatggacttcgatttttgtgacggaaccacggtgattgtcacagaagattgcggcaaccgcgggcccagcctgcggaccaccacagcctctggaaagctcatcaccgagtggtgctgtagatcctgcacgctgcctccgcttcggtatcgcggcgaggacggctgttggtacgggatggaaatcagacccctgaaggagaaagaagagaatctcgttaacagcctggtgacagccggacacggccaggtggataatttctccctgggggtccttggaatggctctctttctggaagagatgctgcggaccagagtgggcacaaagcatgcgattctcctggttgccgtgtctttcgtcacccttatcacagggaacatgagctttaaagacctgggacgcgtggttgtgatggtcggcgctaccatggccgatgacattggcatgggggtgacgtatctcgccctgctggctgccttcaaggttcggcctacctttgcggctggacttctgctcagaaaactgacatccaaggagctcatgatgaccacaatcggcattgtgctgctttctcaaagcaccatccccgaaacggtcctggagctcacagatgccctggccctggggatgatggtgcttaagatcgtgcgcaatatggaaaaataccagctggctgtcaccattatggccatcctctgcgttcctaacgcggtgattctgcagaatgcttggaaggtgtcctgtacaatcctcgccgtcgtgtctgttagccccctgcttctgacctccagccagcagaagaccgactggattcctctcgccctgacaatcaagggactgaaccccacggctatcttccttaccacactgtctagaaccaataaaaagcggtcctggccgctcaacgaggccattatggctgtgggcatggtcagcatcctggcctcttccctcctgaaaaatgacattcctatgacagggccccttgtggcgggaggcctgctgaccgtttgctatgtgctcacgggccgcagcgccgatctggaacttgagagagctacagacgtcaagtgggaggatcaggccgaaatctctgggtccagccctattctgtccatcaccattagcgaggacggatctatgagcatcaagaacgaagaggaggaacagaccctcacaatcctgattcggaccggcctcctggtgatctccgggctttttcccatttctatcccgattacagctgccgcctggtacctgtgggaggtcaaaaagcagcgcgctggagtgctgtgggatgttccttctccccctcccatgggcaaagcggaactcgaggacggggcctatagaatcaagcaaaaaggaatcctgggctactcccagattggcgctggggtgtacaaggaaggaacgttccacaccatgtggcatgtcacacggggcgccgtgcttatgcacaaggggaaacgcatcgagccctcctgggccgatgttaagaaagacctgattagctatggaggcgggtggaagctcgagggagaatggaaagagggcgaagaggtgcaggtcctggctctcgaacctggcaagaatccgagagccgtgcagaccaagcccgggctgtttaaaacaaacaccggaacgatcggcgcggtgtcccttgatttctctcctgggaccagcggatcccccattatcgacaagaaaggcaaggttgtcgggctgtacggaaacggcgtggtgacacggagcggcgcttatgtctctgccatcgcccaaaccgagaaatccattgaggataatcctgaaatcgaggacgatatttttcgcaagagacggctgacaatcatggacctccaccccggggctggaaagaccaaaagatacctgcctgccattgtgcgcgaagcgatcaagcggggccttagaacactgattctcgctccgacgcgcgttgtggccgccgagatggaagaggctctgcgggggctccccatcagatatcagacccctgccatccgcgctgagcatacaggacgggaaattgtcgacctgatgtgtcacgccaccttcaccatgagacttctgagccccgtgcgcgttcctaactacaatctgatcattatggatgaggcgcatttcacagaccccgcctctatcgctgcccggggctatatttccacgagagtggaaatgggggaggctgccggcatctttatgaccgccacaccgcctggaagccgggatcccttcccccagtccaacgctcctatcattgacgaggaacgcgagatccccgaaagatcttggaatagcggccacgagtgggtcaccgattttaaagggaagacagtgtggttcgttccttccattaaagcgggaaacgacatcgccgcttgcctccggaagaatggcaagaaagtgattcaactgagccgcaagacctttgattctgaatacgtcaaaacgagaacaaacgactgggatttcgtggtgaccaccgacatctccgagatgggggccaattttaaggccgagcgggtcatcgatccgagacgctgtatgaaacccgttattcttacagacggagaggaacgggtgatcctggctggccctatgcccgtgacccatagctctgccgcgcagagacgcgggcggattggcagaaaccctaagaatgaaaacgaccagtacatctatatgggagagcccctcgaaaatgatgaggactgcgctcactggaaagaggccaagatgctgctggataacattaatacaccggaaggcatcattcctagcatgttcgagcccgaacgcgagaaggtcgacgccatcgatggggaataccggctcagaggagaggctcgcaaaacctttgtggaccttatgagacggggcgatctgcctgtttggctggcctataaggtggcggccgaggggatcaactacgctgaccgcagatggtgtttcgatggaattaaaaacaatcagatcctcgaagagaacgtcgaagtggagatttggacgaaggagggcgaacggaaaaagctgaagccccgctggcttgacgccagaatctattccgatcctctggctctcaaagagtttaaggagttcgccgctgggcggaaatctctgacactgaatctcattaccgagatgggcagacttcccacattcatgacccaaaagacgcgcgacgccctggataacctggcggttctccacaccgccgaagctggaggccgggcctacaatcatgctctgagcgagcttccggagacactggaaaccctcctgctgctcacacttctggccaccgtgacagggggaatctttctgttcctcatgtccggcagagggatcggaaaaatgaccctgggcatgtgctgcattatcacggcctctattcttctgtggtatgctcagatccagcctcactggattgcggccagcatcatcctcgagtttttcctgattgtcctgctcatccccgaacccgagaagcagcgcacacctcaagacaaccagcttacctacgtggtcattgctatcctgaccgtggttgccgccacaatggctaatgaaatgggctttctggagaagaccaaaaaggacctcgggctgggatccattgccacacagcagccggagagcaacatccttgatattgacctgcggcccgcgtctgcctggacgctctacgctgtggccaccacattcgtgacccctatgctgagacattccatcgaaaatagctccgtcaacgtttctctgacagctatcgccaatcaagcgaccgtgctcatgggccttgggaaaggatggcccctgagcaagatggatattggcgtgcctctgctcgccatcgggtgttattcccaggtcaaccccattacgctgaccgctgcccttctgctcctggtggctcactacgccatcattggacctggcctgcaggctaaagccacacgggaggcgcagaagcgcgccgctgccggcatcatgaagaatccgaccgttgacgggatcacagtgattgatctcgaccccatcccttatgatcccaaatttgaaaagcaacttggacaggtcatgctgctgattctctgcgtgacccaggtcctgatgatgagaacgacatgggctctttgtgaggccctgaccctcgccacaggccctatctctaccctgtgggaagggaaccccggacggttctggaataccacaattgcggtgagcatggctaacatctttcgcggctcctacctggccggggctggactccttttcagcatcatgaaaaatacgaccaacacaagacggggcaccggcaacattggggagacactgggagagaagtggaaatctcgcctgaatgccctcggcaagtccgaatttcaaatctataaaaagagcgggattcaggaggttgacagaaccctggccaaggaaggaatcaaacggggcgagacggatcaccatgctgtgtctcgcgggtccgccaaacttagatggttcgtcgagcggaacatggtgacaccggaaggaaaagttgtggacctgggctgcggcagagggggatggagctactattgtggcgggctcaagaatgtccgcgaggtgaaaggactgaccaagggcgggcctggacacgaggaacccattcccatgtctacctacggctggaacctggtgcggctccagagcggcgttgatgtctttttcatccctcccgaaaagtgcgacacacttctgtgtgatatcggggagtcctctcctaatccgaccgtggaggcgggaagaacactgcgcgtgctcaacctggtcgaaaattggcttaacaataacacgcagttctgcattaaagttctgaatccctacatgcctagcgtgatcgagaagatggaagccctccaacggaaatatggcggggctctggtgagaaaccccctgtcccgcaatagcacccatgagatgtactgggtctccaacgcctctggaaatattgtgagctccgttaacatgatctctcggatgctcattaacagatttacaatgcgccacaagaaagctacctatgaacctgacgtggaccttggcagcgggacacggaatatcggaattgagtccgagatccccaacctggatatcattggcaagagaatcgaaaagattaaacaggagcatgaaacctcttggcactacgaccaggatcacccgtataagacgtgggcctaccatggcagctatgagaccaaacagacagggtccgcgagctctatggtcaatggagtggttcgcctgctcaccaagccttgggacgtgctgcccacagtcacccaaatggccatgacagataccacgcctttcggccagcagcgggtgtttaaagaaaaggtggacacaagaacccaggagcccaaggaggggaccaagaaacttatgaaaatcacagctgaatggctgtggaaagagctcggcaagaagaaaacgcctcgcatgtgtaccagagaagagttcacacggaaggtccgctccaacgccgctctgggcgccatttttaccgatgagaataagtggaaaagcgctagagaagccgttgaggactctcggttctgggaactggtggataaggagagaaacctccacctggaagggaaatgcgagacatgtgtgtacaatatgatgggaaagcgggagaagaaacttggcgaatttggcaaagcgaaagggtcccgcgccatctggtacatgtggctgggagctagattcctcgagtttgaagccctgggcttccttaacgaggaccattggtttagccgggaaaattctctgtccggggtcgagggagagggcctccacaagctggggtatatcctgcgcgatgtgagcaaaaaggaaggcggagctatgtacgccgacgacaccgccggctgggatacaagaattaccctcgaggacctgaaaaacgaagagatggttacgaatcacatggaaggggagcataagaaacttgcggaggctatcttcaaactgacctatcaaaacaaggtggtccgggtgcagcgccccacaccgagaggaaccgttatggatattatctcccggcgcgaccagagaggcagcgggcaagtgggaacatacggcctcaatacctttacgaacatggaagcccagctgattcggcagatggagggggaaggcgtcttcaaaaatatccagcaccttacagtgaccgaggaggttgccgtgcataactggctggctcgcgtcggaagagaacggctctctcgcatggccatcagcggcgatgactgcgtggtcaagcctctggatgacagattcgctaacgccctgacagcgctcaatgatatggggaaaattcggaaggacatccaacagtgggagccctccaagggatggaacgattggacccaggtgcccttttgctctcaccatttccacgaactgattatgaaagacggcagaatccttgttgtgccttgtcgcaatcaggatgagctgattgggcgggccagaatcagccaaggagctggctggtccctccgcgaaacggcctgcctggggaagtcttatgctcagatgtggagccttatgtactttcaccggagagacctgcgcctcgccgcgaacgccatttgttccgctgtcccgtctcattgggtgcccaccagccggacaacctggtccatccacgccaaacatgagtggatgacaaccgaggacatgctgacagtgtggaatagagtttggatccgcgaaaacccttggatggaggataagacccccgtggaaagctgggaggaaattccttatctgggcaaacgggaggaccagtggtgcggatctctcatcggcctgacgtccagagctacatgggccaagaatattcaggctgccatcaaccaagtccgcagccttattgggaatgaggaatacaccgattacatgccctctatgaagcggttcagacgggaggaagaggaagcgggagtgctgtggtga

SEQ ID NO: 20091 - RNA, 9876 nt, synthetic construct
  misc_feature 1..9876: note = derived and/or modified CDS sequence (opt5) from DENV-2__EU482642__SS-prME
  source 1..9876: mol_type = other RNA
agcgccggaatgatcattatgctgatccccacagtgatggctttccacctcacaacgagaaatggggaacctcatatgattgtcggaatccaggaaaagggcaaatccctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcttcgagctgaccgatgccctcgccctggggatgatggtgctgaagatcgtgagaaatatggaaaaataccagcttgctgtcacaatcatggccattctgtgcgttcctaacgcggtgatcctccagaatgcttggaaggtgtcctgtaccattctggccgtcgtgtctgttagccccctcctgcttacctccagccagcagaaaacggactggatccctctggccctcacgattaagggactgaaccccaccgctatctttctgacaaccctttctcgcacaaataaaaagagatcctggccgctgaacgaggccatcatggctgtgggcatggtcagcattctcgcctcttccctgctcaagaatgacatccctatgaccgggcccctggtggcgggaggccttctgacggtttgctatgtgctgacaggccggagcgccgatctcgaactggagcgcgctaccgacgtcaaatgggaggatcaggccgaaatttctgggtccagccctatcctttccattaccatcagcgaggacggatctatgagcattaagaacgaagaggaggaacagacactgaccatcctcatcagaacaggcctgctcgtgatttccgggctgttccccatctctattccgatcacggctgccgcctggtacctttgggaggtcaaaaagcagcgggctggagtgctgtgggatgttccttctccccctcccatgggcaaagcggaactggaggacggggcctatcgcattaagcaaaagggaatcctcggctactcccagatcggcgctggggtgtacaaagaaggaacctttcacacaatgtggcatgtcaccagaggcgccgtgctgatgcacaaggggaaacggattgagccctcctgggccgatgttaagaaagaccttatcagctatggaggcgggtggaagctggagggagaatggaaggagggcgaagaggtgcaggtcctcgctctggaacctggcaaaaatccgcgcgccgtgcagacaaagcccgggctgttcaaaaccaacacgggaaccattggcgcggtgtccctggatttttctcctgggacaagcggatcccccatcattgacaagaaaggcaaggttgtcgggctttacggaaacggcgtggtgaccagaagcggcgcttatgtctctgccatcgcccaaacagagaagtccatcgaggataatcctgaaattgaggacgatatcttccggaaacgcagactgaccattatggacctgcaccccggggctggaaagacaaaacggtacctccctgccatcgtgagagaagcgattaagcgcggcctgcggacgcttatcctggctccgaccagagttgtggccgccgagatggaagaggctctccgcgggctgcccattcggtatcagacccctgccatcagagctgagcataccggacgcgaaatcgtcgacctcatgtgtcacgccaccttcacaatgcggctgcttagccccgtgagagttcctaactacaatctgattatcatggatgaggcgcattttacggaccccgcctctattgctgcccgcggctatatctccacccgggtggaaatgggggaggctgccggcattttcatgacagccaccccgcctggaagcagagatccctttccccagtccaacgctcctatcatcgacgaggaacgggagattcccgaacgctcttggaatagcggccacgagtgggtcacagatttcaaagggaagaccgtgtggtttgttccttccatcaaggcgggaaacgacattgccgcttgcctgcgcaaaaatggcaagaaagtgatccaactcagccggaagacgttcgattctgaatacgtcaaaacacgcaccaacgactgggattttgtggtgaccacagacatttccgagatgggggccaatttcaaggccgagagagtcatcgatccgcggagatgtatgaaacccgttatcctgaccgacggagaggaacgcgtgattcttgctggccctatgcccgtgacacatagctctgccgcgcagcggagagggcgcatcggccggaaccctaagaatgaaaacgaccagtacatttatatgggagagcccctggaaaatgatgaggactgcgctcactggaaggaggccaaaatgctcctggataacatcaataccccggaaggcattatccctagcatgtttgagcccgaaagagagaaggtcgacgccattgatggggaataccgcctgcggggagaggctagaaaaacgttcgtggacctcatgcgcagaggcgatcttcctgtttggctggcctataaggtggcggccgaggggatcaactacgctgaccggcgctggtgttttgatggaatcaaaaacaatcagattctggaagagaacgtcgaagtggagatctggacaaaggagggcgaaagaaagaaactcaagccccggtggctggacgcccgcatttattccgatcctcttgctctgaaagagttcaaggagttcgccgctgggagaaaatctctcaccctgaatctgatcacagagatgggccggctccccacctttatgacgcaaaagaccagagacgcccttgataacctggcggttctgcacacagccgaagctggaggccgcgcctacaatcatgctctcagcgagctgccggagacccttgaaacactgctcctgctgaccctccttgccacagtgaccgggggaattttcctgtttctgatgtccggccgggggatcggaaagatgacgctcggcatgtgctgcatcattacagcctctatcctgctttggtatgctcagattcagcctcactggatcgcggccagcattatcctggagttctttctcatcgtcctgctgattcccgaacccgagaaacagagaacccctcaagacaaccagctcacctacgtggtcatcgctattcttacagtggttgccgccaccatggctaatgaaatgggcttcctggagaagaccaaaaaggacctggggctcggatccatcgccacgcagcagccggagagcaacattctggatatcgaccttcgccccgcgtctgcctggaccctgtacgctgtggccacaacctttgtgacacctatgctccggcattccattgaaaatagctccgtcaacgtttctctgaccgctatcgccaatcaagcgacggtgctgatgggcctcgggaaaggatggccccttagcaagatggatatcggcgtgcctctgctggccattgggtgttattcccaggtcaaccccatcaccctcacagctgccctgcttctgctcgtggctcactacgccattatcggacctggcctgcaggctaaggccaccagagaggcgcagaaacgggccgctgccggcattatgaagaatccgacagttgacgggatcaccgtgatcgatctggaccccattccttatgatcccaaattcgaaaagcaactcggacaggtcatgcttctgatcctgtgcgtgacgcaggtcctcatgatgcgcacaacctgggctctgtgtgaggcccttacactggccaccggccctatttctaccctctgggaagggaaccccggaagattttggaatacaacgatcgcggtgagcatggctaacattttccggggctcctacctggccggggctggactgctctttagcatcatgaaaaataccacaaacacccgcagaggcacaggcaacatgggggagacccttggagagaagtggaaatctcggctgaatgccctgggcaagtccgagttccaaatctataagaaaagcgggattcaggaggttgaccgcacgctcgccaaggaaggaatcaaaagaggcgagacagatcaccatgctgtgtctcgggggtccgccaagctgcgctggtttgtcgagagaaacatggtgaccccggaaggaaaagttgtggaccttggctgcggcagagggggatggagctactattgtggcgggctgaagaatgtccgggaggtgaagggactcaccaaaggcgggcctggacacgaagaacccattcccatgtctacatacggctggaacctggtgcgcctgcagagcggcgttgatgtcttcttcatccctcccgaaaagtgcgacaccctcctttgtgatattggggagtcctctcctaatccgacagtggaggcgggacggacgctgagagtgctgaacctcgtcgaaaattggctgaacaataacacccagttttgcatcaaagttcttaatccctacatgcctagcgtgatcgagaagatggaagccctgcaacgcaaatatggcggggctctcgtgcggaaccccctgtccagaaatagcacacatgagatgtactgggtctccaacgcctctggaaatattgtgagctccgttaacatgatctctcgcatgctgattaaccggttcaccatgagacacaagaaggctacatatgaacctgacgtggacctcggcagcgggacccgcaatatcggaattgagtccgagatccccaaccttgatattatcggcaaacggatcgaaaagattaaacaggagcatgaaacgtcttggcactacgaccaggatcacccgtataagacctgggcctaccatggcagctatgagacaaaacagaccgggtccgcgagctctatggtcaatggagtggttagactgctgacaaagccttgggacgtgctccccaccgtcacacaaatggccatgaccgatacgacaccttttggccagcagcgcgtgttcaaggaaaaagtggacacccggacccaggagcccaaggaggggaccaaaaagctgatgaaaatcacggctgaatggctttggaaggagctgggcaaaaagaagacccctagaatttgtacacgcgaagagtttaccagaaaagtccggtccaacgccgctctcggcgccatcttcacagatgagaataagtggaaaagcgctcgcgaagccgttgaggactctagattttgggaactggtggataaggagcggaacctgcacctcgaagggaaatgcgagacctgtgtgtacaatatgatgggaaagagagagaagaaactgggcgagttcggcaaggcgaaagggtcccgggccatttggtacatgtggcttggagctcgctttctggagttcgaagccctcggctttctgaacgaggaccattggttcagcagagaaaattctctttccggggtcgagggagagggcctgcacaagctcgggtatatcctgcgggatgtgagcaaaaaggaaggcggagctatgtacgccgacgacacagccggctgggatacccgcatcacgctggaggacctcaagaacgaagagatggttaccaatcacatggaaggggagcataaaaagctggcggaggctatttttaaacttacatatcaaaacaaggtggtcagagtgcagcggcccaccccgcgcggaacagttatggatatcatttccagaaaagaccagcggggcagcgggcaagtgggaacctacggcctgaatacgttcacaaacatggaagcccagctcatccgccagatggagggggaaggcgtcttcaagaatattcagcacctgaccgtgacagaggaggttgccgtgcaaaactggcttgctagagtcggacgggaacgcctgtctagaatggccatcagcggcgatgactgcgtggtcaagcctctcgatgaccggtttgctaacgccctgaccgcgctgaatgatatggggaaaatccgcaaggacattcagcagtgggagccctccaaaggatggaacgattggacacaggtgcccttctgctctcatcactttcatgaactcatcatgaaggacggcagagttctggtggtcccttgtcggaatcaagatgagcttattgggagagcccgcatcagccagggagctggctggtccctgcgggaaaccgcctgcctcgggaaatcttatgctcagatgtggagcctgatgtacttccacagacgcgaccttcggctggccgcgaacgccatttgttccgctgtgccgtctcactgggtgcccacaagcagaaccacatggtccatccatgccaagcacgagtggatgaccacagaggacatgctcaccgtttggaatcgcgtgtggattcaggaaaacccttggatggaggataagacgcccgtcgaaagctgggaggaaatcccttatctgggcaaacgggaggaccaatggtgcggatctctgatcggcctcacatccagagctacctgggccaagaatattcaggctgccatcaaccaggtgcgcagcctgattgggaatgaggaatacaccgattacatgccctctatgaaacggtttagacgcgaggaagaggaagcgggagttctttggtga

SEQ ID NO: 20092 - RNA, 9876 nt, synthetic construct
  misc_feature 1..9876: note = derived and/or modified CDS sequence (opt5) from DENV-2__EU482643__SS-prME
  source 1..9876: mol_type = other RNA
agcgccggcatgatcattatgctgatccccaccgtcatggctttccacctgaccacgcggaatggggaacctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatgaagaacaaggcctggctggtccaccggcagtggtttcttgacctgccgctcccttggctgcccggggctgataaacaggagtccaattggattcagaaggagaccctggtgacattcaaaaaccctcatgccaagaaacaagacgttgtggtcctcggaagccaggaaggcgctatgcacaccgccctgacgggggccacagagatccagatgtcctctggcaatcttctgtttaccggacatctcaagtgccgcctgagaatggacaaacttcaactgaaaggcatgagctactccatgtgtacagggaagttcaaagtggtcaaggaaattgctgagacccagcacggaaccatcgtgattcgggttcagtatgagggcgatgggagcccctgcaaaatccccttcgaaatcatggacctcgagaagagatacgtgctgggacgcctgattacagtcaaccctatcgtgacggaaaaggattctccggttaacattgaggcggaacccccttttggcgactcctacatcattatcggggtggagcccggccagctcaaactgaattggttcaagaaaggaagctctattggccaaatgtttgagaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaagaactcaagtgcggaagcggcattttcatcaccgacaacgtgcacacatggaccgagcagtataaatttcaacctgaatccccctctaagctggccagcgccattcagaaagctcaggaggaagggatctgtggcattcggtccgttacaagacttgagaatctgatgtggaagcagatcacgccggagctcaaccacatcctggccgaaaatgaggtgaaactgaccattatgacaggagatatcaagggcattatgcaagctgggaagcgctctcttcggcctcagcccaccgaactcaaatacagctggaagacatggggaaaagccaagatgctgtccaccgagagctataaccagacgttcctgatcgacggccctgaaaccacagagtgccccaataccaacagagcgtggaactctctcgaggtcgaagattacgggtttggagtgttcacaaccaacatttggctgaaacttaaggagaagcaggacgccttttgtgactccaaactgatgagcgctgccatcaaggataatcgcgctgttcatgccgacatgggctattggatcgaatctgcgctcaacgatacatggaaaattgagaaggcctccttcatcgaggtgaaaaattgccactggcctaagagccataccctgtggtctaacggcgtcctggaaagcgagatgattatccccaagaaccttgctgggccggtgtcccaacacaattaccggcctggataccacacgcagattgccggcccctggcatctcgggaaactggaaatggacttcgatttttgtgacggaacaaccgtgatcgtcaccgaggattgcggcaacagagggcccagcctgcgcacaaccacggcttctggaaagctcattacagaatggtgctgtcggtcctgcaccctgcctccgcttagatatcggggcgaggacggctgttggtacgggatggagatccgccccctgaaagaaaaggaggaaaatctcgttaacagcctggtgacagccggacacggccaggtggataatttctccctgggggtccttggaatggccctctttctggaggaaatgctgagaacccgggtgggcacaaaacatgctatcctcctggttaccgtgtctttcgtcacgcttattaccgggaacatgagctttaaggacctgggaagagtggttgtgatggtcggcgcgacaatggccgatgacatcggcatgggggtgacctatctcgctctgctggccgccttcaaggttcgccctacatttgctgccggacttctgctccggaaactgacctccaaggagctcatgatgacgacaattggcatcgtgctgctttctcaaagcaccattcccgagacagtcctggaactcaccgatgcgctggctctggggatgatggtgcttaaaatcgtgagaaatatggagaagtaccagctggccgtcaccatcatggccattctctgcgttcctaacgctgtgatcctgcagaatgcctggaaagtgtcctgtacaattctcgcggtcgtgtctgttagccccctgcttctgacgtccagccagcaaaagaccgactggatccctctcgctctgacaattaaaggactgaaccccaccgccatcttccttacaaccctgtctcgcacgaataagaagagatcctggccgctcaacgaagccatcatggctgtgggcatggtcagcattctggcctcttccctcctgaaaaatgacatccctatgacagggccccttgtggctggaggcctgctgaccgtttgctatgtgctcaccggccggagcgccgatctggagcttgaacgcgcgacagacgtcaagtgggaggatcaggccgagatttctgggtccagccctatcctgtccattaccatcagcgaagacggatctatgagcattaaaaacgaggaagaggagcagacactcacgatcctgatcagaaccggcctcctggtgatttccgggctttttcccatctctattccgatcacagctgccgcttggtacctgtgggaagtcaagaaacagcgggccggagtgctgtgggatgttccttctccccctcccatgggcaaggccgagctcgaagacggggcttatcgcattaagcaaaaaggaatcctgggctactcccagatcggcgcgggggtgtacaaggagggaaccttccacacaatgtggcatgtcaccagaggcgccgtgcttatgcacaaagggaagcggattgaaccctcctgggctgatgttaaaaaggacctgatcagctatggaggcgggtggaagctcgagggagagtggaaagaaggcgaggaagtgcaggtcctggccctcgagcctggcaagaatccgcgcgccgtgcagacgaaacccgggctgtttaagaccaacacaggaaccattggcgctgtgtcccttgatttctctcctgggacaagcggatcccccatcattgacaaaaagggcaaggttgtcgggctgtacggaaacggcgtggtgaccagaagcggcgcctatgtctctgcgatcgctcaaacagaaaaatccatcgaggataatcctgagattgaagacgatatctttcggaagcgcagactgacgattatggacctccaccccggggccggaaaaaccaagcggtacctgcctgccatcgtgagagaggctattaaacgcggccttcggacactgatcctcgccccgaccagagttgtggcggctgaaatggaggaagccctgcgcgggctccccattcggtatcagacccctgccatcagagctgagcatacaggacgcgagatcgtcgacctgatgtgtcacgccacgttcaccatgcggcttctgagccccgtgagagttcctaactacaatctgattatcatggatgaagctcatttcacagaccccgcctctattgcggcccgcggctatatctccacccgggtggagatgggggaagctgccggcatttttatgacagctaccccgcctggaagcagagatcccttcccccagtccaacgcccctatcatcgacgaggagcgggaaattcccgagcgctcttggaatagcggccacgaatgggtcacggattttaaggggaagacagtgtggttcgttccttccatcaaagccggaaacgacattgctgcgtgcctcagaaagaatggcaaaaaggtgatccaactgagccggaaaacctttgattctgagtacgtcaagacccgcacaaacgactgggatttcgtggtgaccacagacatttccgaaatgggggccaattttaaagctgagagagtcatcgatccgcggagatgtatgaagcccgttatccttaccgacggagaggaacgcgtgattctggccggccctatgcccgtgacgcatagctctgccgctcagcggagagggcgcatcggccggaaccctaagaatgagaacgaccagtacatttatatgggagaacccctcgagaatgatgaagactgcgcccactggaaagaggcgaagatgctgctggataacatcaatacaccggagggcattatccctagcatgttcgaacccgagagagaaaaagtcgacgctattgatggggagtaccgcctccggggagaagccagaaagacctttgtggaccttatgcgcagaggcgatctgcctgtttggctggcctataaagtggctgccgaggggatcaactacgcggaccggcgctggtgtttcgatggaatcaagaacaatcagattctcgaggaaaacgtcgaggtggaaatctggacaaaggagggcgagcgcaagaagctgaaaccccggtggcttgacgcccgcatttattccgatcctctggctctcaaggaatttaaagagttcgccgctgggagaaagtctctgaccctgaatctcatcacggaaatgggccggcttcccaccttcatgacacaaaagaccagagacgccctggataacctggctgttctccacacagccgaggcgggaggccgcgcctacaatcatgctctgagcgaacttccggagaccctggagacactcctgctgctcacccttctggccacggtgacagggggaatttttctgttcctcatgtccggccgggggatcggaaaaatgaccctgggcatgtgctgcatcattaccgcttctatccttctgtggtatgcccagattcagcctcactggatcgccgctagcattatcctcgaatttttcctgatcgtcctgctcattcccgagcccgaaaagcagagaacacctcaagacaaccagcttacctacgtggtcatcgcgattctgacagtggttgccgctacgatggccaatgagatgggctttctggagaagaccaagaaagacctcgggctgggatccatcgccacacagcagccggagagcaacattcttgatatcgacctgcgccccgcttctgcctggaccctctacgcggtggccacaaccttcgtgacgcctatgctgcggcattccattgagaatagctccgtcaacgtttctctgaccgctatcgccaatcaagctacagtgctcatgggccttgggaagggatggcccctgagcaagatggatatcggcgtgcctctgctcgccattgggtgttattcccaggtcaaccccatcaccctgacagcggcccttctgctcctggtggctcactacgccattatcggacctggcctgcaggctaaagccaccagagaagctcagaagcgggccgcggccggcattatgaaaaatccgacggttgacgggatcacagtgatcgatctcgaccccattccttatgatcccaagtttgagaaacaacttggacaggtcatgctgctgatcctctgcgtgacccaggtcctgatgatgcgcacaacctgggctctttgtgaagccctgaccctcgctacaggccctatttctacgctgtgggaggggaaccccggaagattctggaataccacaatcgccgtgagcatggccaacatttttcggggctcctacctggcgggggctggactccttttcagcatcatgaagaataccacaaacacccgcagaggcacgggcaacatcggggaaacactgggagagaaatggaagtctcggctgaatgccctcggcaagtccgagtttcaaatttataaaaagagcgggatccaggaagttgaccgcaccctggctaaagagggaattaagagaggcgaaaccgatcaccatgccgtgtctcgggggtccgccaaacttcgctggttcgtcgagagaaacatggtgacaccggagggaaaggttgtggacctgggctgcggcagagggggatggagctactattgtggcgggctcaagaatgtccgggaagtgaaaggactgaccaagggcgggcctggacacgaggaacccatccccatgtctacatacggctggaacctggtgcgcctccagagcggcgttgatgtctttttcattcctcccgagaaatgcgacacgcttctgtgtgatatcggggaatcctctcctaatccgaccgtggaggctggacggacactgagagtgctcaacctggtcgagaattggcttaacaataacacccagttctgcatcaaggttctgaatccctacatgcctagcgtgattgagaagatggaggccctccaacgcaagtatggcggggcgctggtgcggaaccccctgtccagaaatagcacacatgaaatgtactgggtctccaacgcctctggaaatatcgtgagctccgttaacatgatttctcgcatgctcatcaaccggtttaccatgagacacaagaaagctacgtatgagcctgacgtggaccttggcagcgggacccgcaatattggaatcgaatccgagattcccaacctggatatcatcggcaagcggattgagaaaatcaagcaggaacatgagacatcttggcactacgaccaggatcacccgtataaaacctgggcctaccatggcagctatgaaacaaagcagaccgggtccgctagctctatggtcaatggagtggttagactgctcacaaagccttgggacgtgctgcccaccgtcacgcaaatggccatgacagataccacccctttcggccagcagcgcgtgtttaaagagaaggtggacacacggacgcaggaacccaaagaggggaccaagaaacttatgaagattacagcggagtggctgtggaaagaactcggaaagaagaaaacccctagaatgtgtacacgcgaggagttcaccagaaaggtccggtccaacgccgctctgggcgccatctttacagatgagaataaatggaaaagcgctcgcgaggccgttgaagactctagattctgggagctggtggataaagaacggaacctccacctggaggggaagtgcgaaacctgtgtgtacaatatgatgggaaagagagagaagaaacttggcgagtttggcaaagctaaagggtcccgggccatttggtacatgtggctgggagcgcgcttcctcgaatttgaggccctgggcttccttaacgaagaccattggtttagcagagaaaattctctgtccggggtcgaaggagagggcctccacaaactggggtatatcctgcgggatgtgagcaagaaggagggcggagctatgtacgccgacgacacggctggctgggatacccgcatcacactcgaagacctgaaaaacgaggaaatggttaccaatcacatggagggggaacataagaaacttgccgaggccattttcaagctgacatatcaaaacaaagtggtcagagtgcagcggcccaccccgcgcggaacggttatggatatcatttccagacgggaccagcgcggcagcgggcaagtgggaacatacggcctcaatacctttacaaacatggaggcgcagctgatcagacagatggaaggggagggcgtcttcaagaatattcagcaccttaccgtgacggaagaggttgctgtgcaaaactggctggcccgggtcggacgcgagagactctctcggatggccatcagcggcgatgactgcgtggtcaagcctctggatgaccgcttcgctaacgccctgaccgctctcaatgatatggggaaaatcagaaaggacattcagcagtgggaaccctccaaaggatggaacgattggacacaggtgcccttttgctctcatcacttccatgagctgatcatgaaggacggccgggttcttgtggtcccttgtagaaatcaagatgaactgattgggcgcgcccggatcagccagggagcgggctggtccctcagagagaccgcctgcctggggaaatcttatgctcagatgtggagccttatgtactttcaccgccgggacctgagactcgccgctaacgccatttgttccgcggtgccgtctcactgggtgcccacaagccgcaccacatggtccatccatgccaagcacgaatggatgaccacggaggacatgctgacagtttggaatcgggtgtggattagagataacccttggatggaggacaagacccccgtcgaaagctgggaggaaatcccttatctgggcaaacgcgaggatcagtggtgcggatctctcatcggcctgacctcccgggctacatgggccaagaatattcaagctgccatcaaccaggtgagaagccttatggggaatgaagagtacaccgactacatgccctctatgaaacgcttccggagagaggaagaggaagctggagttctgtggtga

SEQ ID NO: 20093 - RNA, 9876 nt, synthetic construct
  misc_feature 1..9876: note = derived and/or modified CDS sequence (opt5) from DENV-2__EU482644__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcaccggggtgacatatctcgccctgctggctgccttcaaagttcgccctacctttgcggctggacttctgctccggaagctgacatccaaggagctcatgatgaccacgattggcatcgtgctgctttctcagagcacaattcccgaaaccgtcctggagctcacagatgccctggccctggggatgatggtgcttaaaatcgtgagaaatatggaaaagtaccagctggctgtcaccatcatgaccattctctgcgttcctaacgccgtgatcctgcagaatgcgtggaaagtgtcctgtacaattctcgctgtcgtgtctgttagccccctgcttctgacgtccagccaacagaagaccgactggatccctctcgccctgacaattaaaggactgaaccccaccgccatcttccttacaaccctgtctcgcacgaataagaaaagatcctggccgctcaacgaggctatcatggccgtgggcatggtcagcattctggcttcttccctcctgaagaatgacatccctatgacagggccccttgtggccggaggcctgctgaccgtttgctatgtgctcaccggccggagcgcggatctggaacttgagcgcgccacagacgtcaagtgggaggatcaggctgaaatttctgggtccagccctatcctgtccattaccatcagcgaggacggatctatgagcattaaaaacgaagaggaggaacagacactcacgatcctgatcagaaccggcctcctggtgatttccgggctttttcccatctctattccgatcacagccgctgcctggtacctgtgggaggtcaagaaacaacgggccggagtgctgtgggatgttccttctccccctcccatgggcaaggctgaactcgaggacggggcgtatcgcattaaacagaagggaatcctgggctactcccagatcggcgccggggtgtacaaggaaggaaccttccacacaatgtggcatgtcaccagaggcgctgtgcttatgcacaaagggaagcggattgagccctcctgggccgatgttaaaaaggacctgatcagctatggaggcgggtggaaactcgagggagaatggaaggagggcgaagaggtgcaggtcctggccctcgaacctggcaagaatccgcgcgctgtgcaaacgaaacccgggctgtttaagaccaacacaggaaccattggcgccgtgtcccttgatttctctcctgggacaagcggatcccccatcattgacaaaaagggcaaagttgtcgggctgtacggaaacggcgtggtgaccagaagcggcgcgtatgtctctgctatcgcccagacagagaagtccatcgaggataatcctgaaattgaggacgatatctttcggaagcgcagactgacgattatggacctccaccccggggccggaaaaaccaagcggtacctgcctgctatcgtgagagaagccattaaacgcggccttcggacactgatcctcgcgccgaccagagttgtggctgccgagatggaagaggccctgcgcgggctccccattcggtatcagacccctgctatcagagccgagcatacaggacgcgaaatcgtcgacctgatgtgtcacgctacgttcaccatgcggcttctgagccccgtgagagttcctaactacaatctgattatcatggatgaggcccatttcacagaccccgcgtctattgccgctcgcggctatatctccacccgggtggaaatgggggaggccgctggcatttttatgacagccaccccgcctggaagcagagatcccttcccccaatccaacgcccctatcatcgacgaggaacgggagattcccgaacgctcttggaatagcggccacgagtgggtcacggattttaaggggaaaacagtgtggttcgttccttccatcaaggctggaaacgacattgcggcctgcctcagaaagaatggcaaaaaggtgatccagctgagccggaaaacctttgattctgaatacgtcaagacccgcacaaacgactgggatttcgtggtgaccacagacatttccgagatgggggctaattttaaagccgagagagtcatcgatccgcggagatgtatgaagcccgttatccttaccgacggagaggaacgcgtgattctggccggccctatgcccgtgacgcatagctctgctgcccagcggagagggcgcatcggccggaaccctaaaaatgaaaacgaccagtacatttatatgggagagcccctcgaaaatgatgaggactgcgcgcactggaaggaggctaagatgctgctggataacatcaatacaccggaaggcattatccctagcatgttcgagcccgaaagagagaaagtcgacgccattgatggggaataccgcctccggggagaggccagaaagacctttgtggaccttatgcgcagaggcgatctgcctgtttggctggcttataaagtggccgcggaggggatcaactacgccgaccggcgctggtgtttcgatggaatcaagaacaatcaaattctcgaagagaacgtcgaagtggagatctggacaaaagagggcgaaagaaagaagctgaaaccccggtggcttgacgctcgcatttattccgatcctctggccctcaaggagtttaaagagttcgctgccgggagaaagtctctgaccctgaatctcatcacggagatgggccggcttcccaccttcatgacacagaaaaccagagacgctctggataacctggccgttctccacacagcggaagccggaggccgcgcttacaatcatgccctgagcgagcttccggagaccctggaaacactcctgctgctcacccttctggctacggtgacagggggaatttttctgttcctcatgtccggccgggggatcggaaagatgaccctgggcatgtgctgcatcattaccgcctctatccttctgtggtatgcccagattcagcctcactggatcgctgcgagcattatcctcgagtttttcctgatcgtcctgctcattcccgaacccgagaagcaaagaacacctcaggacaaccagcttacctacgtggtcatcgccattctgacagtggttgctgccacgatggccaatgaaatgggctttctggagaaaaccaagaaagacctcgggctgggatccatcgctacacagcaaccggagagcaacattcttgatatcgacctgcgccccgcctctgcgtggaccctctacgccgtggctacaaccttcgtgacgcctatgctgcggcattccattgaaaatagctccgtcaacgtttctctgaccgccatcgctaatcaggccacagtgctcatgggccttgggaagggatggcccctgagcaaaatggatatcggcgtgcctctgctcgcgattgggtgttattcccaggtcaaccccatcaccctgacagccgcccttctgctcctggtggcccactacgctattatcggacctggcctgcaggccaaggctaccagagaggcccaaaagcgggcggccgctggcattatgaaaaatccgacggttgacgggatcacagtgatcgatctcgaccccattccttatgatcccaagtttgaaaaacagcttggacaggtcatgctgctgatcctctgcgtgacccaagtcctgatgatgcgcacaacctgggccctttgtgaggctctgaccctcgccacaggccctatttctacgctgtgggaagggaaccccggaagattctggaataccacaatcgccgtgagcatggcgaacatttttcggggctcctacctggctggggccggactccttttcagcatcatgaagaataccacaaacacccgcagaggcacgggcaacatgggggagacactgggagagaaatggaagtctcggctgaatgctctcggcaaatccgaatttcagatctataaaaagagcgggattcaggaggttgaccgcaccctggccaaagaaggaatcaagagaggcgagaccgatcaccatgccgtgtctcgggggtccgctaaacttcgctggttcgtcgagagaaacatggtgacaccggaaggaaaggttgtggacctgggctgcggcagagggggatggagctactattgtggcgggctcaaaaatgtccgggaggtgaagggactgaccaagggcgggcctggacacgaagaacccattcccatgtctacatacggctggaacctggtgcgcctccagagcggcgttgatgtctttttcatccctcccgaaaaatgcgacacgcttctgtgtgatattggggagtcctctcctaatccgaccgtggaggccggacggacactgagagtgctcaacctggtcgaaaattggcttaacaataacacccaattctgcatcaaggttctgaatccctacatgcctagcgtgatcgagaaaatggaagcgctccagcgcaagtatggcggggccctggtgcggaaccccctgtccagaaatagcacacatgagatgtactgggtctccaacgcttctggaaatattgtgagctccgttaacatgatctctcgcatgctcattaaccggtttaccatgagacacaaaaaggccacgtatgaacctgacgtggaccttggcagcgggacccgcaatatcggaattgagtccgagatccccaacctggatattatcggcaagcggatcgagaagattaagcaggagcatgaaacatcttggcactacgaccaggatcacccgtataaaacctgggcttaccatggcagctatgagacaaagcaaaccgggtccgccagctctatggtcaatggagtggttagactgctcacaaaaccttgggacgtgctgcccaccgtcacgcagatggcgatgacagataccacccctttcggccagcagcgcgtgtttaaggaaaaggtggacacacggacgcaagagcccaaagaggggaccaagaaacttatgaagatcacagccgaatggctgtggaaagagctcggaaagaaaaagacccctagaatgtgtacacgcgaagagttcaccagaaaggtccggtccaacgctgccctgggcgctatttttacagatgagaataaatggaaaagcgcccgcgaagctgttgaggactctagattctgggaactggtggataaagagcggaacctccacctggaagggaagtgcgagacctgtgtgtacaatatgatgggaaaaagagagaagaaacttggcgaatttggcaaagccaaggggtcccgggcgatctggtacatgtggctgggagcccgcttcctcgagtttgaagctctgggcttccttaacgaggaccattggtttagcagagaaaattctctgtccggggtcgagggagagggcctccacaaactggggtatattctgcgggatgtgagcaagaaagaaggcggagccatgtacgctgacgacacggccggctgggatacccgcatcacactcgaggacctgaagaacgaagagatggttaccaatcacatggaaggggagcataagaaacttgccgaggcgatcttcaagctgacatatcagaacaaagtggtcagagtgcagcggcccaccccgcgcggaacggttatggatattatctccagacgggaccaacgcggcagcgggcaggtcggaacatacggcctcaatacctttacaaacatggaagctcagctgattagacagatggagggggaaggcgtcttcaagaatatccaacaccttaccgtgacggaggaggttgccgtgcagaactggctggcccgggtcggacgcgaaagactctctcggatggctattagcggcgatgactgcgtggtcaaacctctggatgaccgcttcgccaacgctctgaccgccctcaatgatatggggaagatcagaaaggacatccagcagtgggagccctccaaaggatggaacgattggacacaagtgcccttttgctctcatcacttccatgaactgattatgaaggacggccgggttcttgtggtcccttgtagaaatcaggatgagctgatcgggcgcgcgcggattagccagggagccggctggtccctcagagaaaccgcttgcctggggaaatcttatgcccagatgtggagccttatgtactttcaccgccgggacctgagactcgctgccaacgcgatctgttccgccgtgccgtctcactgggtgcccacaagccgcaccacatggtccattcatgctaagcacgagtggatgaccacggaggacatgctgacagtttggaatcgggtgtggatcagagaaaacccttggatggaggataaaacccccgtcgaaagctgggaggaaattccttatctgggcaagcgcgaggaccaatggtgcggatctctcatcggcctgacctcccgggccacatgggctaagaatatccaggccgctattaaccaggtgagaagccttatcgggaatgaggaatacaccgattacatgccctctatgaaacgcttccggagagaggaagaggaagccggagttctgtggtga

SEQ ID NO: 20094 - RNA, 9876 nt, synthetic construct
  misc_feature 1..9876: note = derived and/or modified CDS sequence (opt5) from DENV-2__EU482645__SS-prME
  source 1..9876: mol_type = other RNA
agcgctggaatgatcattatgctgatccccaccgtgatggctttccacctgaccacgagaaatggggagcctcatatgattgtcggaatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagaaggttctgattttcatccttctgacagctgtggccccttccatgacgatgcgctgcattggcatctctaacagagattttgtcgaaggggtgagcggaggctcctgggttgacatcgtgctcgagcacgggagctgtgtcaccacaatggcgaagaataaacccaccctggatttcgaacttattaagacagaggccaaacagcctgctaccctgcggaagtattgcatcgaagccaaactcacgaacacaaccaccgagtctcgctgtccgacacaaggagagccctccctgaaggaagaacaagacaagagatttgtgtgcaaacatagcatggtggatcggggctggggcaatgggtgtggactgttcggcaaagggggaattgtgacctgcgctatgtttacatgcaaaaagaacatggaaggcaaaatcgttcagcctgagaatctcgaatacacgattgtggtgacaccccactctggggaggagcatgccgtcggaaacgacacaggcaagcacggccaggaaatcaaagtgacccctcaatccagcatcacagaggcggaactgaccgggtatggaacggttaccatggagtgttctccccgcacaggccttgatttcaatgaaatggtgctgctccagatggagaacaaggcctggctggtccacagacagtggtttcttgacctgccgctcccttggctgcccggggctgataagcaggagtccaattggattcaaaaagaaaccctggtgacattcaagaaccctcatgccaaaaagcaggacgttgtggtcctcggaagccaggagggcgctatgcacaccgccctgacgggggccacagaaatccaaatgtcctctggcaatcttctgtttaccggacatctcaaatgccggctgcgcatggacaaacttcagctgaagggcatgagctactccatgtgtacagggaaattcaaggtggtcaaagagattgctgagacccagcacggaaccatcgtgattagagttcagtatgaaggcgatgggagcccctgcaagatccccttcgagatcatggacctcgaaaaacggtacgtgctgggaagactgattacagtcaaccctatcgtgacggagaaggattctccggttaacattgaagcggagcccccttttggcgactcctacatcattatcggggtggagcccggccaactcaagctgaattggttcaaaaagggaagctctattggccagatgtttgaaaccacaatgcgcggggccaaacggatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactccagaagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacaatataagtttcagcctgagtccccctctaaactggccagcgccattcagaaggctcaggaagaggggatctgtggcattcgctccgttacacggcttgagaatctgatgtggaaacaaatcacgccggaactcaaccacatcctggccgagaatgaagtgaagctgaccattatgacaggagatatcaaaggcattatgcaggctgggaagagatctcttcgccctcagcccaccgagctcaagtacagctggaaaacatggggaaaggccaaaatgctgtccaccgaaagctataaccagacgttcctgatcgacggccctgagaccgcggagtgccccaatacaaaccgggcctggaactctctcgaagtcgaggattacgggtttggagtgttcaccacaaacatttggctgaaacttaaagaaaagcaagacgctttttgtgactccaagctgatgagcgccgctatcaaagataatagagccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccagcacaattaccgccctggataccacacccagattgctggcccctggcatctcgggaagctggagatggacttcgatttttgtgacggaacgacagtgatcgtcaccgaagattgcggcaaccgggggcccagcctgagaaccacaaccgcctctggaaaactcattacggagtggtgctgtcgctcctgcacactgcctccgcttcggtatagaggcgaggacggctgttggtacgggatggaaatccggcccctgaaggagaaagaagagaatctcgttaacagcctggtgaccgccggacacggccaagtggataatttctccctgggggtccttggaatggctctctttctggaagagatgctgcgcacaagagtgggcaccaagcatgcgatcctcctggttgccgtgtctttcgtcacacttattaccgggaacatgagctttaaagacctgggacgggtggttgtgatggtcggcgctacgatggccgatgacatcggcaccggggtgacatatctcgccctgctggctgccttcaaggttagacctacctttgcggctggacttctgctccgcaagctgacatccaaagagctcatgatgaccacgattggcatcgtgctgctttctcagagcacaattcccgaaaccgtcctggagctcacagatgccctggccctggggatgatggtgcttaagatcgtgcggaatatggaaaaataccagctggctgtcaccatcatgaccattctctgcgttcctaacgccgtgatcctgcagaatgcgtggaaggtgtcctgtacaattctcgctgtcgtgtctgttagccccctgcttctgacgtccagccaacagaaaaccgactggatccctctcgccctgacaattaagggactgaaccccaccgccatcttccttacaaccctgtctagaacgaataaaaagcgctcctggccgctcaacgaggctatcatggccgtgggcatggtcagcattctggcttcttccctcctgaagaatgacatccctatgacagggccccttgtggccggaggcctgctgaccgtttgctatgtgctcaccggcagaagcgcggatctggaacttgagcgggccacagacgtcaaatgggaggatcaggctgaaatttctgggtccagccctatcctgtccattaccatcagcgaggacggatctatgagcattaagaacgaagaggaggaacagacactcacgatcctgatccgcaccggcctcctggtgatttccgggctttttcccatctctattccgatcacagccgctgcctggtacctgtgggaggtcaaaaagcaaagagccggagtgctgtgggatgttccttctccccctcccatgggcaaagctgaactcgaggacggggcgtatcggattaagcagaagggaatcctgggctactcccagatcggcgccggggtgtacaaagaaggaaccttccacacaatgtggcatgtcacccgcggcgctgtgcttatgcacaaggggaaaagaattgagccctcctgggccgatgttaagaaagacctgatcagctatggaggcgggtggaagctcgagggagaatggaaggagggcgaagaggtgcaggtcctggccctcgaacctggcaaaaatccgcgggctgtgcaaacgaagcccgggctgtttaaaaccaacacaggaaccattggcgccgtgtcccttgatttctctcctgggacaagcggatcccccatcattgacaagaaaggcaaggttgtcgggctgtacggaaacggcgtggtgacccgcagcggcgcgtatgtctctgctatcgcccagacagagaagtccatcgaggataatcctgaaattgaggacgatatctttagaaaacggcgcctgacgattatggacctccaccccggggccggaaagaccaaaagatacctgcctgctatcgtgcgggaagccattaagagaggccttcgcacactgatcctcgcgccgacccgggttgtggctgccgagatggaagaggccctgagagggctccccattcgctatcagacccctgctatccgggccgagcatacaggaagagaaatcgtcgacctgatgtgtcacgctacgttcaccatgcgccttctgagccccgtgcgggttcctaactacaatctgattatcatggatgaggcccatttcacagaccccgcgtctattgccgctagaggctatatctccacccgcgtggaaatgggggaggccgctggcatttttatgacagccaccccgcctggaagccgggatcccttcccccaatccaacgcccctatcatcgacgaggaaagagagattcccgaacggtcttggaatagcggccacgagtgggtcacggattttaaagggaagacagtgtggttcgttccttccatcaaggctggaaacgacattgcggcctgcctccgcaaaaatggcaagaaagtgatccagctgagcagaaagacctttgattctgaatacgtcaaaacccggacaaacgactgggatttcgtggtgaccacagacatttccgagatgggggctaattttaaggccgagcgcgtcatcgatccgagacggtgtatgaaacccgttatccttaccgacggagaagagagagtgattctggccggccctatgcccgtgacgcatagctctgctgcccagcgccgggggagaatcggccgcaaccctaagaatgaaaacgaccagtacatttatatgggagagcccctcgaaaatgatgaggactgcgcgcactggaaggaggctaaaatgctgctggataacatcaatacaccggaaggcattatccctagcatgttcgagcccgaacgggagaaggtcgacgccattgatggggaatacagactccgcggagaggcccggaaaacctttgtggaccttatgagacgcggcgatctgcctgtttggctggcttataaggtggccgcggaggggatcaactacgccgacagacggtggtgtttcgatggaatcaaaaacaatcaaattctcgaagagaacgtcgaagtggagatctggacaaaggagggcgaacgcaagaaactgaagcccagatggcttgacgctcggatttattccgatcctctggccctcaaagagtttaaggagttcgctgccgggcgcaaatctctgaccctgaatctcatcacggagatgggcagacttcccaccttcatgacacagaagacccgggacgctctggataacctggccgttctccacacagcggaagccggaggcagagcttacaatcatgccctgagcgagcttccggagaccctggaaacactcctgctgctcacccttctggctacggtgacagggggaatttttctgttcctcatgtccggccgcgggatcggaaagatgaccctgggcatgtgctgcatcattaccgcctctatccttctgtggtatgcccagattcagcctcactggatcgctgcgagcattatcctcgagtttttcctgatcgtcctgctcattcccgaacccgagaaacaacggacacctcaggacaaccagcttacctacgtggtcatcgccattctgacagtggttgctgccacgatggccaatgaaatgggctttctggagaagaccaaaaaggacctcgggctgggatccatcgctacacagcaaccggagagcaacattcttgatatcgacctgagacccgcctctgcgtggaccctctacgccgtggctacaaccttcgtgacgcctatgctgcgccattccattgaaaatagctccgtcaacgtttctctgaccgccatcgctaatcaggccacagtgctcatgggccttgggaaaggatggcccctgagcaagatggatatcggcgtgcctctgctcgcgattgggtgttattcccaggtcaaccccatcaccctgacagccgcccttctgctcctggtggcccactacgctattatcggacctggcctgcaggccaaggctacccgggaggcccagaagagagcggccgctggcattatgaagaatccgacggttgacgggatcacagtgatcgatctcgaccccattccttatgatcccaaatttgaaaagcagcttggacaggtcatgctgctgatcctctgcgtgacccaagtcctgatgatgcggacaacctgggccctttgtgaggctctgaccctcgccacaggccctatttctacgctgtgggaagggaaccccggacgcttctggaataccacaatcgccgtgagcatggcgaacatttttagaggctcctacctggctggggccggactccttttcagcatcatgaaaaataccacaaacacccggcgcggcacgggcaacatgggggagacactgggagagaagtggaaatctagactgaatgctctcggcaagtccgaatttcagatctataagaaaagcgggattcaggaggttgaccggaccctggccaaggaaggaatcaaacgcggcgagaccgatcaccatgccgtgtctagagggtccgctaaacttcggtggttcgtcgagcgcaacatggtgacaccggaaggaaaagttgtggacctgggctgcggcagagggggatggagctactattgtggcgggctcaagaatgtccgggaggtgaagggactgaccaaaggcgggcctggacacgaggaacccattcccatgtctacatacggctggaacctggtgagactccagagcggcgttgatgtctttttcatccctcccgaaaagtgcgacacgcttctgtgtgatattggggagtcctctcctaatccgaccgtggaggccggacgcacactgcgggtgctcaacctggtcgaaaattggcttaacaataacacccaattctgcatcaaagttctgaatccctacatgcctagcgtgatcgagaagatggaagcgctccagagaaaatatggcggggccctggtgcgcaaccccctgtcccggaatagcacacatgagatgtactgggtctccaacgcttctggaaatattgtgagctccgttaacatgatctctagaatgctcattaaccgctttaccatgcggcacaagaaggccacgtatgaacctgacgtggaccttggcagcgggaccagaaatatcggaattgagtccgagatccccaacctggatattatcggcaaacgcatcgaaaagattaaacaggagcatgaaacatcttggcactacgaccaggatcacccgtataagacctgggcttaccatggcagctatgagacaaaacaaaccgggtccgccagctctatggtcaatggagtggttcggctgctcacaaagccttgggacgtgctgcccaccgtcacgcagatggcgatgacagataccacccctttcggccagcagagagtgtttaaggaaaaagtggacacacgcacgcaagagcccaaggaggggaccaagaaacttatgaaaatcacagccgaatggctgtggaaagagctcggcaagaagaagacccctcggatgtgtacaagagaagagttcacccgcaaagtcagatccaacgctgccctgggcgctatttttacagatgagaataagtggaaaagcgcccgggaagctgttgaggactctcgcttctgggaactggtggataaggagagaaacctccacctggaagggaaatgcgagacctgtgtgtacaatatgatgggaaagcgggagaagaaacttggcgaatttggcaaggccaaagggtccagagcgatctggtacatgtggctgggagcccggttcctcgagtttgaagctctgggcttccttaacgaggaccattggtttagccgcgaaaattctctgtccggggtcgagggagagggcctccacaagctggggtatattctgagagatgtgagcaaaaaggaaggcggagccatgtacgctgacgacacggccggctgggatacccggatcacactcgaggacctgaagaacgaagagatggttaccaatcacatggaaggggagcataagaaacttgccgaggcgatcttcaaactgacatatcagaacaaagtggtccgcgtgcagagacccaccccgcggggaacggttatggatattatctcccgcagagaccaacggggcagcgggcaggtcggaacatacggcctcaatacctttacaaacatggaagctcagctgattcgccagatggagggggaaggcgtcttcaaaaatatccaacaccttaccgtgacggaggaggttgccgtgcagaactggctggccagagtcggacgggaacgcctctctagaatggctattagcggcgatgactgcgtggtcaagcctctggatgaccggttcgccaacgctctgaccgccctcaatgatatggggaagatccgcaaagacatccagcagtgggagccctccaagggatggaacgattggacacaagtgcccttttgctctcatcacttccatgaactgattatgaaagacggcagagttcttgtggtcccttgtcggaatcaggatgagctgatcgggagagcgcgcattagccagggagccggctggtccctccgggaaaccgcttgcctggggaagtcttatgcccagatgtggagccttatgtactttcacagacgcgacctgcggctcgctgccaacgcgatctgttccgccgtgccgtctcactgggtgcccacaagcagaaccacatggtccattcatgctaaacacgagtggatgaccacggaggacatgctgacagtttggaatcgcgtgtggatccgggaaaacccttggatggaggataagacccccgtcgaaagctgggaggaaattccttatctgggcaagagagaggaccaatggtgcggatctctcatcggcctgacctcccgcgccacatgggctaaaaatatccaggccgctattaaccaggtgcggagccttatcgggaatgaggaatacaccgattacatgccctctatgaagagattccgccgggaggaagaggaagccggagttctgtggtga

SEQ ID NO: 20095 - RNA, 9876 nt, synthetic construct
  misc_feature 1..9876: note = derived and/or modified CDS sequence (opt5) from DENV-2__EU482646__SS-prME
  source 1..9876: mol_type = other RNA
agcgccggcatgatcattatgctgatccccacagtgatggctttccacctgacaacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttatttgcaagcatagcatggtggatcgcggctggggcaatgggtgtggactgttcggcaaagggggaatcgtgacctgcgctatgtttacatgcaagaaaaacatggaaggcaagattgtccagcctgagaatctcgaatacacgatcgttgtgacaccccactctggggaggagcatgccgtgggaaacgacacaggcaaacacggcaaggaaatcaaagtcacccctcagtccagcattacagaggcggaactgaccgggtatggaacggtgaccatggagtgttctcccagaacaggccttgatttcaatgaaatggttctgctccaaatggagaacaaggcctggctggtgcaccggcagtggtttcttgacctgccgctcccttggctgcccggggctgataagcaggagtccaattggatccagaaagaaaccctggtcacattcaagaaccctcatgccaaaaagcaagacgtggttgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgtcatccgggtgcagtatgaaggcgatgggagcccctgcaagatccccttcgagattatggacctcgagaagcggtacgttctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagtcttcaccacaaacatctggctgaaacttaaagaaaagcaggacgctttttgtgactccaagctgatgagcgccgctatcaaagataatcgcgccgtgcatgcggacatgggctattggattgagtctgccctcaacgatacctggaagatcgagaaggctagcttcattgaagttaagaattgccactggcctaaaagccatacactgtggtctaacggcgtgctggagagcgaaatgatcattcccaagaaccttgccgggccggtctcccaacacaattaccggcctggataccacacccagatcgctggcccctggcatctcgggaagctggagatggacttcgatttttgtgacggaacgacagtgattgtgaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaatccgccccctgaaggagaaagaagagaatctcgtcaacagcctggttaccgccggacacggccaggtggataatttctccctgggggtgcttggaatggctctctttctggaagagatgctgagaacacgggtcggcaccaagcatgcgattctcctggtggccgtttctttcgtgacacttatcaccgggaacatgagctttaaagacctgggaagagtcgtggttatggtgggcgctacgatggccgatgacattggcatgggggtcacctatctcgccctgctggctgccttcaaggtgcgccctacatttgcggctggacttctgctccggaagctgacctccaaagagctcatgatgacaaccatcggcattgttctgctttctcaaagcacgatccccgaaacagtgctggagctcaccgatgccctggccctggggatgatggtccttaagatcgtgagaaatatggaaaaataccagctggctgtgacaattatggccatcctctgcgtccctaacgcggttattctgcagaatgcttggaaggtgtcctgtaccatcctcgccgtggtctctgtgagccccctgcttctgacctccagccagcagaagaccgactggattcctctcgccctgacgatcaagggactgaaccccaccgctatcttccttacaaccctgtctcgcacaaataaaaagagatcctggccgctcaacgaggccattatggctgttggcatggtgagcatcctggcctcttccctcctgaagaatgacattcctatgaccgggccccttgtcgcgggaggcctgctgacggtgtgctatgttctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccatcctgattagaacaggcctcctggtcatctccgggctttttcccatttctatcccgattacggctgccgcctggtacctgtgggaggtgaaaaagcagcgggctggagtcctgtgggatgtgccttctccccctcccatgggcaaagcggaactcgaggacggggcctatcgcatcaagcaaaagggaatcctgggctactcccagattggcgctggggtttacaaagaaggaaccttccacacaatgtggcatgtgaccagaggcgccgtccttatgcacaaggggaaacggatcgagccctcctgggccgatgtgaagaaagacctgattagctatggaggcgggtggaagctcgagggagaatggaaggagggcgaagaggttcaggtgctggctctcgaacctggcaaaaatccgcgcgccgtccagacaaagcccgggctgtttaaaaccaacacgggaaccatcggcgcggtgtcccttgatttctctcctgggacaagcggatcccccattatcgacaagaaaggcaaggtggttgggctgtacggaaacggcgtcgtgaccagaagcggcgcttatgtgtctgccatcgcccaaacagagaagtccattgaggataatcctgaaatcgaggacgatatttttcggaaacgcagactgaccatcatggacctccaccccggggctggaaagacaaaacggtacctgcctgccattgtcagagaagcgatcaagcgcggccttcggacgctgattctcgctccgaccagagtggttgccgccgagatggaagaggctctgcgcgggctccccatccggtatcagacccctgccatcagagctgagcataccggacgcgaaattgtggacctgatgtgtcacgccaccttcacaatgcggcttctgagccccgtcagagtgcctaactacaatctgatcattatggatgaggcgcatttcacggaccccgcctctatcgctgcccgcggctatatttccacccgggttgaaatgggggaggctgccggcatctttatgacagccaccccgcctggaagcagagatcccttcccccagtccaacgctcctatcattgacgaggaacgggagatccccgaacgctcttggaatagcggccacgagtgggtgacagattttaaagggaagaccgtctggttcgtgccttccattaaggcgggaaacgacatcgccgcttgcctccgcaaaaatggcaagaaagttattcaactgagccggaagacgtttgattctgaatacgtgaaaacacgcaccaacgactgggatttcgtcgtgaccacagacatctccgagatgggggccaattttaaggccgagagagtgatcgatccgcggagatgtatgaaacccgtcattcttaccgacggagaggaacgcgttatcctggctggccctatgcccgtgacacatagctctgccgcgcagcggagagggcgcattggccggaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaataccgcctccggggagaggctagaaaaacgtttgtcgaccttatgcgcagaggcgatctgcctgtgtggctggcctataaggttgcggccgaggggatcaactacgctgaccggcgctggtgtttcgatggaattaaaaacaatcagatcctcgaagagaacgtggaagtcgagatttggacaaaggagggcgaaagaaagaaactgaagccccggtggcttgacgcccgcatctattccgatcctctggctctcaaagagtttaaggagttcgccgctgggagaaaatctctgaccctgaatctcattacagagatgggccggcttcccaccttcatgacgcaaaagaccagagacgccctggataacctggcggtgctccacacagccgaagctggaggccgcgcctacaatcatgctctgagcgagcttccggagaccctggaaacactcctgctgctcacccttctggccacagttaccgggggaatctttctgttcctcatgtccggccgggggatcggaaagatgacgctgggcatgtgctgcattacaaccgcctctatccttctgtggtatgctcagattcagcctcactggatcgcggccagcattatcctcgagtttttcctgatcgtgctgctcattcccgaacccgagaaacagagaacccctcaagacaaccagcttacatacgtcgtgatcgctattctgaccgtcgtggccgccacaatggctaatgaaatgggctttctggagaagacgaaaaaggacctcgggctgggatccatcgccacccagcagccggagagcaacattcttgatatcgacctgcgccccgcgtctgcctggacactctacgctgttgccaccacattcgtgacccctatgctgcggcattccattgaaaatagctccgtgaacgtctctctgacggctatcgccaatcaagcgaccgttctcatgggccttgggaaaggatggcccctgagcaagatggatatcggcgtgcctctgctcgccattgggtgttattcccaggtgaaccccatcacactgaccgctgcccttctgctcctggtcgctcactacgccattatcggacctggcctgcaggctaaggccacaagagaggcgcagaaacgggccgctgccggcattatgaagaatccgaccgtggacgggatcacggttatcgatctcgaccccattccttatgatcccaaatttgaaaagcaacttggacaggtgatgctgctgatcctctgcgtcacacaggtgctgatgatgcgcaccacatgggctctttgtgaggccctgaccctcgccaccggccctatttctacactgtgggaagggaaccccggaagattctggaatacgaccatcgcggtcagcatggctaacatttttcggggctcctacctggccggggctggactccttttcagcatcatgaaaaatacaaccaacacacgcagaggcaccggcaacatgggggagacgctgggagagaagtggaaatctcggctgaatgccctcggcaagtccgaatttcaaatctataagcgcagcgggattcaggaggtggacagaacactggccaaagaaggaatcaagcggggcgagaccgatcaccatgctgtttctcgcgggtccgccaaacttagatggttcgtggagcggaacatggtcaccccggaaggaaaggtggttgacctgggctgcggcagagggggatggagctactattgtggcgggctcaaaaatgtgcgcgaggtcaagggactgacaaagggcgggcctggacacgaagaacccattcccatgtctacctacggctggaacctggtgcggctccagagcggcgtggatgtctttttcatccctcccgaaaaatgcgacacacttctgtgtgatattggggagtcctctcctaatccgacggtcgaggcgggaagaaccctgcgcgtgctcaacctggtggaaaattggcttaacaataacacacagttctgcatcaaggtcctgaatccctacatgcctagcgttatcgagaaaatggaagccctccaacggaagtatggcggggctctggtgagaaaccccctgtcccgcaatagcacccatgagatgtactgggtgtccaacgcctctggaaatattgtcagctccgtgaacatgatctctcggatgctcattaacagatttacaatgcgccacaaaaaggctacctatgaacctgacgttgaccttggcagcgggacgcggaatatcggaattgagtccgagatccccaacctggatattatcggcaagagaatcgagaagattaagcaggagcatgaaacctcttggcactacgaccaggatcacccgtataaaacatgggcctaccatggcagctatgagaccaagcagacagggtccgcgagctctatggtgaatggagtcgtgcgcctgctcaccaaaccttgggacgttctgcccacagtgacccaaatggccatgacggatacaacccctttcggccagcagcgggtctttaaggaaaaggtggacaccagaacacaggagcccaaagaggggacgaagaaacttatgaagatcaccgctgaatggctgtggaaagagctcggaaagaaaaagacacctcgcatgtgtaccagagaagagttcacacggaaggtgcgctccaacgccgctctgggcgccatttttaccgatgagaataaatggaaaagcgctagagaagccgtcgaggactctcggttctgggaactggttgataaagagagaaacctccacctggaagggaagtgcgagacatgtgtgtacaatatgatgggaaaacgggagaagaaacttggcgaatttggcaaagcgaaggggtcccgcgccatctggtacatgtggctgggagctagattcctcgagtttgaagccctgggcttccttaacgaggaccattggtttagccgggaaaattctctgtccggggtggagggagagggcctccacaaactggggtatattctgcgcgatgtcagcaagaaagaaggcggagctatgtacgccgacgacaccgccggctgggatacgagaatcaccctcgaggacctgaagaacgaagagatggtgacaaatcacatggaaggggagcataagaaacttgcggaggctatcttcaagctgacctatcaaaacaaagttgtgcgggtccagcgccccacaccgagaggaaccgtgatggatattatctcccggcgcgaccagagaggcagcgggcaagttggaacgtacggcctcaatacatttaccaacatggaagcccagctgattcggcagatggagggggaaggcgtgttcaagaatatccagcaccttacagtcaccgaggaggtggccgttcaaaactggctggctcgcgtgggaagagaacggctctctcgcatggccattagcggcgatgactgcgtcgtgaaacctctggatgacagattcgctaacgccctgacggcgctcaatgatatggggaagatccggaaggacatccagcagtgggagccctccaaaggatggaacgattggacccaggtccccttttgctctcatcacttccatgaactgattatgaaggacggcagagtgcttgttgtgccttgtcgcaatcaagatgagctgatcgggcgggccagaattagccagggagctggctggtccctccgcgaaacagcctgcctggggaaatcttatgctcagatgtggagccttatgtactttcaccggagagacctgcgcctcgccgcgaacgccatctgttccgctgtcccgtctcactgggtgcccaccagccggacaacctggtccattcatgccaagcacgagtggatgacaaccgaggacatgctgacggtgtggaatagagtttggatccgcgaaaacccttggatggaggataaaacacccgtggaaagctgggaggaaattccttatctgggcaagcgggaggaccagtggtgcggatctctcatcggcctgacctccagagctacctgggccaagaatatccaagctgccattaaccaggtccgcagccttatcgggaatgaggaatacacagattacatgccctctatgaaacggttcagacgggaggaagaggaagcgggagtgctgtggtga

SEQ ID NO: 20096 - RNA, 9876 nt, synthetic construct
  misc_feature 1..9876: note = derived and/or modified CDS sequence (opt5) from DENV-2__EU482647__SS-prME
  source 1..9876: mol_type = other RNA
agcgccggcatgatcattatgctgatccccaccgtcatggctttccacctgacaacgcggaatggggaacctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatgaagaacaaggcctggctggtccaccggcagtggtttcttgacctgccgctcccttggctgcccggggctgataaacaggagtccaattggattcagaaggagaccctggtgacattcaaaaaccctcatgccaagaaacaagacgttgtggtcctcggaagccaggaaggcgctatgcacaccgccctgacgggggccacagagatccagatgtcctctggcaatcttctgtttaccggacatctcaagtgccgcctgagaatggacaaacttcaactgaaaggcatgagctactccatgtgtacagggaagttcaaagtggtcaaggaaattgctgagacccagcacggaaccatcgtgattcgggttcagtatgagggcgatgggagcccctgcaaaatccccttcgaaatcatggacctcgagaagagatacgtgctgggacgcctgattacagtcaaccctatcgtgacggaaaaggattctccggttaacattgaggcggaacccccttttggcgactcctacatcattatcggggtggagcccggccagctcaaactgaattggttcaagaaaggaagctctattggccaaatgtttgagaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaagaactcaagtgcggaagcggcattttcatcaccgacaacgtgcacacatggaccgagcagtataaatttcaacctgaatccccctctaagctggccagcgccattcagaaagctcaggaggaagggatctgtggcattcggtccgttacaagacttgagaatctgatgtggaagcagatcacgccggagctcaaccacatcctggccgaaaatgaggtgaaactgaccattatgacaggagatatcaagggcattatgcaagctgggaagcgctctcttcggcctcagcccaccgaactcaaatacagctggaagacatggggaaaagccaagatgctgtccaccgagagctataaccagacgttcctgatcgacggccctgaaaccgcggagtgccccaatacaaacagagcctggaactctctcgaggtcgaagattacgggtttggagtgttcaccacaaacatttggctgaaacttaaggagaagcaggacgctttttgtgactccaaactgatgagcgccgctatcaaggataatcgcgccgttcatgcggacatgggctattggatcgaatctgccctcaacgatacctggaaaattgagaaggcttccttcatcgaggtgaaaaattgccactggcctaagagccatacactgtggtctaacggcgtcctggaaagcgagatgattatccccaagaaccttgccgggccggtgtcccaacacaattaccggcctggataccacacccagattgctggcccctggcatctcgggaaactggaaatggacttcgatttttgtgacggaacgacagtgatcgtcaccgaggattgcggcaacagagggcccagcctgcgcaccacaaccgcctctggaaagctcattacggaatggtgctgtcggtcctgcacactgcctccgcttagatatcggggcgaggacggctgttggtacgggatggagatccgccccctgaaagaaaaggaggaaaatctcgttaacagcctggtgaccgccggacacggccaggtggataatttctccctgggggtccttggaatggctctctttctggaggaaatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaggttcgccctacatttgcggctggacttctgctccggaaactgacctccaaggagctcatgatgacaaccattggcatcgtgctgctttctcaaagcacgattcccgagacagtcctggaactcaccgatgccctggccctggggatgatggtgcttaaaatcgtgagaaatatggagaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctcgcacaaataagaagagatcctggccgctcaacgaagccatcatggctgtgggcatggtcagcattctggcctcttccctcctgaaaaatgacatccctatgaccgggccccttgtggcgggaggcctgctgacggtttgctatgtgctcacaggccggagcgccgatctggagcttgaacgcgctaccgacgtcaagtgggaggatcaggccgagatttctgggtccagccctatcctgtccattaccatcagcgaagacggatctatgagcattaaaaacgaggaagaggagcagacactcaccatcctgatcagaacaggcctcctggtgatttccgggctttttcccatctctattccgatcacggctgccgcctggtacctgtgggaagtcaagaaacagcgggctggagtgctgtgggatgttccttctccccctcccatgggcaaggcggagctcgaagacggggcctatcgcattaagcaaaaaggaatcctgggctactcccagatcggcgctggggtgtacaaggagggaaccttccacacaatgtggcatgtcaccagaggcgccgtgcttatgcacaaagggaagcggattgaaccctcctgggccgatgttaaaaaggacctgatcagctatggaggcgggtggaagctcgagggagagtggaaagaaggcgaggaagtgcaggtcctggctctcgagcctggcaagaatccgcgcgccgtgcagacaaaacccgggctgtttaagaccaacacgggaaccattggcgcggtgtcccttgatttctctcctgggacaagcggatcccccatcattgacaaaaagggcaaggttgtcgggctgtacggaaacggcgtggtgaccagaagcggcgcttatgtctctgccatcgcccaaacagaaaaatccatcgaggataatcctgagattgaagacgatatctttcggaagcgcagactgaccattatggacctccaccccggggctggaaaaacaaagcggtacctgcctgccatcgtgagagaggcgattaaacgcggccttcggacgctgatcctcgctccgaccagagttgtggccgccgaaatggaggaagctctgcgcgggctccccattcggtatcagacccctgccatcagagctgagcataccggacgcgagatcgtcgacctgatgtgtcacgccaccttcacaatgcggcttctgagccccgtgagagttcctaactacaatctgattatcatggatgaagcgcatttcacggaccccgcctctattgctgcccgcggctatatctccacccgggtggagatgggggaagctgccggcatttttatgacagccaccccgcctggaagcagagatcccttcccccagtccaacgctcctatcatcgacgaggagcgggaaattcccgagcgctcttggaatagcggccacgaatgggtcacagattttaaggggaagaccgtgtggttcgttccttccatcaaagcgggaaacgacattgccgcttgcctcagaaagaatggcaaaaaggtgatccaactgagccggaaaacgtttgattctgagtacgtcaagacacgcaccaacgactgggatttcgtggtgaccacagacatttccgaaatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaagaatgagaacgaccagtacatttatatgggagaacccctcgagaatgatgaagactgcgctcactggaaagaggccaagatgctgctggataacatcaataccccggagggcattatccctagcatgttcgaacccgagagagaaaaagtcgacgccattgatggggagtaccgcctccggggagaagctagaaagacgtttgtggaccttatgcgcagaggcgatctgcctgtttggctggcctataaagtggcggccgaggggatcaactacgctgaccggcgctggtgtttcgatggaatcaagaacaatcagattctcgaggaaaacgtcgaggtggaaatctggacaaaggagggcgagcgcaagaagctgaaaccccggtggcttgacgcccgcatttattccgatcctctggctctcaaggaatttaaagagttcgccgctgggagaaagtctctgaccctgaatctcatcacagaaatgggccggcttcccaccttcatgacgcaaaagaccagagacgccctggataacctggcggttctccacacagccgaggctggaggccgcgcctacaatcatgctctgagcgaacttccggagaccctggagacactcctgctgctcacccttctggccacagtgaccgggggaatttttctgttcctcatgtccggccgggggatcggaaaaatgacgctgggcatgtgctgcatcattacagcctctatccttctgtggtatgctcagattcagcctcactggatcgcggccagcattatcctcgaatttttcctgatcgtcctgctcattcccgagcccgaaaagcagagaacccctcaagacaaccagcttacctacgtggtcatcgctattctgacagtggttgccgccaccatggctaatgagatgggctttctggagaagacaaagaaagacctcgggctgggatccatcgccacgcagcagccggagagcaacattcttgatatcgacctgcgccccgcgtctgcctggaccctctacgctgtggccacaaccttcgtgacacctatgctgcggcattccattgagaatagctccgtcaacgtttctctgaccgctatcgccaatcaagcgacggtgctcatgggccttgggaagggatggcccctgagcaagatggatatcggcgtgcctctgctcgccattgggtgttattcccaggtcaaccccatcaccctgacagctgcccttctgctcctggtggctcactacgccattatcggacctggcctgcaggctaaagccaccagagaagcgcagaagcgggccgctgccggcattatgaaaaatccgacagttgacgggatcaccgtgatcgatctcgaccccattccttatgatcccaagtttgagaaacaacttggacaggtcatgctgctgatcctctgcgtgacgcaggtcctgatgatgcgcacaacctgggctctttgtgaagccctgacactcgccaccggccctatttctaccctgtgggaggggaaccccggaagattctggaatacaacgatcgcggtgagcatggctaacatttttcggggctcctacctggccggggctggactccttttcagcatcatgaagaataccacaaacacccgcagaggcacaggcaacatcggggaaaccctgggagagaaatggaagtctcggctgaatgccctcggcaagtccgagtttcaaacgtataaaaagagcgggattcaggaagttgaccgcacactggccaaagagggaatcaagagaggcgaaaccgatcaccatgctgtgtctcgggggtccgccaaacttcgctggttcgtcgagagaaacatggtgaccccggagggaaaggttgtggacctgggctgcggcagagggggatggagctactattgtggcgggctcaagaatgtccgggaagtgaaaggactgacaaagggcgggcctggacacgaggaacccattcccatgtctacctacggctggaacctggtgcgcctccagagcggcgttgatgtctttttcatccctcccgagaaatgcgacacacttctgtgtgatattggggaatcctctcctaatccgacggtggaggcgggacggaccctgagagtgctcaacctggtcgagaattggcttaacaataacacacagttctgcatcaaggttctgaatccctacatgcctagcgtgatcgagaagatggaggccctccaacgcaagtatggcggggctctggtgcggaaccccctgtccagaaatagcacccatgaaatgtactgggtctccaacgcctctggaaatattgtgagctccgttaacatgatctctcgcatgctcattaaccggtttacaatgagacacaagaaagctacctatgagcctgacgtggaccttggcagcgggacgcgcaatatcggaattgaatccgagatccccaacctggatattatcggcaagcggatcgagaaaattaagcaggaacatgagacctcttggcactacgaccaggatcacccgtataaaacatgggcctaccatggcagctatgaaaccaagcagacagggtccgcgagctctatggtcaatggagtggttagactgctcaccaagccttgggacgtgctgcccacagtcacccaaatggccatgacggatacaacccctttcggccagcagcgcgtgtttaaagagaaggtggacacccggacacaggaacccaaagaggggacgaagaaacttatgaagatcaccgctgagtggctgtggaaagaactcggaaagaagaaaacacctagaatgtgtacccgcgaggagttcacaagaaaggtccggtccaacgccgctctgggcgccatttttaccgatgagaataaatggaaaagcgctcgcgaggccgttgaagactctagattctgggagctggtggataaagaacggaacctccacctggaggggaagtgcgaaacatgtgtgtacaatatgatgggaaagagagagaagaaacttggcgagtttggcaaagcgaaagggtcccgggccatctggtacatgtggctgggagctcgcttcctcgaatttgaggccctgggcttccttaacgaagaccattggtttagcagagaaaattctctgtccggggtcgaaggagagggcctccacaaactggggtatattctgcgggatgtgagcaagaaggagggcggagctatgtacgccgacgacaccgccggctgggatacgcgcatcaccctcgaagacctgaaaaacgaggaaatggttacaaatcacatggagggggaacataagaaacttgcggaggctatcttcaagctgacctatcaaaacaaagtggtcagagtgcagcggcccacaccgcgcggaaccgttatggatattatctccagacgggaccagcgcggcagcgggcaagtgggaacgtacggcctcaatacatttaccaacatggaggcccagctgattagacagatggaaggggagggcgtcttcaagaatatccagcaccttacagtgaccgaagaggttgccgtgcaaaactggctggctcgggtcggacgcgagagactctctcggatggccattagcggcgatgactgcgtggtcaagcctctggatgaccgcttcgctaacgccctgacggcgctcaatgatatggggaaaatcagaaaggacatccagcagtgggaaccctccaaaggatggaacgattggacccaggtgcccttttgctctcatcacttccatgagctgattatgaaggacggccgggttcttgtggtcccttgtagaaatcaagatgaactgatcgggcgcgcccggattagccagggagctggctggtccctcagagagacagcctgcctggggaaatcttatgctcagatgtggagccttatgtactttcaccgccgggacctgagactcgccgcgaacgccatctgttccgctgtgccgtctcactgggtgcccaccagccgcacaacctggtccattcatgccaagcacgaatggatgacaaccgaggacatgctgacggtttggaatcgggtgtggatcagagagaacccttggatggaagataagacacccgtcgagagctgggaagagattccttatctgggcaaacgcgaagaccagtggtgcggatctctcatcggcctgacctcccgggctacctgggccaagaatatccaagctgccattaaccaggtgagaagccttatcgggaatgaggagtacacagattacatgccctctatgaaacgcttccggagagaagaggaagaggcgggagttctgtggtga

SEQ ID NO: 20097 - RNA, 9876 nt, synthetic construct
  misc_feature 1..9876: note = derived and/or modified CDS sequence (opt5) from DENV-2__EU482648__SS-prME
  source 1..9876: mol_type = other RNA
accgccggagtgatcattatgctgatccccacagctatggccttccacctcacgacccggaatggggagcctcatatgattgtcggacggcaggaaaagggcaagtccctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccatcaccgaggctgaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggattcagaaggagaccctggttacgttcaagaaccctcatgccaaaaagcaagacgtggtcgtgctcggctcccaggaaggggccatgcacacagctctgaccggcgcgacagagatccagatgagctccggaaatcttctgtttaccggccatctcaaatgcagactgcggatggataaacttcaactgaaagggatgtcttacagcatgtgtaccggaaagttcaagattgttaaagaaatcgccgagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggctgaacccccttttggggattcttacattatcatcggcgtggagcccggacagctcaaactgaattggttcaagaagggctccagcattgggcaaatgtttgagaccacaatgagaggagccaaacgcatggccatccttggcgacaccgcttgggatttcgggtctctgggaggcgtctttacgagcattgggaaggccctccaccaggtgttcggcgcgatctacggagctgccttttccggcgtttcttggacaatgaaaattctgatcggggccatcattacctggatcggaatgaacagccggtccaccagcctgtctgtgtcccttgtcctcgtgggcgtgattacactgtatctgggggctatggttcaggccgacagcggatgtgtcgtgtcttggaagaataaagaactcaagtgcggctccgggatcttcattaccgataacgtgcacacatggacggagcagtacaagtttcaacctgaaagcccctccaaactggcttctgccatccagaaggcgcatgaggaaggcatctgtggaattagaagcgtcacccgccttgagaatctgatgtggaaacagatcacaccggagctcaaccacattctgtccgaaaatgaggtgaagctgaccatcatgacaggcgacattaaagggatcatgcaggccggaaagcggtctcttagacctcaacccaccgaactcaaatatagctggaagacgtggggcaaggctaaaatgctgtccaccgagagccataaccagacattcctgatcgatgggcctgaaaccgccgagtgccccaatacaaaccgcgcttggaactctctcgaggttgaagactacggatttggcgtgttcaccacaaacatttggctgaaacttcgggagaaacaggacgtcttttgtgattccaagctgatgagcgccgcgatcaaagacaatagagccgtgcacgctgatatgggctattggattgaatctgccctcaacgacacctggaagatggagaaggcttccttcatcgaggttaaaagctgccactggcctaagtctcatacgctgtggagcaatggggtgctggaatccgagatgattatccccaagagcttcgccggaccggtctctcagcacaactaccgccctggctattacacacaaaccgccgggccctggcatcttggaaagctcgaaatggattttgacttctgtgagggcaccacagtggttgtgaccgaagattgcgggaaccggggaccctccctgagaacgacaaccgctagcggcaaactgattacagagtggtgctgtcggtcctgcaccctccctccgctgcgctacagaggcgaggacgggtgttggtatggaatggaaatccggccccttaaggagaaggaagagaatctggtcaactctctcgtgacagcgggccacgggcagatcgataattttagcctgggagtgctgggcatggcccttttcctcgaagagatgctgagaacccgcgtcgggacgaaacatgctattctgctcgttgccgtgtcctttatgaccctgatcacaggaaacatgtctttccgggaccttggcagagtgatggtcatggtgggcgccaccatgacagatgacattgggatgggagttacctacctggctctcctggccgcgtttaaggtgcgccctacgttcgctgccggcctgcttctgagaaaactcacaagcaaggagctgatgatggccaccatcgggattgctctcctgtcccagtctacaatccccgaaaccatccttgagctgaccgatgccctcgcgctgggaatgatggtcctgaaaattgtgcggaatatggaaaagtatcaacttgctgttacaatcatggccattagctgcgtgcctaacgccgtcatcctgcagaatgcttggaaggtgtcctgtacgattctcgccgctgttagcgtgtctcccctgctcctgacctccagccagcagaaagccgactggatccctcttgcgctgacaatcaagggcctcaaccccaccgccatttttctgacaaccctgtctcgcacgtccaaaaagagaagctggccgcttaatgaggctatcatggccgtcgggatggtgtctattctggcttccagcctcctgaaaaacgacatccctatgacaggacccctcgtggccggcggcctgcttaccgtctgctacgttctgaccgggcggtccgccgatctggaactcgagcgcgctacagacgtgaagtgggaggatcaagcggaaattagcggatctagccctatcctgtccattaccatctctgaggacggcagcatgtccatcaaaaatgaagaggaggaacagacacttacgattctgatcagaaccgggctcctggtgatttctggactcttccccgtcagcatcccgattacagccgctgcctggtatctgtgggaggtgaagaagcagcgggccggcgttctttgggatgtgccttctccccctcccgtcgggaaagctgaactggaggacggagcctaccgcatcaagcagaaaggcatcctgggctatagccaaattggggcgggagtgtacaaggaaggcacctttcacacaatgtggcacgttaccagaggggctgtgctcatgcatcggggaaaacgcatcgagcccagctgggccgatgtcaagaaggacctgatttcctacggcgggggatggaaacttgagggcgaatggaaggagggcgaagaggtgcaggtcctggccctcgaacctgggaaaaacccgagagctgtgcagacgaagcccggactgttcaaaaccaatacaggcaccatcggggccgttagcctcgatttttctcctggaacatccggcagccccattgtggaccggaaggggaaggtcgtgggactgtatggcaacggcgttgtgaccagatctggggcgtacgtctccgctatcgcccagacagagaaaagcatcgaggataatcctgaaattgaggacgatatcttccgcaagaaacggcttacgattatggacctgcaccccggagccggcaagaccaaaagatatctgcctgctatcgtgcgcgaagccattaagcgggggctcagaacactgatccttgctccgacccgcgtggttgccgcggagatggaagaggccctgcggggactccccattagataccaaacccctgctatccgcgccgagcatacaggccgggaaatcgtcgacctgatgtgtcacgctacgttcaccatgagactcctgtcccccgtgcgggtgcctaactataaccttattatcatggatgaggcccattttacagaccccgcctctattgctgcgcgcgggtacatcagcaccagagtcgaaatgggcgaggccgctggaattttcatgacagccaccccgcctggctcccgggatccctttccccagagcaatgcccctatcatcgacgaggaacgcgagattcccgaaagatcttggaactccgggcacgagtgggtgacggatttcaagggaaaaacagtttggtttgtgcctagcatcaaggctggcaatgacattgccgcgtgcctgcggaaaaacgggaagaaagtcatccagctgtctagaaagaccttcgatagcgaatatgtgaagacccgcacaaatgactgggattttgttgtgaccacagacatttccgagatgggagctaacttcaaagccgagcgggtcatcgatccgagacgctgtatgaagcccgtgatcctcaccgacggcgaagaacgggttattctggccgggcctatgcccgtgacgcactctagcgctgcccaaagacgcggccggatcggaagaaatcctaaaaacgaaaatgaccagtacatttacatgggcgagccccttgaaaacgatgaggactgcgcgcattggaaggaggccaaaatgctgctcgataatatcaacacaccggaagggattatcccttccatgtttgagcccgaacgcgagaaggtcgacgctattgatggagaatatagactgcggggcgaggcccgcaaaaccttcgtggacctgatgagaagaggggatctccctgtgtggcttgcttaccgcgtcgccgctgagggaatcaattatgccgacagacggtggtgttttgatggcgttaagaacaatcagatcctggaagagaacgtggaagtggagatttggacaaaggagggggaacgcaagaagctgaaaccccgctggctcgacgcgcggatctactctgatcctctggcccttaaggagttcaaagagttcgctgccggcagaaagagcctgaccctcaacctgattacggagatgggacgcctgcccacctttatgacacagaaggctcgggacgccctcgataatcttgccgtcctgcacaccgctgaagcgggcgggagagcctataaccatgctctgtccgagctcccggagacactggaaacccttctgctcctgacactgctcgccaccgtgacgggaggcatcttcctttttctgatgagcgggaaaggagttggcaagatgacactgggcatgtgctgcattatcaccgcctctatcctcctgtggtacgctcaaattcagcctcactggatcgccgcgtccattatccttgagttctttctgattgtgctcctgatccccgaacccgagaaacagcggacccctcaggacaatcaactgacatatgtcgtgatcgccattctcaccgttgtggctgccacaatggctaacgaaatggggttccttgagaagacgaaaaaggacctgggactgggcagcatcgccacccaggagccggaatccaatattctcgatatcgacctgcgccccgcgtctgcctggacactttacgctgtcgccaccacatttgtgacccctatgctgagacacagcattgagaactcctctgtcaatgtgagcctcacggctatcgccaaccaggctaccgttctgatggggctgggaaagggctggcccctctccaaaatggatattggggtgcctcttctggccatcggatgttacagccaggtgaatcccatcacactgaccgcggccctcctgcttctgattgctcattatgccatcattggccctggcctccaagctaaggccacacgggaagcccagaaacgcgcggctgccgggatcatgaagaacccgaccgtcgacggaattacggttatcgatctggaccccatcccttacgatcccaaattcgagaagcagctgggccaggtgatgctccttattctgtgcgtgacacaagtcctgatgatgagaaccacatgggctctctgtgaagccctgacccttgccaccgggcctatctctacactgtgggagggaaatcccggccggttttggaacacgaccattgctgtgtccatggccaatatcttccgcgggagctatctcgcgggagccggcctgctgttttctattatgaagaacacaaccaatacaagacggggcaccgggaacatcggagagacgctcggcgaaaaatggaagtcccgccttaatgctctggggaaaagcgagttccagatctacaagaaatctggcattcaggaagttgacagaacactggccaaggagggcatcaaaagaggggaaaccgatcaccatgctgtgagcagaggatccgccaagctccgctggtttgtcgaacggaacatggtgaccccggagggcaaggtcgtggacctgggctgcgggagaggaggctggtcttattactgtgggggacttaaaaacgttcgcgaagtgaagggcctgacaaaagggggacctggccacgaggaacccattcccatgagcacctatggctggaatctcgtccggctgcaatccggggtggatgttttcttcacacctcccgagaagtgcgacacgctgctctgtgatatcggagagagctcccctaacccgaccattgaagcgggcagaacacttcgcgtgctgtctctggtcgagaattggctcaacaatgacacccagttttgcatcaaagtgctgaacccctacatgcctagcgtgatcgaaaagatggagacacttcagcggaagtacgggggagccctggttagaaatcccctctcccgcaactctacccatgaaatgtattgggtcagcaatgctacgggcaacattgtgtcctctgtgaatatgatcagccggatgctgattaacagattcaccatgaaacacaagaaagccacatacgagcctgacgtcgatctggggtccggaacccgcaatatcggcattgagagcgaaatccccaacctcgacattatcggcaagcggatcgagaaaattaagcaggaacacgagacatcttggcattatgatcaagaccacccgtacaagacctgggcttatcatgggtcctacgaaacaaaacagaccggaagcgcctcttccatggttaatggcgtggtgagacttctgacgaagccttgggatgtcgtgcccatggttacacagatggctatgaccgacaccacaccttttgggcagcaacgcgtgttcaaagagaaggtcgatacgagaacccaggagcccaaagaaggaacaaagaagctgatgaaaatcaccgccgagtggctctggaaggaactgggcaaaaagaaaacacctcggatgtgtacccgcgaggagtttacaagaaaggtgcggagcaacgcggcccttggggctattttcaccgacgaaaacaaatggaagtctgccagagaggctgttgaagattcccggttttgggagctggtggacaaggaacgcaatctccacctggagggaaaatgcgagacgtgtgtctataacatgatgggcaagagagagaagaagctgggcgagttcgggaaagccaagggaagccgggccatctggtacatgtggctcggcgcgcgctttctggagttcgaggctcttgggtttctgaatgaagatcactggttctccagagagaacagcctctctggagtggagggcgaagggctgcataaacttggctacattctgcgggacgtgagcaaaaaggagggaggcgccatgtatgccgacgataccgctgggtgggacacacgcatcaccctcgaagatctgaaaaatgaggaaatggtcacaaaccacatggagggagagcataagagactggccgaagctatctttaaactcacctaccagaataaggttgtgcgggtgcagcgccccacgccgagaggcacagtcatggacattatctcccggcgcgatcaaagagggtctggacaggtgggcacctatgggctgaacacattcaccaatatggaggcccagcttattcggcaaatggaaggcgagggaatcttcaagagcattcagcacctgacggttaccgaggaaatcgcggtgcagaactggctcgcccgcgtcggcagagagcggctgtccagaatggctatctctggggacgattgcgtggttaaacctcttgacgatcgctttgccagcgctctgacagccctcaatgacatgggaaaggtgcggaaagatattcagcaatgggaaccctccaagggctggaacgactggacccaggtccccttctgctctcatcactttcacgagctgatcatgaaagatgggagagtgctggttgtgccttgtcgcaatcaggacgaactcattggacgggcgagaatcagccagggcgccgggtggtccctgaaggagacagcttgccttggcaagagctacgcccaaatgtggtctctgatgtatttccatcgccgggacctcagactggctgccaacgctatttgttccgccgtcccgagccactgggtgcccacctctcgcacaacctggtccatccatgcgaaacacgagtggatgacgacagaagatatgcttaccgtctggaatcgggtgtggattcaggagaacccttggatggaagacaagacccccgttgagagctgggaagaggtgccttacctgggaaaaagagaggatcagtggtgcggctccctcatcgggctgacatctcgcgccacctgggctaagaacatccagacagccattaatcaagtccggagcctgatcggaaacgaagagtatacggactacatgccctccatgaaaagatttcggagagaagaggaagaggccggcgtgctctggtga

SEQ ID NO: 20098 - RNA, 9876 nt, synthetic construct
  misc_feature 1..9876: note = derived and/or modified CDS sequence (opt5) from DENV-2__EU482649__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaatgaacccgaggatatcgactgttggtgcaattctacctccacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctattgccccttccatgacgatgagatgcatcggcatctctaaccgggattttgtggaaggggtcagcggaggctcctgggtggacattgttctcgagcacgggagctgtgtgaccacaatggcgaagaataagcccaccctggatttcgaacttatcaaaacagaggccaagcagcctgctaccctgcgcaaatattgcattgaagccaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaatcgtgacctgcgctatgtttacatgcaagaaaaacatggaaggcaagattgtccagcctgagaatctcgaatacacgatcgttgtgacaccccactctggggaggagcatgccgtgggaaacgacacaggcaaacacggcaaggaaatcaaagtcacccctcagtccagcattacagaggcggaactgaccgggtatggaacggtgaccatggagtgttctcccagaacaggccttgatttcaatgaaatggttctgctccaaatggagaacaaggcctggctggtgcaccggcagtggtttcttgacctgccgctcccttggctgcccggggctgataagcaggagtccaattggatccagaaagaaaccctggtcacattcaagaaccctcatgccaaaaagcaagacgtggttgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgtcatccgggtgcagtatgaaggcgatgggagcccctgcaagatccccttcgagattatggacctcgagaagcggtacgttctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagtcttcaccacaaacatctggctgaaacttaaagaaaagcaggacgctttttgtgactccaagctgatgagcgccgctatcaaagataatcgcgccgtgcatgcggacatgggctattggattgagtctgccctcaacgatacctggaagatcgagaaggcttccttcattgaagttaagaattgccactggcctaaaagccatacactgtggtctaacggcgtgctggagagcgaaatgatcattcccaagaaccttgccgggccggtctcccaacacaattaccggcctggataccacacccagatcgctggcccctggcatctcgggaagctggagatggacttcgatttttgtgacggaacgacagtgattgtgaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaatccgccccctgaaggagaaagaagagaatctcgtcaacagcctggttaccgccggacacggccaggtggataatttctccctgggggtgcttggaatggctctctttctggaagagatgctgagaacacgggtcggcaccaagcatgcgattctcctggtggccgtttctttcgtgacacttatcaccgggaacatgagctttaaagacctgggaagagtcgtggttatggtgggcgctacgatggccgatgacattggcatgggggtctcctatctcgccctgctggctgccttcaaggtgcgccctacctttgcggctggacttctgctccggaagctgacatctaaagagctcatgatgaccacaatcggcattgttctgcttagccaatccaccatccccgaaacggtgctggagctcacagatgccctggccctggggatgatggtccttaagatcgtgagaaatatggaaaaataccagctggctgtgaccattatggccatcctctgcgtccctaacgcggttgtgctgcagaatgcttggaaggtgtcttgtacaattctcgccgtcgtgagcgttagccccctgcttctgaccagctctcagcagaagaccgactggatccctctcgccctgacaattaagggactgaaccccacggctatcttccttaccacactgtcccgcaccaataaaaagagaagctggccgctcaacgaggccatcatggctgtgggcatggtctctattctggcctccagcctcctgaagaatgacatccctatgacagggccccttgtggcgggaggcctgctgaccgtttgctatgtgctcacgggccggtctgccgatctggaacttgagcgcgctacagacgtcaaatgggaggatcaggccgaaatttccgggagctcccctatcctgagcattaccatctctgaggacggaagcatgtccattaagaacgaagaggaggaacagaccctcacaatcctgatcagaaccggcctcctggtgatttctgggctttttcccatcagcattccgatcacagctgccgcctggtacctgtgggaggtcaaaaagcagcgggctggagtgctgtgggatgttccttctccccctcccatgggcaaagcggaactcgaggacggggcctatcgcattaagcaaaagggaatcctgggctacagccagatcggcgctggggtgtacaaagaaggaacgttccacaccatgtggcatgtcacaagaggcgccgtgcttatgcacaaggggaaacggattgagcccagctgggccgatgttaagaaagacctgatctcctatggaggcgggtggaagctcgagggagaatggaaggagggcgaagaggtgcaggtcctggctctcgaacctggcaaaaatccgcgcgccgtgcagaccaagcccgggctgtttaaaacaaacaccggaacgattggcgcggtgtctcttgatttcagccctgggacctccggaagccccatcattgacaagaaaggcaaggttgtcgggctgtacggaaacggcgtggtgacaagatctggcgcttatgtctccgccatcgcccaaaccgaaaagtccatcgaggataatcctgaaattgaggacgatatctttcggaaacgcagactgacaattatggacctccaccccggggctggaaagaccaaacggtacctgcctgccatcgtgagagaagcgattaagcgcggccttcggacactgatcctcgctccgacgagagttgtggccgccgagatggaagaggctctgcgcgggctccccattcggtatcagacccctgccatcaaagctgagcatacaggaagagaaatcgtcgacctgatgtgtcacgccaccttcaccatgcgccttctgtctcccgtgcgggttcctaactacaatctgattatcatggatgaggcgcatttcacagaccccgcctccattgctgccagaggctatatcagcacgcgcgtggaaatgggggaggctgccggcatttttatgaccgccacaccgcctggatcccgggatcccttcccccagtctaacgctcctatcatcgacgaggaaagagagattcccgaacggagctggaactccggccacgagtgggtcaccgattttaaggggaagacagtgtggttcgttcctagcatcaaagcgggaaacgacattgccgcttgcctccgcaagaatggcaaaaaggtgatccaactgtctagaaaaacctttgattccgaatacgtcaagacgcggacaaacgactgggatttcgtggtgaccaccgacattagcgagatgggggccaattttaaagccgagcgcgtcatcgatccgagacggtgtatgaagcccgttatccttacagacggagaagagagagtgattctggctggccctatgcccgtgacccattctagcgccgcgcagcgccgggggagaatcggccgcaaccctaagaatgaaaacgaccagtacatttatatgggagagcccctcgaaaatgatgaggactgcgctcactggaaagaggccaagatgctgctggataacatcaatacaccggaaggcattatcccttccatgttcgagcccgaacgggagaaagtcgacgccattgatggggaatacagactccgcggagaggctcggaagacctttgtggaccttatgagacgcggcgatctgcctgtttggctggcctataaagtggcggccgaggggatcaactacgctgacagacggtggtgtttcgatggaatcaagaacaatcagattctcgaagagaacgtcgaagtggagatctggacgaaggagggcgaacgcaaaaagctgaaacccagatggcttgacgcccggatttattctgatcctctggctctcaaggagtttaaagagttcgccgctgggcgcaagagcctgacactgaatctcatcaccgagatgggcagacttcccacattcatgacccaaaagacgcgggacgccctggataacctggcggttctccacaccgccgaagctggaggcagagcctacaatcatgctctgtccgagcttccggagacactggaaaccctcctgctgctcacacttctggccaccgtgacagggggaatttttctgttcctcatgtctggccgcgggatcggaaaaatgaccctgggcatgtgctgcatcattacggccagcatccttctgtggtatgctcagattcagcctcactggatcgcggcctccattatcctcgagtttttcctgatcgtcctgctcattcccgaacccgagaagcagcggacacctcaagacaaccagcttacctacgtggtcatcgctattctgaccgtggttgccgccacaatggctaatgaaatgggctttctggagaaaaccaagaaagacctcgggctgggaagcatcgccacacagcagccggagtctaacattcttgatatcgacctgagacccgcgtccgcctggacgctctacgctgtggccaccacattcgtgacccctatgctgcgccatagcattgaaaattcctctgtcaacgttagcctgacagctatcgccaatcaagcgaccgtgctcatgggccttgggaagggatggcccctgtccaagatggatatcggcgtgcctctgctcgccattgggtgttattctcaggtcaaccccatcacgctgaccgctgcccttctgctcctggtggctcactacgccattatcggacctggcctgcaggctaaagccacacgggaggcgcagaagagagccgctgccggcattatgaaaaatccgaccgttgacgggatcacagtgatcgatctcgaccccattccttatgatcccaagtttgaaaaacaacttggacaggtcatgctgctgatcctctgcgtgacccaggtcctgatgatgcggacgacatgggctctttgtgaggccctgaccctcgccacaggccctattagcaccctgtgggaagggaaccccggacgcttctggaataccacaatcgcggtgtccatggctaacatttttagaggcagctacctggccggggctggactccttttctctatcatgaagaatacgaccaacacacggcgcggcaccggcaacatcggggagacactgggagagaaatggaagtccagactgaatgccctcggcaagagcgaatttcaaatttataaaaagtctgggatccaggaggttgaccggaccctggccaaagaaggaattaagcgcggcgagacggatcaccatgctgtgtccagagggagcgccaaacttcggtggttcgtcgagcgcaacatggtgacaccggaaggaaaggttgtggacctgggctgcggcagagggggatggtcttactattgtggcgggctcaagaatgtccgggaggtgaaaggactgaccaagggcgggcctggacacgaagaacccatccccatgagcacctacggctggaacctggtgagactccagtccggcgttgatgtctttttcattcctcccgaaaaatgcgacacacttctgtgtgatatcggggagtctagccctaatccgaccgtggaggcgggacgcacactgcgggtgctcaacctggtcgaaaattggcttaacaataacacgcagttctgcatcaaggttctgaatccctacatgccttccgtgattgagaaaatggaagccctccaaagaaagtatggcggggctctggtgcgcaaccccctgagcagaaattccacccatgagatgtactgggtctctaacgccagcggaaatatcgtgtcctctgttaacatgattagcagaatgctcatcaaccgctttacaatgcggcacaagaaagctacctatgaacctgacgtggaccttggctccgggacaagaaatattggaatcgagtctgagattcccaacctggatatcatcggcaagcgcattgagaaaatcaagcaggagcatgaaaccagctggcactacgaccaggatcacccgtataaaacgtgggcctaccatggctcctatgagaccaagcagacagggagcgcgtcttccatggtcaatggagtggttcggctgctcaccaagccttgggacgtgctgcccacagtcacccaaatggccatgacagataccacgcctttcggccagcagagagtgtttaaagaaaaggtggacacacgcacccaggagcccaaagaggggaccaagaaacttatgaagattacagctgaatggctgtggaaagagctcggaaagaagaaaacgcctcggatgtgtaccagagaagagttcacacgcaaggtcagaagcaacgccgctctgggcgccatctttaccgatgagaataaatggaagtctgctcgggaagccgttgaggactcccgcttctgggaactggtggataaagagagaaacctccacctggaagggaagtgcgagacatgtgtgtacaatatgatgggaaagcgggagaagaaacttggcgaatttggcaaagcgaaagggagcagagccatttggtacatgtggctgggagctcggttcctcgagtttgaagccctgggcttccttaacgaggaccattggttttctcgcgaaaattccctgagcggggtcgagggagagggcctccacaaactggggtatatcctgagagatgtgtccaagaaggaaggcggagctatgtacgccgacgacaccgccggctgggatacacggatcaccctcgaggacctgaaaaacgaagagatggttacgaatcacatggaaggggagcataagaaacttgcggaggctattttcaagctgacctatcaaaacaaagtggtccgcgtgcagagacccacaccgcggggaaccgttatggatatcattagccgcagagaccagcggggctctgggcaagtgggaacatacggcctcaatacctttacgaacatggaagcccagctgatccgccagatggagggggaaggcgtcttcaagaatattcagaaccttacagtgaccgaggaggttgccgtgcaaaactggctggctagagtcggacgggaacgcctcagcagaatggccatctccggcgatgactgcgtggtcaagcctctggatgaccggttcgctaatgccctgacagcgctcaacgatatggggaaaatccgcaaggacattcagcagtgggagccctctaaaggatggaatgattggacccaggtgcccttttgcagccaccatttccacgaactgatcatgaaggacggcagagttcttgtggtcccttgtcggaaccaagatgagctgattgggagagcccgcatctcccagggagctggctggtctctccgggaaacggcctgcctggggaaaagctatgctcagatgtggtcccttatgtactttcatagacgcgacctgcggctcgccgcgaatgccatttgttctgctgtgccgagccactgggtgcccacctccagaacaacctggagcatccacgccaagcatgagtggatgacaaccgaggacatgctgacagtttggaaccgcgtgtggattcgggaaaatccttggatggaggataagacccccgtcgaatcttgggaggaaatcccttatctgggcaaaagagaggaccagtggtgcggatccctcatcggcctgacgagccgcgctacatgggccaagaacattcaagctgccatcaatcaggtgcggtctcttattgggaacgaggaatacaccgattacatgccctccatgaaaagattccgccgggaggaagaggaagcgggagttctgtggtga

SEQ ID NO: 20099 - RNA, 9876 nt, synthetic construct
  misc_feature 1..9876: note = derived and/or modified CDS sequence (opt5) from DENV-2__EU482650__SS-prME
  source 1..9876: mol_type = other RNA
agcgccggaatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcagagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccaacagaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacaacgggctggagtgctgtgggatgttccttctccccctcccatgggcaaggcggaactcgaggacggggcctatcgcattaaacagaagggaatcctgggctactcccagatcggcgctggggtgtacaaggaaggaaccttccacacaatgtggcatgtcaccagaggcgccgtgcttatgcacaaagggaagcggattgagccctcctgggccgatgttaaaaaggacctgatcagctatggaggcgggtggaaactcgagggagaatggaaggagggcgaagaggtgcaggtcctggctctcgaacctggcaagaatccgcgcgccgtgcaaacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgaccagaagcggcgcttatgtctctgccatcgcccagacagagaagtccatcgaggataatcctgaaattgaggacgatatctttcggaagcgcagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccaatccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctcagaaagaatggcaaaaaggtgatccagctgagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaaagagagaaagtcgacgccattgatggggaataccgcctccggggagaggctagaaagacgtttgtggaccttatgcgcagaggcgatctgcctgtttggctggcctataaagtggcggccgaggggatcaactacgctgaccggcgctggtgtttcgatggaatcaagaacaatcaaattctcgaagagaacgtcgaagtggagatctggacaaaagagggcgaaagaaagaagctgaaaccccggtggcttgacgcccgcatttattccgatcctctggctctcaaggagtttaaagagttcgccgctgggagaaagtctctgaccctgaatctcatcacagagatgggccggcttcccaccttcatgacgcagaaaaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaagcaaagaacccctcaggacaaccagcttacctacgtggtcatcgctattctgacagtggttgccgccaccatggctaatgaaatgggctttctggagaaaacaaagaaagacctcgggctgggatccatcgccacgcagcaaccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaggcgacggtgctcatgggccttgggaagggatggcccctgagcaaaatggatatcggcgtgcctctgctcgccattgggtgttattcccaggtcaaccccatcaccctgacagctgcccttctgctcctggtggctcactacgccattatcggacctggcctgcaggctaaggccaccagagaggcgcaaaagcgggccgctgccggcattatgaaaaatccgacagttgacgggatcaccgtgatcgatctcgaccccattccttatgatcccaagtttgaaaaacagcttggacaggtcatgctgctgatcctctgcgtgacgcaagtcctgatgatgcgcacaacctgggctctttgtgaggccctgacactcgccaccggccctatttctaccctgtgggaagggaaccccggaaagttctggaatacaacgatcgcggtgagcatggctaacatttttagaggctcctacctggccggggctggactccttttcagcatcatgaaaaataccacaaacacccggcgcggcacaggcaacatgggggagaccctgggagagaagtggaaatctagactgaatacgctcggcaagtccgaatttcagatctataagaaaagcgggattcaggaggttgaccggacactggccaaggaaggaatcaaacgcggcgagaccgatcaccatgccgtgtctagagggtccgctaaacttcggtggttcgtcgagcgcaacatggtgaccccggaaggaaaagttgtggacctgggctgcggcagagggggatggagctactattgtggcgggctcaagaatgtccgggaggtgaagggactgacaaaaggcgggcctggacacgaggaacccattcccatgtctacctacggctggaacctggtgagactccagagcggcgttgatgtctttttcatccctcccgaaaagtgcgacacacttctgtgtgatattggggagtcctctcctaatccgacggtggaggccggacgcaccctgcgggtgctcaacctggtcgaaaattggcttaacaataacacacaattctgcatcaaagttctgaatccctacatgcctagcgtgatcgagaagatggaagcgctccagagaaaatatggcggggccctggtgcgcaaccccctgtcccggaatagcacccatgagatgtactgggtctccaacgcttctggaaatattgtgagctccgttaacatgatctctagaatgctcattaaccgctttacaatgcggcacaagaaggccacctatgaacctgacgtggaccttggcagcgggacgagaaatatcggaattgagtccgagatccccaacctggatattatcggcaaacgcatcgaaaagattaaacaggagcatgaaacctcttggcactacgaccaggatcacccgtataagacatgggcttaccatggcagctatgagaccaaacaaacagggtccgccagctctatggtcaatggagtggttcggctgctcaccaagccttgggacgtgctgcccacagtcacccagatggcgatgacggatacaacccctttcggccagcagagagtgtttaaggaaaaagtggacacccgcacacaagagcccaaggaggggacgaagaaacttatgaaaatcaccgccgaatggctgtggaaagagctcggcaagaagaagacacctcggatgtgtaccagagaagagttcacacgcaaagtcagatccaacgctgccctgggcgctatttttaccgatgagaataagtggaaaagcgcccgggaagctgttgaggactctcgcttctgggaactggtggataaggagagaaacctccacctggaagggaaatgcgagacatgtgtgtacaatatgatgggaaagcgggagaagaaacttggcgaatttggcaaggccaaagggtccagagcgatctggtacatgtggctgggagcccggttcctcgagtttgaagctctgggcttccttaacgaggaccattggtttagccgcgaaaattctctgtccggggtcgagggagagggcctccacaagctggggtatattctgagagatgtgagcaaaaaggaaggcggagccatgtacgctgacgacaccgccggctgggatacgcggatcaccctcgaggacctgaagaacgaagagatggttacaaatcacatggaaggggagcataagaaacttgccgaggcgatcttcaaactgacctatcagaacaaagtggtccgcgtgcagagacccacaccgcggggaaccgttatggatattatctcccgcagagaccaacggggcagcgggcaggtcggaacgtacggcctcaatacatttaccaacatggaagctcagctgattcgccagatggagggggaaggcgtcttcaaaaatatccaacaccttacagtgaccgaggaggttgccgtgcagaactggctggccagagtcggacgggaacgcctctctagaatggctattagcggcgatgactgcgtggtcaagcctctggatgaccggttcgccaacgctctgacggccctcaatgatatggggaagatccgcaaagacatccagcagtgggagccctccaagggatggaacgattggacccaagtgcccttttgctctcatcacttccatgaactgattatgaaagacggcagagttcttgtggtcccttgtcggaatcaggatgagctgatcgggagagcgcgcattagccagggagccggctggtccctccgggaaacagcttgcctggggaagtcttatgcccagatgtggagccttatgtactttcacagacgcgacctgcggctcgctgccaacgcgatctgttccgccgtgccgtctcactgggtgcccaccagcagaacaacctggtccattcatgctaaacacgagtggatgacaaccgaggacatgctgacggtttggaatcgcgtgtggatccgggaaaacccttggatggaggataagacacccgtcgaaagctgggaggaaattccttatctgggcaagagagaggaccaatggtgcggatctctcatcggcctgacctcccgcgccacctgggctaaaaatatccaggccgctattaaccaggtgcggagccttatcgggaatgaggaatacacagattacatgccctctatgaagagattccgccgggaggaagaggaagccggagttctgtggtga

SEQ ID NO: 20100 - RNA, 9876 nt, synthetic construct
  misc_feature 1..9876: note = derived and/or modified CDS sequence (opt5) from DENV-2__EU482651__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgcgccttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattacgggcccctggcatctcgggaagctggagatggacttcgatttttgtgacggaacaaccgtgatcgtcaccgaagattgcggcaaccgcgggcccagcctgcggacaaccacggcttctggaaagctcattacagagtggtgctgtagatcctgcaccctgcctccgcttcggtatcgcggcgaggacggctgttggtacgggatggaaatcagacccctgaaagagaaggaagagaatctcgttaacagcctggtgacagccggacacggccaggtggataatttctccctgggggtccttggaatggccctctttctggaagagatgctgcggaccagagtgggcacaaaacatgctatcctcctggttaccgtgtctttcgtcacgcttattaccgggaacatgagctttaaggacctgggacgcgtggttgtgatggtcggcgcgacaatggccgatgacatcggcatgggggtgacctatctcgctctgctggccgccttcaaagttcggcctacatttgctgccggacttctgctcagaaagctgacctccaaggagctcatgatgacgacaattggcatcgtgctgctttctcaaagcaccattcccgaaacagtcctggagctcaccgatgcgctggctctggggatgatggtgcttaaaatcgtgcgcaatatggaaaagtaccagctggccgtcaccatcatggccattctctgcgttcctaacgctgtggtgctgcagaatgcctggaaagtctcctgtacaatcctcgcggtggtttctgtgagccccctgcttctgacgtccagccagcaaaagaccgactggattcctctcgctctgacaatcaaaggactgaaccccaccgccattttccttacaaccctgtctagaacgaataagaaacggtcctggccgctcaacgaggccatcatggctgtcggcatggtgagcatcctggcctcttccctcctgaagaatgacattcctatgacagggccccttgttgctggaggcctgctgaccgtgtgctatgtcctcaccggccgcagcgccgatctggaacttgagagagcgacagacgtgaagtgggaggatcaggccgaaatctctgggtccagccctattctgtccatcaccattagcgaggacggatctatgagcatcaaaaacgaagaggaggaacagacactcacgattctgatccggaccggcctcctggtcatctccgggctttttcccatttctatcccgattacagctgccgcttggtacctgtgggaggtgaagaaacagcgcgccggagttctgtgggatgtgccttctccccctcccatgggcaaggccgaactcgaggacggggcttatagaatcaaacaaaaggggattctgggctactcccagatcggcgcgggggtctacaaggaaggaaccttccacacaatgtggcatgtgacccggggcgccgttcttatgcacaaagggaagcgcatcgagccctcctgggctgatgtgaaaaaggacctgattagctatggaggcgggtggaaactcgagggagaatggaaggagggcgaagaggtccaggtgctggccctcgaacctggcaagaatccgagagccgtgcagacgaaacccgggctgtttaagaccaacacaggaaccatcggcgctgtttcccttgatttctctcctgggacaagcggatcccccattatcgacaaaaagggcaaagtcgtggggctgtacggaaacggcgtggtcacccggagcggcgcctatgtgtctgcgattgctcaaacagagaagtccatcgaggataatcctgaaatcgaggacgatatttttcgcaagagacggctgacgatcatggacctccaccccggggccggaaaaaccaagagatacctgcctgccattgttcgcgaagctatcaaacggggccttagaacactgattctcgccccgacccgcgtggtcgcggctgagatggaagaggccctgcgggggctccccatcagatatcagacccctgccattaaggctgagcatacaggacgcgaaatcgtggacctgatgtgtcacgccacgttcaccatgcggcttctgagccccgttagagtgcctaactacaatctgatcattatggatgaggctcatttcacagaccccgcctctatcgcggcccgcggctatatttccacccgggtcgaaatgggggaggctgccggcatctttatgacagctaccccgcctggaagcagagatcccttcccccagtccaacgcccctattatcgacgaggaacgggagatccccgaacgctcttggaatagcggccacgagtgggtgacggattttaaagggaagacagtttggttcgtgccttccattaaggccggaaacgacatcgctgcgtgcctccgcaaaaatggcaagaaagtcattcaactgagccggaagacctttgattctgaatacgtgaaaacccgcacaaacgactgggatttcgtggtcaccacagacatctccgagatgggggccaattttaaggctgagagagttattgatccgcggagatgtatgaaacccgtgatccttaccgacggagaggaacgcgtgatcctggccggccctatgcccgtcacgcatagctctgccgctcagcggagagggcgcattggccggaaccctaagaatgaaaacgaccagtacatctatatgggagagcccctcgaaaatgatgaggactgcgcccactggaaggaggcgaaaatgctgctggataacattaatacaccggaaggcatcattcctagcatgttcgagcccgaaagagagaaggtggacgctatcgatggggaataccgcctccggggagaggccagaaaaacctttgttgaccttatgcgcagaggcgatctgcctgtgtggctggcctataaggtcgctgccgaggggattaactacgcggaccggcgctggtgtttcgatggaatcaaaaacaatcagatcctcgaagagaacgtggaagttgagatttggacaaaggagggcgaaagaaagaaactgaagccccggtggcttgacgcccgcatctattccgatcctctggctctcaaagagtttaaggagttcgccgctgggagaaaatctctgaccctgaatctcattacggagatgggccggcttcccaccttcatgacacaaaagaccagagacgccctggataacctggctgtgctccacacagccgaagcgggaggccgcgcctacaatcatgctctgagcgagcttccggagaccctggaaacactcctgctgctcacccttctggccacggtcacagggggaatctttctgttcctcatgtccggccgggggattggaaagatgaccctgggcatgtgctgcatcatcaccgcttctattcttctgtggtatgcccagatccagcctcactggattgccgctagcatcattctcgagtttttcctgatcgtgctgctcatccccgaacccgagaaacagagaacacctcaagacaaccagcttacctacgtcgtgattgcgatcctgacagttgtggccgctacgatggccaatgaaatgggctttctggagaagaccaaaaaggacctcgggctgggatccattgccacacagcagccggagagcaacatccttgatattgacctgcgccccgcttctgcctggaccctctacgcggtggccacaaccttcgtcacgcctatgctgcggcattccatcgaaaatagctccgttaacgtgtctctgaccgctattgccaatcaagctacagtgctcatgggccttgggaaaggatggcccctgagcaagatggatatcggcgtccctctgctcgccatcgggtgttattcccaggtgaaccccattaccctgacagcggcccttctgctcctggttgctcactacgccatcattggacctggcctgcaggctaaggccaccagagaggctcagaaacgggccgcggccggcatcatgaagaatccgacggtggacgggattacagtcatcgatctcgaccccatcccttatgatcccaaatttgaaaagcaacttggacaggtgatgctgctgattctctgcgtcacccaggtgctgatgatgcgcacaacctgggctctttgtgaggccctgaccctcgctacaggccctatctctacgctgtgggaagggaaccccggaagattctggaataccacaattgccgttagcatggccaacatctttcggggctcctacctggcgggggctggactccttttcagcattatgaaaaataccacaaacacccgcagaggcacgggcaacatcggggagacactgggagagaagtggaaatctcggctgaatgccctcggcaagtccgaatttcaaatctataagaaaagcgggattcaggaggtggaccgcaccctggctaaggaaggaatcaaaagaggcgagaccgatcaccatgccgtctctcgggggtccgccaaacttcgctggttcgtggagagaaacatggttacaccggaaggaaaagtggtcgacctgggctgcggccggggaggatggagctactattgtggcgggctcaagaatgtgagagaggtgaagggactgaccaaaggcgggcctggacacgaagaacccattcccatgtctacatacggctggaacctggttcgcctccagagcggcgtcgatgtgtttttcatccctcccgaaaagtgcgacacgcttctgtgtgatattggggagtcctctcctaatccgaccgtggaggctggacggacactgagagtcctcaacctggttgaaaattggcttaacaataacacccagttctgcatcaaagtgctgaatccctacatgcctagcgtgatcgagaagatggaagccctccaacgcaaatatggcggggcgctggtccggaaccccctgtccagaaatagcacacatgagatgtactgggtgtccaacgcctctggaaatattgttagctccgtgaacatgatctctcgcatgctcattaaccggtttaccatgagacacaagaaggctacgtatgaacctgacgtcgaccttggcagcgggacccgcaatatcggaattgagtccgagatccccaacctggatattatcggcaaacggatcgaaaagattaaacaggagcatgaaacatcttggcactacgaccaggatcacccgtataagacctgggcctaccatggcagctatgagacaaaacagaccgggtccgctagctctatggtgaatggagttgtgagactgctcacaaagccttgggacgtcctgcccaccgtgacgcaaatggccatgacagataccacccctttcggccagcagcgcgtgtttaaggaaaaagtcgacacacggacgcaggagcccaaggaggggaccaagaaacttatgaaaatcacagcggaatggctgtggaaagagctcggcaagaagaagacccctagaatgtgtacacgcgaagagttcaccagaaaagttcggtccaacgccgctctgggcgccatttttacagatgagaataagtggaaaagcgctcgcgaagccgtggaggactctagattctgggaactggtggataaggagcggaacctccacctggaagggaaatgcgagacctgtgtctacaatatgatgggaaagagagagaagaaacttggcgaatttggcaaggctaaagggtcccgggccatctggtacatgtggctgggagcgcgcttcctcgagtttgaagccctgggcttccttaacgaggaccattggtttagcagagaaaattctctgtccggggtggagggagagggcctccacaagctggggtatattctgcgggatgttagcaaaaaggaaggcggagctatgtacgccgacgacacggctggctgggatacccgcatcacactcgaggacctgaagaacgaagagatggtgaccaatcacatggaaggggagcataagaaacttgccgaggccatcttcaaactgacatatcaaaacaaagtcgtgagagttcagcggcccaccccgcgcggaacggtgatggatattatctccagacgggaccagcgcggcagcgggcaagtcggaacatacggcctcaatacctttacaaacatggaagcgcagctgattagacagatggagggggaaggcgtgttcaaaaatatccagcaccttaccgttacggaggaggtggctgtccaaaactggctggcccgggtgggacgcgaaagactctctcggatggccattagcggcgatgactgcgtcgtgaagcctctggatgaccgcttcgctaacgccctgaccgctctcaatgatatggggaagatcagaaaagacatccagcagtgggagccctccaagggatggaacgattggacacaggttcccttttgctctcatcacttccatgaactgattatgaaagacggccgggtgcttgtcgtgccttgtagaaatcaagatgagctgatcgggcgcgcccggattagccagggagcgggctggtccctcagagaaaccgcctgcctggggaagtcttatgctcagatgtggagccttatgtactttcaccgccgggacctgagactcgccgctaacgccatctgttccgcggtgccgtctcactgggttcccacaagccgcaccacatggtccattcatgccaaacacgagtggatgaccacggaggacatgctgacagtgtggaatcgggtctggatcagagaaaacccttggatggaggataagacccccgtggaaagctgggaggaaattccttatctgggcaagcgcgaggaccagtggtgcggatctctcatcggcctgacctcccgggctacatgggccaaaaatatccaagctgccattaaccaggttagaagccttatcgggaatgaggaatacaccgattacatgccctctatgaagcgcttccggagagaggaagaggaagctggagtgctgtggtga

SEQ ID NO: 20101 - RNA, 9876 nt, synthetic construct
  misc_feature 1..9876: note = derived and/or modified CDS sequence (opt5) from DENV-2__EU482652__SS-prME
  source 1..9876: mol_type = other RNA
agcgccggcatgatcattatgctgatccccaccgtgatggctttccacctcacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaagacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccctctgtacagggaagttcaaagtggtcaaggagattgctgagacccagcacggaaccatcgtgattcgggttcagtatgaaggcgatgggagcccctgcaaaatccccttcgagatcatggacctggaaaagagatacgtgctgggacgcctcattacagtcaaccctatcgtgacggagaaagattctccggttaacattgaagcggagcccccttttggcgactcctacatcattatcggggtggagcccggccaactgaaacttaattggttcaagaaaggaagctctattggccagatgtttgaaaccacaatgagaggggccaagagaatggctatcctgggagataccgcctgggacttcggcagcctcgggggagtctttacatccatcggcaaagccctgcatcaggtgttcggggctatttatggcgccgcgttttctggagtgagctggaccatgaagatcctgattggcgttatcattacgtggatcgggatgaactcccgcagcacatctctttccgtcagcctcgtgctggtgggaatcgtcaccctgtacctcggcgtgatggttcaggctgattctgggtgtgtggtctcctggaaaaataaggagctgaagtgcggaagcggcattttcatcaccgacaacgtgcacacatggaccgaacaatataaatttcagcctgagtccccctctaaacttgccagcgccattcagaaagctcaggaagaggggatctgtggcattcggtccgttacaagactggagaatctcatgtggaagcaaatcacgccggaactgaaccacatcctggccgagaatgaagtgaaacttaccattatgacaggagatatcaagggcattatgcaggctgggaaacgctctctccggcctcagcccaccgagctgaagtacagctggaagacatggggaaaagccaagatgctgtccaccgaaagctataaccagacgttcctcatcgacggccctgagaccgcggagtgccccaatacaaacagagcctggaactctctggaagtcgaggattacgggtttggagtgttcaccacaaacatttggcttaaactgaaggaaaaacaagacgctttttgtgactccaagctcatgagcgccgctatcaaggataatcgcgccgttcatgcggacatgggctattggatcgagtctgccctgaacgatacctggaaaattgagaaggcttccttcatcgaagtgaaaaattgccactggcctaagagccatacactgtggtctaacggcgtccttgagagcgaaatgattatccccaaaaacctcgccgggccggtgtcccagcacaattaccggcctggataccacacccagattgctggcccctggcatctggggaagctggagatggacttcgatttttgtgacggaacgacagtgatcgtcaccgaagattgcggcaacagagggcccagcctccgcaccacaaccgcctctggaaagctgattacggagtggtgctgtcggtcctgcacacttcctccgctgagatatcggggcgaggacggctgttggtacgggatggaaatccgccccctcaaagagaaggaagagaatctggttaacagcctggtgaccgccggacacggccaagtggataatttctcccttggggtcctcggaatggctctgtttctggaagagatgctcagaacacgggtgggcaccaaacatgcgatcctgcttgttgccgtgtctttcgtcacactgattaccgggaacatgagctttaaggacctcggaagagtggttgtgatggtcggcgctacgatgaccgatgacatcggcatgggggtgacatatctggccctgcttgccgctttcaaagttcgccctacctttgccgcgggactgctcctgcggaagctcacatccaaggagctgatgatgaccacgattggcatcgtgcttctgtctcagagcgctattcccgaaacagtcctcgagctgaccgatgccctggcccttgggatgatggtgctgaaaatcgtgagaaatatggaaaagtaccagctcgctgtcacaatcatggccattctgtgcgttcctaacgcggtgatcctccagaatgcttggaaagtgtcctgtaccattctggccgtcgtgtctgttagcccccttctgctcacctccagccaacagaagacagactggatccctctggccctgacgattaaaggacttaaccccaccgctatcttcctgacaaccctctctcgcacaaataagaaaagatcctggccgctgaacgaggccatcatggctgtgggcatggtcagcattctcgcctcttccctgcttaagaatgacatccctatgaccgggcccctggtggcgggaggcctgctcacggtttgctatgtgctgacaggccggagcgccgatcttgaactggagcgcgctaccgacgtcaagtgggaggatcaggccgaaatttctgggtccagccctatcctctccattaccatcagcgaggacggatctatgagcattaaaaacgaagaggaggaacagacactgaccatcctcatcagaacaggcctgcttgtgatttccgggctgtttcccatctctattccgatcacggctgccgcctggtacctgtgggaggtcaagaaacaacgggctggagtgctctgggatgttccttctccccctcccatgggcaaggcggaactggaggacggggcctatcgcattaaacagaagggaatccttggctactcccagatcggcgctggggtgtacaaggaaggaaccttccacacaatgtggcatgtcaccagaggcgccgtgctgatgcacaaagggaagcggattgagccctcctgggccgatgttaaaaaggacctcatcagctatggaggcgggtggaaactggagggagaatggaaggagggcgaagaggtgcaggtcctcgctctggaacctggcaagaatccgcgcgccgtgcaaacaaaacccgggctttttaagaccaacacgggaaccattggcgcggtgtccctggatttctctcctgggacaagcggatcccccatcattgacaaaaagggcaaagttgtcgggctgtacggaaacggcgtggtgaccagaagcggcgcttatgtctctgccatcgcccagacagagaagtccatcgaggataatcctgaaattgaggacgatatctttcggaagcgcagactcaccattatggacctgcaccccggggctggaaaaacaaagcggtaccttcctgccatcgtgagagaagcgattaaacgcggcctgcggacgctcatcctggctccgaccagagttgtggccgccgagatggaagaggctctccgcgggctgcccattcggtatcagacccctgccatcagagctgagcataccggacgcgaaatcgtcgaccttatgtgtcacgccaccttcacaatgcggctgctgagccccgtgagagttcctaactacaatctcattatcatggatgaggcgcatttcacggaccccgcctctattgctgcccgcggctatatctccacccgggtggaaatgggggaggctgccggcatttttatgacagccaccccgcctggaagcagagatcccttcccccaatccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctgagaaagaatggcaaaaaggtgatccagcttagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatcctgaccgacggagaagaacgcgtgattctcgctggccctatgcccgtgacacatagctctgccgcgcagcggagagggcgcatcggccggaaccctaaaaatgaaaacgaccagtacatttatatgggagagcccctggaaaatgatgaggactgcgctcactggaaggaggccaagatgctgctcgataacatcaataccccggaaggcattatccctagcatgttcgagcccgaaagagagaaagtcgacgccattgatggggaataccgccttcggggagaggctagaaagacgtttgtggacctgatgcgcagaggcgatctgcctgtttggctcgcctataaagtggcggccgaggggatcaactacgctgaccggcgctggtgtttcgatggaatcaagaacaatcaaattctggaagagaacgtcgaagtggagatctggacaaaagagggcgaaagaaagaaacttaaaccccggtggctggacgcccgcatttattccgatcctctcgctctgaaggagtttaaagagttcgccgctgggagaaagtctctgaccctcaatcttatcacagagatgggccggctgcccaccttcatgacgcagaaaaccagagacgccctggataacctcgcggttctgcacacagccgaagctggaggccgcgcctacaatcatgctcttagcgagctgccggagaccctcgaaacactgctgctccttaccctgctggccacagtgaccgggggaatttttctcttcctgatgtccggccgggggatcggaaagatgacgcttggcatgtgctgcatcattacagcctctaccctgctctggtatgctcagatccagcctcactggattgcggccagcatcattctggagtttttcctgatcgtcctccttatccccgaacccgagaagcaaagaacccctcaggacaaccagctgacatacgtggtcattgctatcctgaccgtggttgccgccacaatggctaatgaaatgggctttctcgagaaaacgaagaaagacctggggcttggatccattgccacccagcaaccggagagcaacatcctggatattgacctccgccccgcgtctgcctggacactgtacgctgtggccaccacattcgtgacccctatgctgcggcattccatcgaaaatagctccgtcaacgtttctctcacggctattgccaatcaggcgaccgtgcttatgggcctggggaagggatggcccctgagcaaaatggatatcggcgtgcctctcctggccatcgggtgttattcccaggtcaaccccattacacttaccgctgccctgctcctgctggtggctcactacgccatcattggacctggcctccaggctaaggccacaagagaggcgcaaaagcgggccgctgccggcatcatgaaaaatccgaccgttgacgggattacggtgatcgatcttgaccccatcccttatgatcccaagtttgaaaaacagctgggacaggtcatgctgctcattctgtgcgtgacacaagtccttatgatgcgcaccacatgggctctgtgtgaggccctcaccctggccaccggccctatctctacactgtgggaagggaaccccggaagattctggaatacgaccattgcggtgagcatggctaacatctttcggggctcctacctcgccggggctggacttctgttcagcattatgaagaatacaaccaacacacgcagaggcaccggcaacatgggggagacgctgggagagaaatggaagtctcggctcaatgccctgggcaaatccgaatttcagatctataaaaagagcgggatccaggaggttgaccgcacacttgccaaagaaggaattaagagaggcgagaccgatcaccatgctgtgtctcgggggtccgccaaactgcgctggttcgtcgagagaaacatggtgaccccggaaggaaaggttgtggacctcggctgcggcagagggggatggagctactattgtggcgggctgaaaaatgtccgggaggtgaagggactgacaaagggcgggcctggacacgaggaacccatccccatgtctacctacggctggaacctcgtgcgccttcagagcggcgttgatgtctttttcattcctcccgaaaaatgcgacacactgctgtgtgatatcggggagtcctctcctaatccgacggtggaggcgggacggaccctcagagtgctgaaccttgtcgaaaattggctgaacaataacacacaattctgcattaaggttctcaatccctacatgcctagcgtgatcgagaaaatggaagccctgcagcgcaagtatggcggggctctggtgcggaaccccctctccagaaatagcacccatgagatgtactgggtctccaacgcctctggaaatatcgtgagctccgttaacatgatttctcgcatgcttatcaaccggtttacaatgagacacaaaaaggctacctatgaacctgacgtggacctgggcagcgggacgcgcaatattggaatcgagtccgagattcccaacctggatatcattggcaagcggatcgagaagatcaagcaggagcatgaaacctcttggcactacgaccaggatcacccgtataaaacatgggcctaccatggcagctatgagaccaagcaaacagggtccgcgagctctatggtcaatggagtggttagactcctgaccaaaccttgggacgtgcttcccacagtcacccagatggccatgacggatacaacccctttcggccagcagcgcgtgtttaaggaaaaggtggacacccggacacaagagcccaaagaggggacgaagaaactgatgaagattaccgctgaatggctctggaaagagctgggaaagaaaaagacacctagaatgtgtacccgcgaagagttcacaagaaaggtccggtccaacgccgctctgggcgccatctttaccgatgagaataaatggaaaagcgctcgcgaagccgttgaggactctagattctgggaactcgtggataaagagcggaacctgcaccttgaagggaagtgcgagacatgtgtgtacaatatgatgggaaaaagagagaagaagctgggcgaatttggcaaagcgaaggggtcccgggccatttggtacatgtggctcggagctcgcttcctggagtttgaagcccttggcttcctgaacgaggaccattggtttagcagagaaaattctctctccggggtcgagggagagggcctgcacaaactggggtatatcctccgggatgtgagcaagaaagaaggcggagctatgtacgccgacgacaccgccggctgggatacgcgcattaccctggaggaccttaagaacgaagagatggttacaaatcacatggaaggggagcataagaaactggcggaggctatcttcaagctcacctatcagaacaaagtggtcagagtgcagcggcccacaccgcgcggaaccgttatggatatcatttccagacgggaccaacgcggcagcgggcaggtcggaacgtacggcctgaatacatttaccaacatggaagcccagcttatcagacagatggagggggaaggcgtcttcaagaatattcaacacctgacagtgaccgaggaggttgccgtgaaaaactggctcgctcgggtcggacgcgaaagactgtctcggatggccatcagcggcgatgactgcgtggtcaagcctctggatgaccgcttcgctaacgccctcacggcgctgaatgatatggggaagattagaaaagacatccagcagtgggagccctccaagggatggaacgattggacccaggtgcccttttgctctcatcacttccatgaacttatcatgaaagacggccgggttctggtggtcccttgtagaaatcaagatgagctcattgggcgcgcccggatcagccagggagctggctggtccctgagagaaacagcctgccttgggaagtcttatgctcagatgtggagcctgatgtactttcaccgccgggacctcagactggccgcgaacgccatttgttccgctgtgccgtctcactgggtgcccaccagccgcacaacctggtccatccatgccaaacacgagtggatgacaaccgaggacatgctgacggtttggaatcgggtgtggattagagaaaacccttggatggaggataagacacccgtcgaaagctgggaggaaatcccttatctcggcaagcgcgaggaccagtggtgcggatctctgattggccttacctcccgggctacctgggccaaaaatatccaagctgccatcaaccaggtgagaagcctgattgggaatgaggaatacgcggattacatgccctctatgaagcgcttccggagagaggaagaggaagccggagttctctggtga

SEQ ID NO: 20102 - RNA, 9876 nt, synthetic construct
  misc_feature 1..9876: note = derived and/or modified CDS sequence (opt5) from DENV-2__EU482653__SS-prME
  source 1..9876: mol_type = other RNA
agcgccggcatgatcattatgctgatccccaccgtgatggctttccacctcacaacgagaaatggggaacctcatatgattgtcggaatccaggaaaagggcaagagcctgctttttaagaccgaagacggggttaatatgtgcacactgatggccatggatctcggagaactgtgtgaagacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcgtgaccgacaacgttcacacatggaccgaacagtataagtttcaacctgagtccccctctaaactggccagcgccatccagaaggctcaggaagaggggatttgtggcatccggtccgtgacaagacttgagaatctgatgtggaaacagattacgccggaactcaaccacatcctggccgagaatgaagtcaagctgaccatcatgacaggagatattaaaggcatcatgcaagctgggaagcgctctcttcggcctcagcccaccgagctcaagtacagctggaaaacatggggaaaggccaaaatgctgtccaccgaaagccataaccagacgttcctgattgacggccctgagaccgcggagtgccccaatacaaacagagcctggaactctctcgaagtggaggattatgggtttggagttttcaccacaaacatctggctgcgccttaaggaaaaacaggacgctttttgtgactccaagctgatgagcgccgctattaaggataatcgggccgtgcacgcggacatgggctactggatcgagtctgccctcaacgatacctggaaaatcgagaaggcttccttcattgaagtcaaaaattgccattggcctaagagccacacactgtggtctaacggcgtgctggagagcgaaatgatcattcccaaaaaccttgccgggccggtgtcccaacacaattatagacctggataccatacccagatcgctggcccctggcacctcgggaagctggagatggacttcgatttttgtgacggaacgacagtcattgttaccgaagattgcggcaaccgcgggcccagcctgcggaccacaaccgcctctggaaagctcatcacggagtggtgctgtagatcctgcacactgcctccgcttcggtaccgcggcgaggacggctgttggtatgggatggaaattagacccctgaaagagaaggaagagaatctcgtgaacagcctggtgaccgccggacatggccaggtcgataatttctccctgggggtgcttggaatggctctctttctggaagagatgctgcggacaagagttggcaccaaacacgcgatcctcctggtggccgtctctttcgtgacacttatcaccgggaacatgagctttaaggacctgggacgcgttgtggtcatggtgggcgctacgatggccgatgacattggcatgggggttacctacctcgccctgctggctgccttcaaagtgcggcctacatttgcggctggacttctgctcagaaagctgacctccaaggagctcatgatgacaaccatcggcattgtcctgctttctcaaagcacgatccccgaaacagtgctggagctcaccgatgccctggccctggggatgatggtgcttaaaattgtccgcaatatggaaaagtatcagctggctgttacaatcatggccatcctctgcgtgcctaacgcggtgattctgcagaatgcttggaaagtctcctgtaccatcctcgccgtggtttctgtgagccccctgcttctgacctccagccagcaaaagacagactggattcctctcgccctgacgatcaaaggactgaaccccaccgctattttccttacaaccctgtctagaacaaataagaaacggtcctggccgctcaacgaggccatcatggctgtcggcatggtgagcatcctggcctcttccctcctgaagaatgacattcctatgaccgggccccttgttgcgggaggcctgctgacggtgtgctacgtcctcacaggccgcagcgccgatctggaacttgagagagctaccgacgtgaagtgggaggatcaggccgaaatctctgggtccagccctattctgtccatcaccattagcgaggacggatctatgagcatcaaaaacgaagaggaggaacagacactcaccattctgatccggacaggcctcctggtcatctccgggctttttcccatttctatcccgattacggctgccgcctggtatctgtgggaggtgaagaaacagcgcgctggagttctgtgggatgtgccttctccccctcccatgggcaaggcggaactcgaggacggggcctacagaatcaaacaaaagggaattttcggctattcccagatcggcgctggggtctacaaggaaggaacctttcatacaatgtggcacgtgacccggggcgccgttctgatgcacaaagggaagcgcatcgagccctcctgggccgatgtgaaaaaggaccttattagctacggaggcgggtggaaactggagggagaatggaaggagggcgaagaggtccaggtgctcgctctggaacctggcaagaatccgagagccgtgcagacaaaacccgggctgttcaagaccaacacgggaaccatcggcgcggtttccctggatttttctcctgggacaagcggatcccccattatcgacaaaaagggcaaagtcgtggggctttatggaaacggcgtggtcacccggagcggcgcttacgtgtctgccattgcccaaacagagaagtccatcgaggataatcctgaaatcgaggacgatattttccgcaagagacggctgaccatcatggacctgcatcccggggctggaaaaacaaagagatatctccctgccattgttcgcgaagcgatcaaacggggcctgagaacgcttattctggctccgacccgcgtggtcgccgccgagatggaagaggctctccgggggctgcccatcagataccagacccctgccattcgcgctgagcacaccggacgggaaatcgtggacctcatgtgtcatgccaccttcacaatgagactgcttagccccgttcgcgtgcctaactataatctgatcattatggatgaggcgcactttacggaccccgcctctatcgctgcccggggctacatttccaccagagtcgaaatgggggaggctgccggcatcttcatgacagccaccccgcctggaagccgggatccctttccccagtccaacgctcctattatcgacgaggaacgcgagatccccgaaagatcttggaatagcggccatgagtgggtgacagatttcaaggggaaaaccgtttggtttgtgccttccattaaggcgggaaacgacatcgccgcttgcctgcggaagaatggcaaaaaggtcattcaactcagccgcaaaacgttcgattctgaatatgtgaagacaagaaccaacgactgggattttgtggtcaccacagacatctccgagatgggggccaatttcaaagccgagcgggttattgatccgagacgctgtatgaagcccgtgatcctgaccgacggagaggaacgggtgatccttgctggccctatgcccgtcacacacagctctgccgcgcagagacgcgggcggattggcagaaaccctaaaaatgaaaacgaccagtacatctacatgggagagcccctggaaaatgatgaggactgcgctcactggaaggaggccaagatgctcctggataacattaataccccggaaggcatcattcctagcatgtttgagcccgaacgcgagaaagtggacgccatcgatggggaatatcggctgagaggagaggctcgcaagacgttcgttgacctcatgagacggggcgatcttcctgtgtggctggcctacaaagtcgcggccgaggggattaactatgctgaccgcagatggtgttttgatggaatcaagaacaatcagatcctggaagagaacgtggaagttgagatttggacaaaagagggcgaacggaagaagctcaaaccccgctggctggacgccagaatctactccgatcctcttgctctgaaggagttcaaagagttcgccgctgggcggaagtctctcaccctgaatctgattacagagatgggcagactccccacctttatgacgcagaagacccgcgacgcccttgataacctggcggtgctgcatacagccgaagctggaggccgggcctataatcacgctctcagcgagctgccggagacccttgaaacactgctcctgctgaccctccttgccacagtcaccgggggaatcttcctgtttctgatgtccggcagagggattggaaagatgacgctcggcatgtgctgcatcatcacagcctctattctgctttggtacgctcagatccagcctcattggattgcggccagcatcattctggagttctttctcatcgtgctgctgatccccgaacccgagaagcagcgcacccctcaagacaaccagctcacctatgtcgtgattgctatccttacagttgtggccgccaccatggctaatgaaatgggcttcctggagaaaacaaagaaagacctggggctcggatccattgccacgcagcagccggagagcaacatcctggatattgaccttcggcccgcgtctgcctggaccctgtacgctgtggccacaacctttgtcacacctatgctcagacactccatcgaaaatagctccgttaacgtgtctctgaccgctattgccaatcaagcgacggtgctgatgggcctcgggaagggatggccccttagcaaaatggatatcggcgtccctctgctggccatcgggtgttactcccaggtgaaccccattaccctcacagctgccctgcttctgctcgttgctcactatgccatcattggacctggcctgcaggctaaggccacccgggaggcgcagaagcgcgccgctgccggcatcatgaaaaatccgacagtggacgggattaccgtcatcgatctggaccccatcccttacgatcccaagttcgaaaaacaactcggacaggtgatgcttctgattctgtgcgtcacgcaggtcctcatgatgagaacaacctgggctctgtgtgaggcccttacactggccaccggccctatctctaccctctgggaagggaaccccggacggttttggaatacaacgattgcggttagcatggctaacatcttccgcggctcctatctggccggggctggactgctctttagcattatgaagaataccacaaacgccagacggggcaccggcaacatgggggagacacttggagagaaatggaagtctcgcctgaatgccctgggcaaatccgagttccaaatctacaaaaagagcgggatccaggaggtggacagaaccctcgctaaagaaggaattaagcggggcgagacggatcatcacgccgtctctcgcgggtccgcgaaactgagatggtttgtggagcggaacatggttacaccggaaggaaaggtggtcgaccttggctgcggcagagggggatggagctattactgtggcgggctgaaaaatgtgcgcgaggtgaagggactcaccaagggcgggcctggacatgaagaacccatccccatgtctacctatggctggaacctggttcggctgcagagcggcgtcgatgtgttcttcattcctcccgaaaaatgcgacacactcctttgtgatatcggggagtcctctcctaatccgaccgtggaggccggaagaacactgcgcgtcctgaacctcgttgaaaattggctgaacaataacacgcagttttgcattaaggtgcttaatccctacatgcctagcgtgatcgagaaaatggaagctctgcaacggaagtacggcggggccctcgtcagaaaccccctgtcccgcaatagcacccacgagatgtattgggtgtccaacgcttctggaaatatcgttagctccgtgaacatgatttctcggatgctgatcaacagattcacaatgcgccataaaaaggccacctacgaacctgacgtcgacctcggcagcgggacacggaatattggaatcgagtccgagattcccaaccttgatatcattggcaagagaatcgagaagatcaagcaggagcacgaaacctcttggcactatgaccaggatcatccgtacaaaacgtgggcgtatcacggcagctacgagaccaagcagacagggtccgccagctctatggtgaatggagttgtgcgcctgctgaccaaaccttgggacgtcctccccacagtgacccaaatggctatgacagataccacgccttttggccagcagcgggtgttcaaggaaaaggtcgacacaagaacccaggagcccaaagaggggaccaagaaactgatgaagattacagccgaatggctttggaaagagctgggaaagaaaaagacgcctcgcatgtgtaccagagaagagtttacacggaaggttcgctccaacgctgccctcggcgctatcttcaccgatgagaataaatggaaaagcgccagagaagcggtggaggactctcggttttgggaactggtggataaagagagaaacctgcatctcgaagggaagtgcgagacatgtgtctataatatgatgggaaaacgggagaagaagctgggcgagttcggcaaagccaaggggtcccgcgctatttggtacatgtggcttggagccagatttctggagttcgaagctctcggctttctgaacgaggaccactggttcagccgggaaaattctctttccggggtggagggagagggcctgcacaaactcgggtacatcctgcgcgatgttagcaagaaagaaggcggagccatgtatgccgacgacaccgcgggctgggatacaagaattaccctggaggacctcaagaacgaagagatggtgacgaatcatatggaaggggagcacaagaaactggctgaggccatctttaaacttacctaccaaaacaaagtcgtgcgggttcagcgccccacaccgagaggaaccgtgatggatatcatttcccggcgcgaccagagaggcagcgggcaagtcggaacatatggcctgaataccttcacgaacatggaagcccagctcatccggcagatggagggggaaggcgtgttcaagaatattcagcatctgacagttaccgaggaggtggctgtccaaaactggcttgcccgcgtgggaagagaacggctgtctcgcatggctatcagcggcgatgactgcgtcgtgaaacctctcgatgacagatttgccaacgcgctgacagccctgaatgatatggggaagattcggaaggacatccagcagtgggagccctccaaaggatggaacgattggacccaggttcccttctgctctcaccattttcacgaactcatcatgaaggacggcagagtgctggtcgtgccttgtcgcaatcaagatgagcttattgggcgggctagaatcagccagggagccggctggtccctgcgcgaaacggcttgcctcgggaaatcttacgcccagatgtggagcctgatgtatttccaccggagagaccttcgcctggcggccaacgctatttgttccgccgtgccgtctcattgggttcccaccagccggacaacctggtccatccacgctaagcatgagtggatgacaaccgaggacatgctcacagtgtggaatagagtctggattcgcgaaaacccttggatggaggataaaacccccgtggaaagctgggaggaaatcccttacctgggcaagcgggaggaccagtggtgcggatctctgattggcctcacgtccagagccacatgggctaagaatatccaagccgcgatcaaccaggttcgcagcctgattgggaatgaggaatataccgattacatgccctctatgaaacggtttagacgggaggaagaggaagccggagtgctttggtga

SEQ ID NO: 20103 - RNA, 9876 nt, synthetic construct
  misc_feature 1..9876: note = derived and/or modified CDS sequence (opt5) from DENV-2__EU482654__SS-prME
  source 1..9876: mol_type = other RNA
agcgccggcatgatcattatgctgatccccaccgtgatggctttccacctcacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaaatgaccattatgacaggagatatcaagggcattatgcaggctgggaaacgctctctgcggcctcagcccaccgagcttaagtacagctggaagacatggggaaaagccaagatgctctccaccgaaagctataaccagacgttcctgatcgacggccctgagaccgcggagtgccccaatacaaacagagcctggaactctctggaagtcgaggattacgggtttggagtgttcaccacaaacatttggctcaaactgaaggaaaaacaagacgctttttgtgactccaaacttatgagcgccgctatcaaggataatcgcgccgttcatgcggacatgggctattggatcgagtctgccctgaacgatacctggaaaattgagaaggcttccttcatcgaagtgaaaaattgccactggcctaagagccatacactctggtctaacggcgtcctggagagcgaaatgattatccccaaaaacctggccgggccggtgtcccagcacaattaccggcctggataccacacccagattgctggcccctggcatcttgggaagctcgagatggacttcgatttttgtgacggaacgacagtgatcgtcaccgaagattgcggcaacagagggcccagcctgcgcaccacaaccgcctctggaaagctgattacggagtggtgctgtcggtcctgcacactccctccgctgagatatcggggcgaggacggctgttggtacgggatggaaatccgcccccttaaagagaaggaagagaatctggttaacagcctcgtgaccgccggacacggccaagtggataatttctccctgggggtcctgggaatggctctttttctcgaagagatgctgagaacacgggtgggcaccaaacatgcgatcctgctcgttgccgtgtctttcgtcacactgattaccgggaacatgagctttaaggaccttggaagagtggttgtgatggtcggcgctacgatggccgatgacatcggcatgggggtgacctatctggccctcctggctgccttcaaagttcgccctacatttgcggctggactgcttctgcggaagctcacctccaaggagctgatgatgacaaccattggcatcgtgctcctgtctcagagcacgattcccgaaacagtccttgagctgaccgatgccctcgccctggggatgatggtgctgaaaatcgtgagaaatatggaaaagtaccagcttgctgtcacaatcatggccattctgtgcgttcctaacgcggtgatcctccagaatgcttggaaagtgtcctgtaccattctggccgtcgtgtctgttagccccctcctgcttacctccagccaacagaagacagactggatccctctggccctcacgattaaaggactgaaccccaccgctatcttcctgacaaccctttctcgcacaaataagaaaagatcctggccgctgaacgaggccatcatggctgtgggcatggtcagcattctcgcctcttccctgctcaagaatgacatccctatgaccgggcccctggtggcgggaggccttctgacggtttgctatgtgctgacaggccggagcgccgatctcgaactggagcgcgctaccgacgtcaagtgggaggatcaggccgaaatttctgggtccagccctatcctttccattaccatcagcgaggacggatctatgagcattaaaaacgaagaggaggaacagacactgaccatcctcatcagaacaggcctgctcgtgatttccgggctgtttcccatctctattccgatcacggctgccgcctggtacctttgggaggtcaagaaacaacgggctggagtgctgtgggatgttccttctccccctcccatgggcaaggcggaactggaggacggggcctatcgcattaaacagaagggaatcctcggctactcccagatcggcgctggggtgtacaaggaaggaaccttccacacaatgtggcatgtcaccagaggcgccgtgctgatgcacaaagggaagcggattgagccctcctgggccgatgttaaaaaggaccttatcagctatggaggcgggtggaaactggagggagaatggaaggagggcgaagaggtgcaggtcctcgctctggaacctggcaagaatccgcgcgccgtgcaaacaaaacccgggctctttaagaccaacacgggaaccattggcgcggtgtccctggatttctctcctgggacaagcggatcccccatcattgacaaaaagggcaaagttgtcgggctttacggaaacggcgtggtgaccagaagcggcgcttatgtctctgccatcgcccagacagagaagtccatcgaggataatcctgaaattgaggacgatatctttcggaagcgcagactgaccattatggacctgcaccccggggctggaaaaacaaagcggtacctccctgccatcgtgagagaagcgattaaacgcggcctgcggacgcttatcctggctccgaccagagttgtggccgccgagatggaagaggctctccgcgggctgcccattcggtatcagacccctgccatcagagctgagcataccggacgcgaaatcgtcgacctcatgtgtcacgccaccttcacaatgcggctgcttagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccaatccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctgagaaagaatggcaaaaaggtgatccagctcagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatcctgaccgacggagaggaacgcgtgattcttgctggccctatgcccgtgacacatagctctgccgcgcagcggagagggcgcatcggccggaaccctaaaaatgaaaacgaccagtacatttatatgggagagcccctggaaaatgatgaggactgcgctcactggaaggaggccaagatgctcctggataacatcaataccccggaaggcattatccctagcatgttcgagcccgaaagagagaaagtcgacgccattgatggggaataccgcctgcggggagaggctagaaagacgtttgtggacctcatgcgcagaggcgatcttcctgtttggctggcctataaagtggcggccgaggggatcaactacgctgaccggcgctggtgtttcgatggaatcaagaacaatcaaattctggaagagaacgtcgaagtggagatctggacaaaagagggcgaaagaaagaagctcaaaccccggtggctggacgcccgcatttattccgatcctcttgctctgaaggagtttaaagagttcgccgctgggagaaagtctctcaccctgaatctgatcacagagatgggccggctccccaccttcatgacgcagaaaaccagagacgcccttgataacctggcggttctgcacacagccgaagctggaggccgcgcctacaatcatgctctcagcgagctgccggagacccttgaaacactgctcctgctgaccctccttgccacagtgaccgggggaatttttctgttcctgatgtccggccgggggatcggaaagatgacgctcggcatgtgctgcatcattacagcctctatcctgctttggtatgctcagattcagcctcactggatcgcggccagcattatcctggagtttttcctcatcgtcctgctgattcccgaacccgagaagcaaagaacccctcaggacaaccagctcacctacgtggtcatcgctattcttacagtggttgccgccaccatggctaatgaaatgggctttctggagaaaacaaagaaagacctggggctcggatccatcgccacgcagcaaccggagagcaacattctggatatcgaccttcgccccgcgtctgcctggaccctgtacgctgtggccacaaccttcgtgacacctatgctccggcattccattgaaaatagctccgtcaacgtttctctgaccgctatcgccaatcaggcgacggtgctgatgggcctcgggaagggatggccccttagcaaaatggatatcggcgtgcctctgctggccattgggtgttattcccaggtcaaccccatcaccctcacagctgccctgcttctgctcgtggctcactacgccattatcggacctggcctgcaggctaaggccaccagagaggcgcaaaagcgggccgctgccggcattatgaaaaatccgacagttgacgggatcaccgtgatcgatctggaccccattccttatgatcccaagtttgaaaaacagctcggacaggtcatgcttctgatcctgtgcgtgacgcaagtcctcatgatgcgcacaacctgggctctgtgtgaggcccttacactggccaccggccctatttctaccctctgggaagggaaccccggaagattctggaatacaacgatcgcggtgagcatggctaacatttttcggggctcctacctggccggggctggactgctgttcagcatcatgaagaataccacaaacacccgcagaggcacaggcaacatgggggagacccttggagagaaatggaagtctcggctgaatacgctgggcaaatccgaatttcagatctataaaaagagcgggattcaggaggttgaccgcacactcgccaaagaaggaatcaagagaggcgagaccgatcaccatgccgtgtctcgggggtccgctaaactgcgctggttcgtcgagagaaacatggtgaccccggaaggaaaggttgtggaccttggctgcggcagagggggatggagctactattgtggcgggctgaaaaatgtccgggaggtgaagggactcacaaagggcgggcctggacacgaagaacccattcccatgtctacctacggctggaacctggtgcgcctgcagagcggcgttgatgtctttttcatccctcccgaaaaatgcgacacactcctttgtgatattggggagtcctctcctaatccgacggtggaggccggacggaccctgagagtgctgaacctcgtcgaaaattggctgaacaataacacacaattctgcatcaaggttcttaatccctacatgcctagcgtgatcgagaaaatggaagcgctgcagcgcaagtatggcggggccctcgtgcggaaccccctgtccagaaatagcacccatgagatgtactgggtctccaacgcttctggaaatattgtgagctccgttaacatgatctctcgcatgctgattaaccggtttacaatgagacacaaaaaggccacctatgaacctgacgtggacctcggcagcgggacgcgcaatatcggaattgagtccgagacccccaaccttgatatcattggcaagcggatcgagaagatcaagcaggagcatgaaacatcttggcactacgaccaggatcacccgtataaaacctgggcttaccatggcagctatgagacaaagcaaaccgggtccgccagctctatggtcaatggagtggttagactgctgacaaaaccttgggacgtgctccccaccgtcacgcagatggcgatgacagataccacccctttcggccagcagcgcgtgtttaaggaaaaggtggacacacggacgcaagagcccaaagaggggaccaagaaactgatgaagattacagccgaatggctttggaaagagctgggaaagaaaaagacccctagaatgtgtacacgcgaagagttcaccagaaaggtccggtccaacgctgccctcggcgctatctttacagatgagaataaatggaaaagcgcccgcgaagctgttgaggactctagattctgggaactggtggataaagagcggaacctgcacctcgaagggaagtgcgagacctgtgtgtacaatatgatgggaaaaagagagaagaagctgggcgaatttggcaaagccaaggggtcccgggcgatttggtacatgtggcttggagcccgcttcctggagtttgaagctctcggcttcctgaacgaggaccattggtttagcagagaaaattctctttccggggtcgagggagagggcctgcacaaactcgggtatatcctgcgggatgtgagcaagaaagaaggcggagccatgtacgctgacgacacggccggctgggatacccgcattacactggaggacctcaagaacgaagagatggttaccaatcacatggaaggggagcataagaaactggccgaggcgatcttcaaacttacatatcagaacaaagtggtcagagtgcagcggcccaccccgcgcggaacggttatggatatcatttccagacgggaccaacgcggcagcgggcaggtcggaacatacggcctgaatacctttacaaacatggaagctcagctcatcagacagatggagggggaaggcgtcttcaagaatattcaacacctgaccgtgacggaggaggttgccgtgcagaactggcttgcccgggtcggacgcgaaagactgtctcggatggctatcagcggcgatgactgcgtggtcaaacctctcgatgaccgcttcgccaacgctctgaccgccctgaatgatatggggaagattagaaaggacatccagcagtgggagccctccaaaggatggaacgattggacacaagtgcccttttgctctcatcacttccatgaactcatcatgaaggacggccgggttctggtggtcccttgtagaaatcaggatgagcttattgggcgcgcgcggatcagccagggagccggctggtccctgagagaaaccgcttgcctcgggaaatcttatgcccagatgtggagcctgatgtactttcaccgccgggaccttagactggctgccaacgcgatttgttccgccgtgccgtctcactgggtgcccacaagccgcaccacatggtccatccatgctaagcacgagtggatgaccacggaggacatgctcacagtttggaatcgggtgtggattagagaaaacccttggatggaggataaaacccccgtcgaaagctgggaggaaatcccttatctgggcaagcgcgaggaccaatggtgcggatctctgattggcctcacctcccgggccacatgggctaagaatatccaggccgctatcaaccaggtgagaagcctgattgggaatgaggaatacaccgattacatgccctctatgaaacgcttccggagagaggaagaggaagccggagttctttggtga

SEQ ID NO: 20104 - RNA, 9876 nt, synthetic construct
  misc_feature 1..9876: note = derived and/or modified CDS sequence (opt5) from DENV-2__EU482656__SS-prME
  source 1..9876: mol_type = other RNA
agcgccggcatgatcattatgctgatccccaccgtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcgtgaccgacaacgttcacacatggaccgaacagtataagtttcaacctgagtccccctctaaactggccagcgccatccagaaggctcaggaagaggggatttgtggcatccggtccgtgacaagacttgagaatctgatgtggaaacagattacgccggaactcaaccacatcctggccgagaatgaagtcaagctgaccatcatgacaggagatattaaaggcatcatgcaagctgggaagcgctctcttcggcctcagcccaccgagctcaagtacagctggaaaacatggggaaaggccaaaatgctgtccaccgaaagccataaccagacgttcctgattgacggccctgagaccgcggagtgccccaatacaaacagagcctggaactctctcgaagtggaggattatgggtttggagttttcaccacaaacatctggctgaaacttaaagaaaagcaggacgctttttgtgactccaagctgatgagcgccgctattaaagataatcgcgccgtgcacgcggacatgggctactggatcgagtctgccctcaacgatacctggaagatcgagaaggctagcttcattgaagtcaagaattgccattggcctaaaagccacacactgtggtctaacggcgtgctggagagcgaaatgatcattcccaagaaccttgccgggccggtgtcccaacacaattatcggcctggataccatacccagatcgctggcccctggcacctcgggaagctggagatggacttcgatttttgtgacggaacgacagtcattgttaccgaagattgcggcaacagagggcccagcctgcgcaccacaaccgcctctggaaaactcatcacggagtggtgctgtcggtcctgcacactgcctccgcttagataccggggcgaggacggctgttggtatgggatggaaattcgccccctgaaggagaaagaagagaatctcgtgaacagcctggtgaccgccggacatggccaggtcgataatttctccctgggggtgcttggaatggctctctttctggaagagatgctgagaacacgggttggcaccaagcacgcgatcctcctggtggccgtctctttcgtgacacttatcaccgggaacatgagctttaaagacctgggaagagttgtggtcatggtgggcgctacgatggccgatgacattggcatgggggttacctacctcgccctgctggctgccttcaaggtgcgccctacatttgcggctggacttctgctccggaagctgacctccaaagagctcatgatgacaaccatcggcattgtcctgctttctcaaagcacgatccccgaaacagtgctggagctcaccgatgccctggccctggggatgatggtgcttaagattgtcagaaatatggaaaaatatcagctggctgttacaatcatggccatcctctgcgtgcctaacgcggtgattctgcagaatgcttggaaggtctcctgtaccatcctcgccgtggtttctgtgagccccctgcttctgacctccagccagcagaagaccgactggattcctctcgccctgacgatcaagggactgaaccccaccgctattttccttacaaccctgtctcgcacaaataaaaagagatcctggccgctcaacgaggccatcatggctgtcggcatggtgagcatcctggcctcttccctcctgaagaatgacattcctatgaccgggccccttgttgcgggaggcctgctgacggtgtgctacgtcctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccattctgatcagaacaggcctcctggtcatctccgggctttttcccatttctatcccgattacggctgccgcctggtatctgtgggaggtgaaaaagcagcgggctggagttctgtgggatgtgccttctccccctcccatgggcaaagcggaactcgaggacggggcctaccgcatcaagcaaaaggggattctgggctattcccagatcggcgctggggtctacaaagaaggaaccttccatacaatgtggcacgtgaccagaggcgccgttcttatgcacaaggggaaacggatcgagccctcctgggccgatgtgaagaaagacctgattagctacggaggcgggtggaagctcgagggagaatggaaggagggcgaagaggtccaggtgctggctctcgaacctggcaaaaatccgcgcgccgtgcagacaaagcccgggctgtttaaaaccaacacgggaaccatcggcgcggtttcccttgatttctctcctgggacaagcggatcccccattatcgacaagaaaggcaaggtcgtggggctgtatggaaacggcgtggtcaccagaagcggcgcttacgtgtctgccattgcccaaacagagaagtccatcgaggataatcctgaaatcgaggacgatatttttcggaaacgcagactgaccatcatggacctccatcccggggctggaaagacaaaacggtatctgcctgccattgttagagaagcgatcaagcgcggccttcggacgctgattctcgctccgaccagagtggtcgccgccgagatggaagaggctctgcgcgggctccccatccggtaccagacccctgccattagagctgagcacaccggacgcgaaatcgtggacctgatgtgtcatgccaccttcacaatgcggcttctgagccccgttagagtgcctaactataatctgatcattatggatgaggcgcacttcacggaccccgcctctatcgctgcccgcggctacatttccacccgggtcgaaatgggggaggctgccggcatctttatgacagccaccccgcctggaagcagagatcccttcccccagtccaacgctcctattctcgacgaggaacgggagatccccgaacgctcttggaatagcggccatgagtgggtgacagattttgaagggaaaaccgtttggttcgtgccttccatcaaggcgggaaacgacattgccgcttgcctgagaaagaatggcaaaaaggtcatccaacttagccggaaaacgtttgattctgagtatgtgaagacacgcaccaacgactgggatttcgtggtcaccacagacatttccgagatgggggccaattttaaagccgaaagagttatcgatccgcggagatgtatgaagcccgtgattctgaccgacggagaggaacgcgtgatcctcgctggccctatgcccgtcacacacagctctgccgcgcagcggagagggcgcatcggccggaaccctaaaaatgagaacgaccagtacatttacatgggagaacccctggagaatgatgaggactgcgctcactggaaggaagccaagatgctgctcgataacatcaataccccggagggcattatccctagcatgttcgaacccgagagagaaaaagtggacgccattgatggggagtatcgccttcggggagaggctagaaagacgtttgttgacctgatgcgcagaggcgatctgcctgtgtggctcgcctacaaagtcgcggccgaagggatcaactatgctgaccggcgctggtgtttcgatggaattaagaacaatcagatcctggaggaaaacgtggaggttgagatctggacaaaagaaggcgagagaaagaaacttaaaccccggtggctggacgcccgcatttactccgatcctctcgctctgaaggaatttaaagagttcgccgctgggagaaagtctctgaccctcaatcttatcacagaaatgggccggctgcccaccttcatgacgcagaagaccagagacgccctggataacctcgcggtgctgcatacagccgaggctggaggccgcgcctataatcacgctcttagcgagctgccggaaaccctcgagacactgctgctccttaccctgctggccacagtcaccgggggaatttttctcttcctgatgtccggccgggggatcggaaagatgacgcttggcatgtgctgcattatcacagcctctatcctgctctggtacgctcagattcagcctcattggatcgcggccagcattatcctggaatttttcctgattgtgctccttatccccgagcccgaaaagcagagaacccctcaagacaaccagctgacctatgtcgtgatcgctattctgacagttgtggccgccaccatggctaatgagatgggctttctcgagaaaacaaagaaagacctggggcttggatccgtggccacgcagcagccggaaagcaacatcctggatattgacctccgccccgcgtctgcctggaccctgtacgctgtcgccacaaccttcgttacacctatgctgcggcactccatcgagaatagctccgtgaacgtgtctctcaccgctattgccaatcaagcgacggtccttatgggcctggggaagggatggcccctgagcaaaatggatatcggcgtgcctctcctggccattgggtgttactcccaggttaaccccatcacccttacagctgccctgctcctgctggtggctcactatgccatcattggacctggcctccaggctaaggccaccagagaagcgcagaagcgggccgctgccggcatcatgaaaaatccgacagtcgacgggattaccgtgatcgatcttgaccccattccttacgatcccaagtttgagaaacaactgggacaggtcatgctgctcatcctgtgcgtgacgcaggttcttatgatgcgcacaacctgggctctgtgtgaagccctcacactggccaccggccctatctctaccctgtgggaggggaaccccggaagattctggaatacaacgattgcggtgagcatggctaacatctttcggggctcctatctcgccggggctggacttctgttcagcattatgaagaataccacaaacacccgcagaggcacaggcaacatgggggagaccctgggagaaaaatggaagtctcggctcaatgccctgggcaaatccgagtttcaaatctacaaaaagagcgggattcaggaagtcgaccgcacgcttgccaaagagggaatcaagagaggcgagacagatcatcacgctgtgtctcgggggtccgccaaactgcgctggttcgttgaaagaaacatggtgaccccggagggaaaggtcgtggacctcggctgcggccggggaggatggagctattactgtggcgggctgaaaaatgtgagagaagttaagggactgaccaagggcgggcctggacatgaggaacccatccccatgtctacatatggctggaacctcgtccgccttcagagcggcgtggatgtgtttttcattcctcccgagaaatgcgacaccctgctgtgtgatatcggggagtcctctcctaatccgacagtcgaagcgggacggacgctcagagttctgaaccttgtggagaattggctgaacaataacacccagttctgcattaaggtgctcaatccctacatgcctagcgtcatcgagaagatggaggccctgcaacgcaagtacggcggggctctggtgcggaaccccctctccagaaatagcacacacgaaatgtattgggtttccaacgcctctggaaatattgtgagctccgtcaacatgatctctcgcatgcttatcaaccggtttaccatgagacataaaaaggctacatacgagcctgacgtggacctgggcagcgggacccgcaatattggaatcgagtccgaaattcccaacctggatatcattggcaagcggatcgagaaaattaagcaggaacacgagacgtcttggcactatgaccaggatcatccgtacaaaacctgggcctatcacggcagctacgaaacaaagcagaccgggtccgcgagctctatggttaatggagtggtcagactcctgacaaaaccttgggacgtgcttcccaccgtgacacaaatggccatgaccgatacgacacctttcggccagcagcgcgtctttaaggagaaggttgacacccggacccaggagcccaaagaagggacaaagaaactgatgaagatcacggctgagtggctctggaaagaactgggaaagaaaaagacccctagaatgtgtacacgcgaggagttcaccagaaaggtgcggtccaacgccgctctgggcgccatctttacagatgaaaataaatggaaaagcgctcgcgaggccgtggaagactctagattctgggagctcgtcgataaagaacggaacctgcatcttgaggggaagtgcgagacctgtgtgtataatatgatgggaaaaagagaaaagaagctgggcgagtttggcaaagcgaaggggtcccgggccatttggtacatgtggctcggagctcgcttcctggaatttgaggcccttggcttcctgaacgaagaccactggtttagcagagaaaattctctctccggggttgagggagaaggcctgcacaaactggggtacatcctccgggatgtgagcaagaaagagggcggagctatgtatgccgacgacacagccggctgggatacccgcattacgctggaagaccttaagaacgaggaaatggtcaccaatcatatggagggggagcacaagaaactggcggaagctatcttcaagctcacataccaaaacaaagtggttagagtgcagcggcccaccccgcgcggaacagtcatggatattatctccagacgggaccagcgcggcagcgggcaagtgggaacctatggcctgaatacgtttacaaacatggaggcccagcttatcagacagatggaaggggagggcgttttcaagaatattcagcatctgaccgtgacagaggaagtcgccgtgcaaaactggctcgctcgggtcggacgcgagagactgtctcggatggccatcagcggcgatgactgcgtggttaaacctctggatgaccgcttcgctaacgccctcaccgcgctgaatgatatggggaagattagaaaggacatccagcagtgggaaccctccaaaggatggaacgattggacgcaagtccccttttgctctcaccatttccacgagcttattatgaaggacggccgggtcctggtggtgccttgtagaaatcaagatgaactcatcgggcgcgcccggatcagccagggagctggctggtccctgagagagaccgcctgccttgggaaatcttacgctcagatgtggagcctgatgtattttcaccgccgggacctcagactggccgcgaacgccatttgttccgctgttccgtctcattgggtgcccacaagccgcaccacatggtccatccacgccaagcatgagtggatgaccacagaagacatgctgaccgtctggaatcgggtgtggattagagagaacccttggatggaagataaaacgcccgttgagagctgggaagagatcccttacctcggcaagcgcgaggaccagtggtgcggatctctgattggccttacatcccgggctacctgggccaagaatatccaagctgccattaaccaggtgagaagcctgatcgggaatgaagagtataccgattacatgccctctatgaaacgcttccggagagaagaggaagaggcgggagtcctctggtga

SEQ ID NO: 20105 - RNA, 9876 nt, synthetic construct
  misc_feature 1..9876: note = derived and/or modified CDS sequence (opt5) from DENV-2__EU482657__SS-prME
  source 1..9876: mol_type = other RNA
agcgccggaatgatcattatgctgatccccaccgtgatggctttccacctcacaacgagaaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattatgcggcatcccgggttcaccatcatggccgctattctggcctacacaatcggaaccacccactttcagcgcgttctcattttcatcctgcttacagctgtggccccttccatgacgatgagatgcattggcatctctaaccgggattttgtcgaaggggtgagcggaggctcctgggttgacatcgtgctggagcacgggagctgtgtcaccacaatggcgaagaataagcccaccctcgatttcgaactgattaaaacagaggccaagcagcctgctacccttcgcaaatattgcatcgaagccaagctgacgaacacaaccaccgagtctagatgtccgacacaaggagagccctccctcaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctggaatacacgattgtggtgacaccccactctggggaggagcatgccgtcggaaacgacacaggcaaacacggcaaggaaatcaaagtgacccctcagtccagcatcacagaggcggaactcaccgggtatggaacggttaccatggagtgttctcccagaacaggcctggatttcaatgaaatggtgcttctgcaaatggagaacaaggcctggctcgtccaccggcagtggtttctggaccttccgctgccttggctccccggggctgataagcaggagtccaattggattcagaaagaaaccctggtgacattcaagaaccctcatgccaaaaagcaagacgttgtggtcctgggaagccaggagggcgctatgcacaccgccctcacgggggccacagaaatccagatgtcctctggcaatctgctttttaccggacatctgaaatgccgcctcagaatggacaagctgcaacttaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctggagaagcggtacgtgctcggacgcctgattacagtcaaccctatcgtgacggagaaggattctccggttaacattgaagcggagcccccttttggcgactcctacatcattatcggggtggagcccggccagctgaagctcaattggttcaaaaagggaagctctattggccaaatgtttgaaaccacaatgagaggggccaaaagaatggctatcctgggagataccgcctgggacttcggcagccttgggggagtctttacatccatcggcaaggccctgcatcaggtgttcggggctatttatggcgccgcgttttctggagtgagctggaccatgaaaatcctcattggcgttatcattacgtggatcgggatgaactcccgcagcacatctctgtccgtcagcctggtgcttgtgggaatcgtcaccctctacctgggcgtgatggttcaggctgattctgggtgtgtggtctcctggaagaataaggagctgaaatgcggaagcggcattttcatcaccgacaacgtgcacacatggaccgaacagtataagtttcaacctgagtccccctctaaactcgccagcgccattcagaaggctcaggaagaggggatctgtggcattcggtccgttacaagactggagaatcttatgtggaaacagatcacgccggaactgaaccacatcctcgccgagaatgaagtgaagctgaccattatgacaggagatatccgcggcattatgcaagctgggaaacggtctctgagacctcagcccaccgagcttaagtacagctggaagacatggggaaaagccaagatgctctccaccgaaagctataaccagacgttcctgatcgacggccctgagaccgcggagtgccccaatacaaaccgcgcctggaactctctggaagtcgaggattacgggtttggagtgttcaccacaaacatttggctcaaactgaaggaaaaacaggacgctttttgtgactccaaacttatgagcgccgctatcaaggataatcgggccgttcatgcggacatgggctattggatggagtctgccctgaacgatacctggaaaatcgagaaggcttccttcattgaagtgaaaaattgccactggcctaagagccatacactctggtctaacggcgtcctggagagcgaaatgatcattcccaaaaacctggccgggccggtgtcccaacacaattacagacctggataccacacccagatcgctggcccctggcatcttgggaagctcgagatggacttcgatttttgtgacggaacgacagtgattgtcaccgaagattgcggcaaccgcgggcccagcctgcggaccacaaccgcctctggaaagctgatcacggagtggtgctgtagatcctgcacactccctccgctgcggtatcgcggcgaggacggctgttggtacgggatggaaattagaccccttaaagagaaggaagagaatctggttaacagcctcgtgaccgccggacacggccaggtggataatttctccctgggggtcctgggaatggctctttttctcgaagagatgctgcggacaagagtgggcaccaaacatgcgatcctgctcgttgccgtgtctttcgtcacactgatcaccgggaacatgagctttaaggaccttggacgcgtggttgtgatggtcggcgctacgatggccgatgacattggcatgggggtgacctatctggccctcctggctgccttcaaagttcggcctacatttgcggctggactgcttctgagaaagctcacctccaaggagctgatgatgacaaccatcggcattgtgctcctgtctcaaagcacgatccccgaaacagtccttgagctgaccgatgccctcgccctggggatgatggtgctgaaaattgtgcgcaatatggaaaagtaccagcttgctgtcacaatcatggccatcctgtgcgttcctaacgcggtgattctccagaatgcttggaaagtgtcctgtaccatcctggccgtcgtgtctgttagccccctcctgcttacctccagccagcaaaagacagactggattcctctggccctcacgatcaaaggactgaaccccaccgctattttcctgacaaccctttctagaacaaataagaaacggtcctggccgctgaacgaggccatcatggctgtgggcatggtcagcatcctcgcctcttccctgctcaagaatgacattcctatgaccgggcccctggtggcgggaggccttctgacggtttgctatgtgctgacaggccgcagcgccgatctcgaactggagagagctaccgacgtcaagtgggaggatcaggccgaaatctctgggtccagccctattctttccatcaccattagcgaggacggatctatgagcatcaaaaacgaagaggaggaacagacactgaccattctcatccggacaggcctgctcgtgatctccgggctgtttcccatttctatcccgattacggctgccgcctggtacctttgggaggtcaagaaacagcgcgctggagtgctgtgggatgttccttctccccctcccatgggcaaggcggaactggaggacggggcctatagaatcaaacaaaagggcattctgggctactcccagatcggcgctggggtgtacaaggaaggaaccttccacacaatgtggcatgtcacccggggcgccgtgctgatgcacaaagggaagcgcatcgagccctcctgggccgatgttaaaaaggaccttattagctatggaggcgggtggaaactggagggagaatggaaggagggcgaagaggtgcaggtcctcgctctggaacctggcaagaatccgagagccgtgcagacaaaacccgggctctttaagaccaacacgggaaccatcggcgcggtgtccctggatttctctcctgggacaagcggatcccccattatcgacaaaaagggcaaagttgtcgggctttacggaaacggcgtggtgacccggagcggcgcttatgtctctgccattgcccaaacagagaagtccatcgaggataatcctgaaatcgaggacgatatttttcgcaagagacggctgaccatcatggacctgcaccccggggctggaaaaacaaagagatacctccctgccattgtgcgcgaagcgatcaaacggggcctgagaacgcttattctggctccgacccgcgttgtggccgccgagatggaagaggctctccgggggctgcccatcagatatcagacccctgccattcgcgctgagcataccggacgggaaatcgtcgacctcatgtgtcacgccaccttcacaatgagactgcttagccccgtgcgcgttcctaactacaatctgatcattatggatgaggcgcatttcacggaccccgcctctatcgctgcccggggctatatttccaccagagtggaaatgggggaggctgccggcatctttatgacagccaccccgcctggaagccgggatcccttcccccagtccaacgctcctattatcgacgaggaacgcgagatccccgaaagatcttggaatagcggccacgagtgggtcacagattttaaggggaaaaccgtgtggttcgttccttccattaaggcgggaaacgacatcgccgcttgcctgcggaagaatggcaaaaaggtgattcaactcagccgcaaaacgtttgattctgaatacgtcaagacaagaaccaacgactgggatttcgtggtgaccacagacatctccgagatgggggccaattttaaagccgagcgggtcattgatccgagacgctgtatgaagcccgttatcctgaccgacggagaagaacgggtgatccttgctggccctatgcccgtgacacatagctctgccgcgcagagacgcgggcggattggcagaaaccctaaaaatgaaaacgaccagtacatctatatgggagagcccctggaaaatgatgaggactgcgctcactggaaggaggccaagatgctcctggataacattaataccccggaaggcatcattcctagcatgttcgagcccgaacgcgagaaagtcgacgccatcgatggggaataccggctgagaggagaggctcgcaagacgtttgtggacctcatgagacggggcgatcttcctgtttggctggcctataaagtggcggccgaggggattaactacgctgaccgcagatggtgtttcgatggaatcaagaacaatcagatcctggaagagaacgtcgaagtggagatttggacaaaagagggcgaacggaagaagctcaaaccccgctggctggacgccagaatctattccgatcctcttgctctgaaggagtttaaagagttcgccgctgggcggaagtctctcaccctgaatctgattacagagatgggcagactccccaccttcatgacgcagaagacccgcgacgcccttgataacctggcggttctgcacacagccgaagctggaggccgggcctacaatcatgctctcagcgagctgccggagacccttgaaacactgctcctgctgaccctccttgccacagtgaccgggggaatctttctgttcctgatgtccggcagagggattggaaagatgacgctcggcatgtgctgcatcatcacagcctctaccctgctttggtatgctcagattcagcctcactggatcgcggccagcattatcctggagtttttcctcattgtcctgctgatccccgaacccgagaagcagcgcacccctcaagacaaccagctcacatacgtggtcatcgctattcttaccgtggttgccgccacaatggctaatgaaatgggctttctggagaaaacgaagaaagacctggggctcggatccatcgccacccagcagccggagagcaacattctggatatcgaccttcggcccgcgtctgcctggacactgtacgctgtggccaccacattcgtgacccctatgctcagacattccattgaaaatagctccgtcaacgtttctctgacggctatcgccaatcaagcgaccgtgctgatgggcctcgggaagggatggccccttagcaaaatggatattggcgtgcctctgctggccatcgggtgttattcccaggtcaaccccatcacactcaccgctgccctgcttctgctcgtggctcactacgccattatcggacctggcctgcaggctaaggccacacgggaggcgcagaagcgcgccgctgccggcattatgaaaaatccgaccgttgacgggatcacggtgattgatctggaccccatcccttatgatcccaagtttgaaaaacaactcggacaggtcatgcttctgatcctgtgcgtgacacaggtcctcatgatgagaaccacatgggctctgtgtgaggcccttaccctggccaccggccctatttctacactctgggaagggaaccccggacggttctggaatacgaccatcgcggtgagcatggctaacatttttcgcggctcctacctggccggggctggactcctcttcagcatcatgaagaatacaaccaacacaagacggggcaccggcaacattggggagacgcttggagagaaatggaagtctcgcctgaatgccctgggcaaatccgaatttcaaatctataaaaagagcgggatccaggaggttgacagaacactcgccaaagaaggaattaagcggggcgagaccgatcaccatgctgtgtctcgcgggtccgccaaactgagatggttcgtcgagcggaacatggtgaccccggaaggaaaggttgtggaccttggctgcggcagagggggatggagctactattgtggcgggctgaaaaatgtccgcgaggtgaagggactcacaaagggcgggcctggacacgaagaacccatccccatgtctacctacggctggaacctggtgcggctgcagagcggcgttgatgtctttttcattcctcccgaaaaatgcgacacactcctttgtgatatcggggagtcctctcctaatccgacggtggaggcgggaagaaccctgcgcgtgctgaacctcgtcgaaaattggctgaacaataacacacagttctgcattaaggttcttaatccctacatgcctagcgtgatcgagaaaatggaagccctgcaacggaagtatggcggggctctcgtgagaaaccccctgtcccgcaatagcacccatgagatgtactgggtctccaacgcctctggaaatatcgtgagctccgttaacatgatttctcggatgctgatcaacagatttacaatgcgccacaaaaaggctacctatgaacctgacgtggacctcggcagcgggacgcggaatattggaatcgagtccgagattcccaaccttgatatcattggcaagagaatcgagaagatcaagcaggagcatgaagcctcttggcactacgaccaggatcacccgtataaaacctgggcgtaccatggcagctatgagacaaagcagaccgggtccgccagctctatggtcaatggagtggttcgcctgctgacaaaaccttgggacgtgctccccaccgtcacacaaatggctatgaccgatacgacacctttcggccagcagcgggtgtttaaggaaaaggtggacaccagaacccaggagcccaaagaggggacaaagaaactgatgaagattacggccgaatggctttggaaagagctgggaaagaaaaagacccctcgcatgtgtacaagagaagagttcacccggaaggtccgctccaacgctgccctcggcgctatctttacagatgagaataaatggaaaagcgccagagaagcggttgaggactctcggttctgggaactggtggataaagagagaaacctgcacctcgaagggaagtgcgagacctgtgtgtacaatatgatgggaaaacgggagaagaagctgggcgaatttggcaaagccaaggggtcccgcgctatttggtacatgtggcttggagccagattcctggagtttgaagctctcggcttcctgaacgaggaccattggtttagccgggaaaattctctttccggggtcgagggagagggcctgcacaaactcgggtatatcctgcgcgatgtgagcaagaaagaaggcggagccatgtacgccgacgacacagcgggctgggataccagaattacgctggaggacctcaagaacgaagagatggttaccaatcacatggaaggggagcataagaaactggctgaggccatcttcaaacttacatatcaaaacaaagtggtccgggtgcagcgccccaccccgagaggaacagttatggatatcatttcccggcgcgaccagagaggcagcgggcaagtgggaacctacggcctgaatacgtttacaaacatggaagcccagctcatccggcagatggagggggaaggcgtcttcaagaatattcagcacctgaccgtgacagaggaggttgctgtgcataactggcttgcccgcgtcggaagagaacggctgtctcgcatggctatcagcggcgatgactgcgtggtcaaacctctcgatgacagattcgccaacgcgctgaccgccctgaatgatatggggaagattcggaaggacatccaacagtgggagccctccaaaggatggaacgattggacgcaggtccccttttgctctcaccatttccacgaactcatcatgaaggacggcagagttctggtggtcccttgtcgcaatcaggatgagcttattgggcgggctagaatcagccaaggagccggctggtccctgcgcgaaaccgcttgcctcgggaaatcttatgcccagatgtggagcctgatgtactttcaccggagagaccttcgcctggcggccaacgctatttgttccgccgtgccgtctcattgggtgcccacaagccggaccacatggtccatccacgctaagcatgagtggatgaccacagaggacatgctcaccgtttggaatagagtgtggattcgcgaaaacccttggatggaggataaaacgcccgtcgaaagctgggaggaaatcccttatctgggcaagcgggaggaccagtggtgcggatctctgattggcctcacatccagagccacctgggctaagaatatccaggccgcgatcaaccaagtgcgcagcctgattgggaatgaggaatacaccgattacatgccctctatgaaacggttcagacgggaggaagaggaagccggagttctttggtga

SEQ ID NO: 20106 - RNA, 9876 nt, synthetic construct
  misc_feature 1..9876: note = derived and/or modified CDS sequence (opt5) from DENV-2__EU482658__SS-prME
  source 1..9876: mol_type = other RNA
agcgccggaatgatcattatgctgatccccaccgtgatggctttccacctgaccacgagaaatggggagcctcatatgattgttggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgttacctgcgctatgtttacatgcaagaaaaacatggaaggcaagatcgtccagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttatcgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgaaagagatcgctgagacccagcacggaaccattgtcatccgggtgcagtatgaaggcgatgggagcccctgcaagatccccttcgagattatggacctcgagaagcggtacgttctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccacagagtgccccaataccaacagagcgtggaactctctcgaagtggaggattacgggtttggagtcttcacaaccaacatctggctgaaacttaaagaaaagcaggacgccttttgtgactccaagctgatgagcgctgccatcaaagataatcgcgctgtgcatgccgacatgggctattggattgagtctgcgctcaacgatacatggaagatcgagaaagcctccttcattgaagttaagaattgccactggcctaaaagccataccctgtggtctaacggcgtgctggagagcgaaatgatcattcccaagaaccttgctgggccggtctcccaacacaattaccggcctggataccacacgcagatcgccggcccctggcatctcgggaagctggagatggacttcgatttttgtgacggaacaaccgtgattgtgaccgaagattgcggcaacagagggcccagcctgcgcacaaccacggcttctggaaaactcatcacagagtggtgctgtcggtcctgcaccctgcctccgcttagatatcggggcgaggacggctgttggtacgggatggaaatccgccccctgaaggagaaagaagagaatctcgtcaacagcctggttacagccggacacggccaggtggataatttctccctgggggtgcttggaatggccctctttctggaagagatgctgagaacccgggtcggcacaaagcatgctattctcctggtgaccgtttctttcgtgacgcttatcaccgggaacatgagctttaaagacctgggaagagtcgtggttatggtgggcgcgacaatggccgatgacattggcatgggggtcacctatctcgctctgctggccgccttcaaggtgcgccctacatttgctgccggacttctgctccggaagctgacctccaaagagctcatgatgacgacaatcggcattgttctgctttctcaaagcaccatccccgaaacagtgctggagctcaccgatgcgctggctctggggatgatggtccttaagatcgtgagaaatatggaaaaataccagctggccgtgaccattatggccatcctctgcgtccctaacgctgttattctgcagaatgcctggaaggtgtcctgtacaatcctcgcggtggtctctgtgagccccctgcttctgacgtccagccagcagaagaccgactggattcctctcgctctgacaatcaagggactgaaccccaccgccatcttccttacaaccctgtctcgcacgaataaaaagagatcctggccgctcaacgaggccattatggctgttggcatggtgagcatcctggcctcttccctcctgaagaatgacattcctatgacagggccccttgtcgctggaggcctgctgaccgtgtgctatgttctcaccggccggagcgccgatctggaacttgagcgcgcgacagacgtgaaatgggaggatcaggccgaaatctctgggtccagccctattctgtccatcaccattagcgaggacggatctatgagcatcaagaacgaagaggaggaacagacactcacgatcctgattagaaccggcctcctggtcatctccgggctttttcccatttctatcccgattacagctgccgcttggtacctgtgggaggtgaaaaagcagcgggccggagtcctgtgggatgtgccttctccccctcccatgggcaaagccgaactcgaggacggggcttatcgcatcaagcaaaagggaatcctgggctactcccagattggcgcgggggtttacaaagaaggaaccttccacacaatgtggcatgtgaccagaggcgccgtccttatgcacaaggggaaacggatcgagccctcctgggctgatgtgaagaaagacctgattagctatggaggcgggtggaagctcgagggagaatggaaggagggcgaagaggttcaggtgctggccctcgaacctggcaaaaatccgcgcgccgtccagacgaagcccgggctgtttaaaaccaacacaggaaccatcggcgctgtgtcccttgatttctctcctgggacaagcggatcccccattatcgacaagaaaggcaaggtggttgggctgtacggaaacggcgtcgtgaccagaagcggcgcctatgtgtctgcgatcgctcaaacagagaagtccattgaggataatcctgaaatcgaggacgatatttttcggaaacgcagactgacgatcatggacctccaccccggggccggaaagaccaaacggtacctgcctgccattgtcagagaagctatcaagcgcggccttcggacactgattctcgccccgaccagagtggttgcggctgagatggaagaggccctgcgcgggctccccatccggtatcagacccctgccatcagagctgagcatacaggacgcgaaattgtggacctgatgtgtcacgccacgttcaccatgcggcttctgagccccgtcagagtgcctaactacaatctgatcattatggatgaggctcatttcacagaccccgcctctatcgcggcccgcggctatatttccacccgggttgaaatgggggaggctgccggcatctttatgacagctaccccgcctggaagcagagatcccttcccccagtccaacgcccctatcattgacgaggaacgggagatccccgaacgctcttggaatagcggccacgagtgggtgacggattttaaagggaagacagtctggttcgtgccttccattaaggccggaaacgacatcgctgcgtgcctccgcaaaaatggcaagaaagttattcaactgagccggaagacctttgattctgaatacgtgaaaacccgcacaaacgactgggatttcgtcgtgaccacagacatctccgagatgggggccaattttaaggctgagagagtgatcgatccgcggagatgtatgaaacccgtcattcttaccgacggagaggaacgcgttatcctggccggccctatgcccgtgacgcatagctctgccgctcagcggagagggcgcattggccggaaccctaagaatgaaaacgaccagtacatctatatgggagagcccctcgaaaatgatgaggactgcgcccactggaaggaggcgaaaatgctgctggataacattaatacaccggaaggcatcattcctagcatgttcgagcccgaaagagagaaggtggacgctatcgatggggaataccgcctccggggagaggccagaaaaacctttgtcgaccttatgcgcagaggcgatctgcctgtgtggctggcctataaggttgctgccgaggggatcaactacgcggaccggcgctggtgtttcgatggaattaaaaacaatcagatcctcgaagagaacgtggaagtcgagatttggacaaaggagggcgaaagaaagaaactgaagccccggtggcttgacgcccgcatctattccgatcctctggctctcaaagagtttaaggagttcgccgctgggagaaaatctctgaccctgaatctcattacggagatgggccggcttcccaccttcatgacacaaaagaccagagacgccctggataacctggctgtgctccacacagccgaagcgggaggccgcgcctacaatcatgctctgagcgagcttccggagaccctggaaacactcctgctgctcacccttctggccacggttacagggggaatctttctgttcctcatgtccggccgggggatcggaaagatgaccctgggcatgtgctgcattatcaccgcttctattcttctgtggtatgcccagatccagcctcactggattgccgctagcatcatcctcgagtttttcctgattgtgctgctcatccccgaacccgagaaacagagaacacctcaagacaaccagcttacctacgtcgtgattgcgatcctgacagtcgtggccgctacgatggccaatgaaatgggctttctggagaagaccaaaaaggacctcgggctgggatccattgccacacagcagccggagagcaacatccttgatattgacctgcgccccgcttctgcctggaccctctacgcggttgccacaaccttcgtgacgcctatgctgcggcattccatcgaaaatagctccgtgaacgtctctctgaccgctatcgccaatcaagctacagttctcatgggccttgggaaaggatggcccctgagcaagatggatattggcgtgcctctgctcgccatcgggtgttattcccaggtgaaccccattaccctgacagcggcccttctgctcctggtcgctcactacgccatcattggacctggcctgcaggctaaggccaccagagaggctcagaaacgggccgcggccggcatcatgaagaatccgacggtggacgggatcacagttattgatctcgaccccatcccttatgatcccaaatttgaaaagcaacttggacaggtgatgctgctgattctctgcgtcacccaggtgctgatgatgcgcacaacctgggctctttgtgaggccctgaccctcgctacaggccctatctctacgctgtgggaagggaaccccggaagattctggaataccacaattgccgtcagcatggccaacatctttcggggctcctacctggcgggggctggactccttttcagcatcatgaaaaataccacaaacacccgcagaggcacgggcaacattggggagacactgggagagaagtggaaatctcggctgaatgccctcggcaagtccgaatttcaaatctataagaaaagcgggattcaggaggtggaccgcaccctggctaaggaaggaatcaaaagaggcgagaccgatcaccatgccgtttctcgggggtccgccaaacttcgctggttcgtggagagaaacatggtcacaccggaaggaaaagtggttgacctgggctgcggcagagggggatggagctactattgtggcgggctcaagaatgtgcgggaggtcaagggactgaccaaaggcgggcctggacacgaagaacccattcccatgtctacatacggctggaacctggtgcgcctccagagcggcgtggatgtctttttcatccctcccgaaaagtgcgacacgcttctgtgtgatatcggggagtcctctcctaatccgaccgtcgaggctggacggacactgagagtgctcaacctggtggaaaattggcttaacaataacacccagttctgcattaaagtcctgaatccctacatgcctagcgttatcgagaagatggaagccctccaacgcaaatatggcggggcgctggtgcggaaccccctgtccagaaatagcacacatgagatgtactgggtgtccaacgcctctggaaatattgtcagctccgtgaacatgatctctcgcatgctcattaaccggtttaccatgagacacaagaaggctacgtatgaacctgacgttgaccttggcagcgggacccgcaatatcggaattgagtccgagatccccaacctggatatcattggcaaacggatcgaaaagattaaacaggagcatgaaacatcttggcactacgaccaggatcacccgtataagacctgggcctaccatggcagctatgagacaaaacagaccgggtccgctagctctatggtgaatggagtcgtgagactgctcacaaagccttgggacgttctgcccaccgtgacgcaaatggccatgacagataccacccctttcggccagcagcgcgtctttaaggaaaaagtggacacacggacgcaggagcccaaggaggggaccaagaaacttatgaaaatcacagcggaatggctgtggaaagagctcggcaagaagaagacccctagaatgtgtacacgcgaagagttcaccagaaaagtgcggtccaacgccgctctgggcgccatttttacagatgagaataagtggaaaagcgctcgcgaagccgtcgaggactctagattctgggaactggttgataaggagcggaacctccacctggaagggaaatgcgagacctgtgtgtacaatatgatgggaaagagagagaagaaacttggcgaatttggcaaggctaaagggtcccgggccatctggtacatgtggctgggagcgcgcttcctcgagtttgaagccctgggcttccttaacgaggaccattggtttagcagagaaaattctctgtccggggtggagggagagggcctccacaagctggggtatatcctgcgggatgtcagcaaaaaggaaggcggagctatgtacgccgacgacacggctggctgggatacccgcattacactcgaggacctgaagaacgaagagatggtgaccaatcacatggaaggggagcataagaaacttgccgaggccatcttcaaactgacatatcaaaacaaagttgtgagagtccagcggcccaccccgcgcggaacggtgatggatattatctccagacgggaccagcgcggcagcgggcaagttggaacatacggcctcaatacctttacaaacatggaagcgcagctgattagacagatggagggggaaggcgtgttcaaaaatatccagcaccttaccgtcacggaggaggtggctgttcaaaactggctggcccgggtgggacgcgaaagactctctcggatggccatcagcggcgatgactgcgtcgtgaagcctctggatgaccgcttcgctaacgccctgaccgctctcaatgatatggggaagattagaaaagacatccagcagtgggagccctccaagggatggaacgattggacacaggtccccttttgctctcatcacttccatgaactgattatgaaagacggccgggtgcttgttgtgccttgtagaaatcaagatgagctgatcgggcgcgcccggattagccagggagcgggctggtccctcagagaaaccgcctgcctggggaagtcttatgctcagatgtggagccttatgtactttcaccgccgggacctgagactcgccgctaacgccatctgttccgcggtcccgtctcactgggtgcccacaagccgcaccacatggtccattcatgccaaacacgagtggatgaccacggaggacatgctgacagtgtggaatcgggtttggatcagagataacccttggatggaagacaagacccccgtggagagctgggaagagatcccttatctgggcaagcgcgaagatcagtggtgcggatctctcattggcctgacctcccgggctacatgggccaaaaatatccaagctgccattaaccaggtcagaagccttatcgggaatgaggagtacaccgactacatgccctctatgaagcgcttccggagagaagaggaagaggctggagtgctgtggtga

SEQ ID NO: 20107 - RNA, 9876 nt, synthetic construct
  misc_feature 1..9876: note = derived and/or modified CDS sequence (opt5) from DENV-2__EU482659__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccacagagtgccccaataccaacagagcgtggaactctctcgaagtcgaggattacgggtttggagtgttcacaaccaacatttggctgaaacttaaagaaaagcaggacgccttttgtgactccaagctgatgagcgctgccatcaaagataatcgcgctgttcatgccgacatgggctattggatcgagtctgcgctcaacgatacatggaagattgagaaagcctccttcatcgaagtgaagaattgccactggcctaaaagccataccctgtggtctaacggcgtcctggagagcgaaatgattatccccaagaaccttgctgggccggtgtcccaacacaattaccggcctggataccacacgcagattgccggcccctggcatctcgggaagctggagatggacttcgatttttgtgacggaacaaccgtgatcgtcaccgaagattgcggcaacagagggcccagcctgcgcacaaccacggcttctggaaaactcattacagagtggtgctgtcggtcctgcaccctgcctccgcttagatatcggggcgaggacggctgttggtacgggatggaaatccgccccctgaaggagaaagaagagaatctcgttaacagcctggtgacagccggacacggccaggtggataatttctccctgggggtccttggaatggccctctttctggaagagatgctgagaacccgggtgggcacaaagcatgctatcctcctggttgcggtgtctttcgtcacccttattacggggaacatgagctttaaagacctgggaagagtggttgtgatggtcggcgccaccatggctgatgacatcggcatgggggtgacatatctcgccctgctggccgctttcaaggttcgccctacctttgccgcgggacttctgctccggaagctgacatccaaagagctcatgatgaccacgattggcatcgtgctgctttctcaaagcacaattcccgaaaccgtcctggagctcacagatgctctggccctggggatgatggtgcttaagatcgtgagaaatatggaaaaataccagctggccgtcaccatcatggctattctctgcgttcctaacgccgtgatcctgcagaatgcgtggaaggtgtcctgtaccattctcgctgtcgtgtctgttagccccctgcttctgacatccagccagcagaagacggactggatccctctcgccctgaccattaagggactgaaccccacagccatcttccttaccacactgtctcgcaccaataaaaagagatcctggccgctcaacgaggctatcatggccgtgggcatggtcagcattctggcttcttccctcctgaagaatgacatccctatgacggggccccttgtggccggaggcctgctgacagtttgctatgtgctcaccggccggagcgcggatctggaacttgagcgcgccaccgacgtcaaatgggaggatcaggctgaaatttctgggtccagccctatcctgtccattacaatcagcgaggacggatctatgagcattaagaacgaagaggaggaacagaccctcacaatcctgatcagaacgggcctcctggtgatttccgggctttttcccatctctattccgatcaccgccgctgcctggtacctgtgggaggtcaaaaagcagcgggccggagtgctgtgggatgttccttctccccctcccatgggcaaagctgaactcgaggacggggcgtatcgcattaagcaaaagggaatcctgggctactcccagatcggcgccggggtgtacaaagaaggaacattccacaccatgtggcatgtcacaagaggcgctgtgcttatgcacaaggggaaacggattgagccctcctgggccgatgttaagaaagacctgatcagctatggaggcgggtggaagctcgagggagaatggaaggagggcgaagaggtgcaggtcctggccctcgaacctggcaaaaatccgcgcgctgtgcagaccaagcccgggctgtttaaaacgaacaccggaacaattggcgccgtgtcccttgatttctctcctgggaccagcggatcccccatcattgacaagaaaggcaaggttgtcgggctgtacggaaacggcgtggtgacaagaagcggcgcgtatgtctctgctatcgcccaaaccgagaagtccatcgaggataatcctgaaattgaggacgatatctttcggaaacgcagactgacaattatggacctccaccccggggccggaaagacgaaacggtacctgcctgctatcgtgagagaagccattaagcgcggccttcggaccctgatcctcgcgccgacaagagttgtggctgccgagatggaagaggccctgcgcgggctccccattcggtatcagacccctgctatcagagccgagcataccggacgcgaaatcgtcgacctgatgtgtcacgctacattcacgatgcggcttctgagccccgtgagagttcctaactacaatctgattatcatggatgaggcccatttcaccgaccccgcgtctattgccgctcgcggctatatctccacacgggtggaaatgggggaggccgctggcatttttatgaccgccacaccgcctggaagcagagatcccttcccccagtccaacgcccctatcatcgacgaggaacgggagattcccgaacgctcttggaataccggccacgagtgggtcacggattttaaagggaagacagtgtggttcgttcctagcatcaaggctggaaacgacattgcggcctgcctccgcaaaaatggcaagaaagtgatccaactgtcccggaagacctttgatagcgaatacgtcaaaacccgcacaaacgactgggatttcgtggtgaccacagacatttctgagatgggggctaattttaaggccgagagagtcatcgatccgcggagatgtatgaaacccgttatccttaccgacggagaggaacgcgtgattctggccggccctatgcccgtgacgcattccagcgctgcccagcggagagggcgcatcggccggaaccctaagaatgaaaacgaccagtacatttatatgggagagcccctcgaaaatgatgaggactgcgcgcactggaaggaggctaaaatgctgctggataacatcaatacaccggaaggcattatcccttctatgttcgagcccgaaagagagaaggtcgacgccattgatggggaataccgcctccggggagaggccagaaaaacctttgtggaccttatgcgcagaggcgatctgcctgtttggctggcttataaggtggccgcggaggggatcaactacgccgaccggcgctggtgtttcgatggaatcaaaaacaatcagattctcgaagagaacgtcgaagtggagatctggacaaaggagggcgaaagaaagaaactgaagccccggtggcttgacgctcgcatttatagcgatcctctggccctcaaagagtttaaggagttcgctgccgggagaaaatccctgaccctgaatctcatcacggagatgggccggcttcccaccttcatgacacaaaagaccagagacgctctggataacctggccgttctccacacagcggaagccggaggccgcgcttacaatcatgccctgtctgagcttccggagaccctggaaacactcctgctgctcacccttctggctacggtgacagggggaatttttctgttcctcatgagcggccgggggatcggaaagatgaccctgggcatgtgctgcatcattaccgcctccatccttctgtggtatgcccagattcagcctcactggatcgctgcgtctattatcctcgagtttttcctgatcgtcctgctcattcccgaacccgagaaacagagaacacctcaagacaaccagcttacctacgtggtcatcgccattctgacagtggttgctgccacgatggccaatgaaatgggctttctggagaagaccaaaaaggacctcgggctgggaagcatcgctacacagcagccggagtccaacattcttgatatcgacctgcgccccgccagcgcgtggaccctctacgccgtggctacaaccttcgtgacgcctatgctgcggcattctattgaaaattccagcgtcaacgtttccctgaccgccatcgctaatcaagccacagtgctcatgggccttgggaaaggatggcccctgtctaagatggatatcggcgtgcctctgctcgcgattgggtgttatagccaggtcaaccccatcaccctgacagccgcccttctgctcctggtggcccactacgctattatcggacctggcctgcaggccaaggctaccagagaggcccagaaacgggcggccgctggcattatgaagaatccgacggttgacgggatcacagtgatcgatctcgaccccattccttatgatcccaaatttgaaaagcaacttggacaggtcatgctgctgatcctctgcgtgacccaggtcctgatgatgcgcacaacctgggccctttgtgaggctctgaccctcgccacaggccctatttccacgctgtgggaagggaaccccggaagattctggaataccacaatcgccgtgtctatggcgaacatttttcggggcagctacctggctggggccggactccttttctccatcatgaaaaataccacaaacacccgcagaggcacgggcaacatcggggagacactgggagagaagtggaaaagccggctgaatgctctcggcaagtctgaatttcaaatttataagaaatccgggatccaggaggttgaccgcaccctggccaaggaaggaattaaaagaggcgagaccgatcaccatgccgtgagccgggggtctgctaaacttcgctggttcgtcgagagaaacatggtgacaccggaaggaaaagttgtggacctgggctgcggcagagggggatggtcctactattgtggcgggctcaagaatgtccgggaggtgaagggactgaccaaaggcgggcctggacacgaagaacccatccccatgagcacatacggctggaacctggtgcgcctccagtctggcgttgatgtctttttcattcctcccgaaaagtgcgacacgcttctgtgtgatatcggggagagctcccctaatccgaccgtggaggccggacggacactgagagtgctcaacctggtcgaaaattggcttaacaataacacccagttctgcatcaaagttctgaatccctacatgccttctgtgattgagaagatggaagcgctccaacgcaaacatggcggggccctggtgcggaaccccctgagcagaaattccacacacgagatgtattgggtcagcaacgcttccggaaatatcgtgtctagcgttaacatgatttcccgcatgctcatcaaccggtttaccatgagacataagaaggccacgtacgaacctgacgtggaccttggctctgggacccgcaatattggaatcgagagcgagattcccaacctggatatcatcggcaaacggattgaaaagatcaaacaggagcacgaaacatcctggcactatgaccaggatcatccgtacaagacctgggcttatcacggctcttacgagacaaaacagaccgggagcgcctccagcatggtcaatggagtggttagactgctcacaaagccttgggacgtgctgcccaccgtcacgcaaatggcgatgacagataccacccctttcggccagcagcgcgtgtttaaggaaaaagtggacacacggacgcaggagcccaaggaggggaccaagaaacttatgaaaattacagccgaatggctgtggaaagagctcggcaagaagaagacccctagaatgtgtacacgcgaagagttcaccagaaaagtccggtctaacgctgccctgggcgctatctttacagatgagaataagtggaaatccgcccgcgaagctgttgaggacagcagattctgggaactggtggataaggagcggaacctccatctggaagggaaatgcgagacctgtgtgtataatatgatgggaaagagagagaagaaacttggcgaatttggcaaggccaaagggtctcgggcgatttggtacatgtggctgggagcccgcttcctcgagtttgaagctctgggcttccttaacgaggaccactggttttccagagaaaatagcctgtctggggtcgagggagagggcctccacaagctggggtacatcctgcgggatgtgtccaaaaaggaaggcggagccatgtatgctgacgacacggccggctgggatacccgcatcacactcgaggacctgaagaacgaagagatggttaccaatcatatggaaggggagcacaagaaacttgccgaggcgattttcaaactgacataccaaaacaaagtggtcagagtgcagcggcccaccccgcgcggaacggttatggatatcattagcagacgggaccagcgcggctccgggcaagtgggaacatatggcctcaatacctttacaaacatggaagctcagctgatcagacagatggagggggaaggcgtcttcaaaaatattcagcatcttaccgtgacggaggaggttgccgtgcaaaactggctggcccgggtcggacgcgaaagactcagccggatggctatctctggcgatgactgcgtggtcaagcctctggatgaccgcttcgccaacgctctgaccgccctcaatgatatggggaagatcagaaaagacattcagcagtgggagcccagcaagggatggaacgattggacacaggtgcccttttgctcccaccatttccacgaactgatcatgaaagacggccgggttcttgtggtcccttgtagaaatcaagatgagctgattgggcgcgcgcggatctctcagggagccggctggagcctcagagaaaccgcttgcctggggaagtcctacgcccagatgtggtctcttatgtattttcaccgccgggacctgagactcgctgccaacgcgatttgtagcgccgtgccgtcccattgggtgcccacatctcgcaccacatggagcatccacgctaaacatgagtggatgaccacggaggacatgctgacagtttggaatcgggtgtggattagagaaaacccttggatggaggataagacccccgtcgaatcctgggaggaaatcccttacctgggcaagcgcgaggaccagtggtgcggaagcctcatcggcctgacctctcgggccacatgggctaaaaatattcaagccgctatcaaccaggtgagatcccttattggggatgaggaatataccgactacatgcccagcatgaagcgcttccggagagaggaagaggaagccggagttctgtggtga

SEQ ID NO: 20108 - RNA, 9876 nt, synthetic construct
  misc_feature 1..9876: note = derived and/or modified CDS sequence (opt5) from DENV-2__EU482661__SS-prME
  source 1..9876: mol_type = other RNA
agcgccggcatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgagggggacatctttcggaaacgcagactgaccattatggatctccaccccggagctggcaagacaaaacggtacctgcctgccatcgtgagagaagcgattaagcgcgggcttcggacgctgatcctcgctccgaccagagttgtggccgccgagatggaagaggctctgcgcggactccccattcggtatcagacccctgccatcagagctgagcataccggccgcgaaatcgtcgacctgatgtgtcacgccaccttcacaatgcggcttctgagccccgtgagagttcctaactacaatctgattatcatggacgaggcgcatttcacggatcccgcctctattgctgcccgcgggtatatctccacccgggtggaaatgggcgaggctgccggaatttttatgacagccaccccgcctggcagcagagaccccttcccccagtccaacgctcctatcatcgatgaggaacgggagattcccgaacgctcttggaatagcgggcacgagtgggtcacagactttaaaggaaagaccgtgtggttcgttccttccatcaaggcgggcaacgatattgccgcttgcctccgcaaaaatgggaagaaagtgatccaactgagccggaagacgtttgactctgaatacgtcaaaacacgcaccaacgattgggacttcgtggtgaccacagatatttccgagatgggagccaattttaaggccgagagagtcatcgacccgcggagatgtatgaaacccgttatccttaccgatggcgaggaacgcgtgattctggctgggcctatgcccgtgacacatagctctgccgcgcagcggagaggccgcatcggacggaaccctaagaatgaaaacgaccagtacatttatatgggcgagcccctcgaaaatgacgaggattgcgctcactggaaggaggccaaaatgctgctggacaacatcaataccccggaagggattatccctagcatgttcgagcccgaaagagagaaggtcgatgccattgacggagaataccgcctccggggcgaggctagaaaaacgtttgtggatcttatgcgcagaggggacctgcctgtttggctggcctataaggtggcggccgagggaatcaactacgctgatcggcgctggtgtttcgacggcatcaaaaacaatcagattctcgaagagaacgtcgaagtggagatctggacaaaggagggggaaagaaagaaactgaagccccggtggcttgatgcccgcatttattccgaccctctggctctcaaagagtttaaggagttcgccgctggcagaaaatctctgaccctgaatctcatcacagagatgggacggcttcccaccttcatgacgcaaaagaccagagatgccctggacaacctggcggttctccacacagccgaagctggcgggcgcgcctacaatcatgctctgagcgagcttccggagaccctggaaacactcctgctgctcacccttctggccacagtgaccggaggcatttttctgttcctcatgtccgggcggggaatcggcaagatgacgctgggcatgtgctgcatcattacagcctctatccttctgtggtatgctcagattcagcctcactggatcgcggccagcattatcctcgagtttttcctgatcgtcctgctcattcccgaacccgagaaacagagaacccctcaagataaccagcttacctacgtggtcatcgctattctgacagtggttgccgccaccatggctaatgaaatggggtttctggagaagaccaagaaggacctcggactgggctccatcgccacgcagcagccggagagcaacattcttgacatcgatctgcgccccgcgtctgcctggaccctctacgctgtggccacaaccttcgtgacacctatgctgcggcattccattgaaaatagctccgtcaacgtttctctgaccgctatcgccaatcaagcgacggtgctcatggggcttggaaaaggctggcccctgagcaagatggacatcggggtgcctctgctcgccattggatgttattcccaggtcaaccccatcaccctgacagctgcccttctgctcctggtggctcactacgccattatcggccctggcctgcaggctaaggccaccagagaggcgcagaaacgggccgctgccgggattatgaagaatccgacagttgatggaatcaccgtgatcgacctcgatcccattccttatgaccccaaatttgaaaagcaacttggccaggtcatgctgctgatcctctgcgtgacgcaggtcctgatgatgcgcacaacctgggctctttgtgaggccctgacactcgccaccgggcctatttctaccctgtgggaaggaaaccccggcagattctggaatacaacgatcgcggtgagcatggctaacatttttcgggggtcctacctggccggagctggcctccttttcagcatcatgaaaaataccacaaacacccgcagaggcacagggaacatcggagagaccctgggcgagaagtggaaatctcggctgaatgccctcgggaagtccgaatttcaaatttataagaaaagcggaatccaggaggttgatcgcacgctggccaaggaaggcattaaaagaggggagacagaccaccatgctgtgtctcggggatccgccaaacttcgctggttcgtcgagagaaacatggtgaccccggaaggcaaagttgtggatctgggctgcgggcggggaggctggagctactattgtgggggactcaagaatgtcagagaggtgaagggcctgaccaaagggggacctggccacgaagaacccatccccatgtctacatacggctggaacctggtgcgcctccagagcggggttgacgtctttttcattcctcccgaaaagtgcgatacccttctgtgtgacatcggagagtcctctcctaatccgacagtggaggcgggccggacgctgagagtgctcaacctggtcgaaaattggcttaacaataacacccagttctgcatcaaagttctgaatccctacatgcctagcgtgattgagaagatggaagccctccaacgcaaatatgggggagctctggtgcggaaccccctgtccagaaatagcacacatgagatgtactgggtctccaacgcctctggcaatatcgtgagctccgttaacatgatttctcgcatgctcatcaaccggtttaccatgagacacaagaaggctacatatgaacctgatgtggaccttgggagcggaacccgcaatattggcatcgagtccgagattcccaacctggacatcatcggcaaacggattgaaaagatcaaacaggagcatgaaacgtcttggcactacgatcaggaccacccgtataagacctgggcctaccatgggagctatgagacaaaacagaccggatccgcgagctctatggtcaatggcgtggttagactgctcacaaagccttgggatgtgctgcccaccgtcacacaaatggccatgaccgacacgacacctttcgggcagcagcgcgtgtttaaggaaaaagtggatacccggacccaggagcccaaggagggaaccaagaaacttatgaaaattacggctgaatggctgtggaaggagctcggcaaaaagaagacccctagaatgtgtacacgcgaagagttcaccagaaaagtccggtccaacgccgctctgggggccatctttacagacgagaataagtggaaaagcgctcgcgaagccgttgaggattctagattctgggaactggtggacaaggagcggaacctccacctggaaggaaaatgcgagacctgtgtgtacaatatgatgggcaagagagagaagaaacttggcgaatttgggaaggcgaaaggatcccgggccatttggtacatgtggctgggcgctcgcttcctcgagtttgaagccctggggttccttaacgaggatcattggtttagcagagaaaattctctgtccggagtcgagggcgaggggctccacaagctgggctatatcctgcgggacgtgagcaaaaaggaaggaggcgctatgtacgccgatgacacagccgggtgggacacccgcatcacgctcgaggatctgaagaacgaagagatggttaccaatcacatggaaggagagcataagaaacttgcggaggctattttcaaactgacatatcaaaacaaagtggtcagagtgcagcggcccaccccgcgcggcacagttatggacatcatttccagacgggatcagcgcgggagcggacaagtgggcacctacgggctcaatacgtttacaaacatggaagcccagctgatcagacagatggagggcgaaggagtcttcaaaaatattcagcaccttaccgtgacagaggaggttgccgtgcaaaactggctggctcgggtcggccgcgaaagactctctcggatggccatcagcggggacgattgcgtggtcaagcctctggacgatcgcttcgctaacgccctgaccgcgctcaatgacatgggaaagatcagaaaagatattcagcagtgggagccctccaagggctggaacgactggacacaggtgcccttttgctctcatcacttccatgaactgatcatgaaagatgggcgggttcttgtggtcccttgtagaaatcaagacgagctgattggacgcgcccggatcagccagggcgctgggtggtccctcagagaaaccgcctgcctgggcaagtcttatgctcagatgtggagccttatgtactttcaccgccgggatctgagactcgccgcgaacgccatttgttccgctgtgccgtctcactgggtgcccacaagccgcaccacatggtccatccatgccaaacacgagtggatgaccacagaggacatgctgaccgtttggaatcgggtgtggattagagaaaacccttggatggaggacaagacgcccgtcgaaagctgggaggaaatcccttatctgggaaagcgcgaggatcagtggtgcggctctctcatcgggctgacatcccgggctacctgggccaaaaatattcaagctgccatcaaccaggtgagaagccttattggaaatgaggaatacaccgactacatgccctctatgaagcgcttccggagagaggaagaggaagcgggcgttctgtggtga

SEQ ID NO: 20109 - RNA, 9876 nt, synthetic construct
  misc_feature 1..9876: note = derived and/or modified CDS sequence (opt5) from DENV-2__EU482662__SS-prME
  source 1..9876: mol_type = other RNA
accgccggagtgatcattatgctgatccccacagctatggccttccacctcacgaccagaaatggggagcctcatatgattgtcggacggcaggaaaagggaaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagaaggccctgattttcatccttctgacggcggttgcccctagcatgaccatgagatgcattggcatctccaaccgggattttgtggaaggggtctctggaggcagctgggtggacatcgttctcgagcacgggtcctgtgtgacaaccatggctaagaataaacccacactggatttcgaacttattaagaccgaggccaaacagcctgctacgctgcgcaagtattgcatcgaagccaaactcacaaacaccaccacagagagcagatgtccgacccaaggagagccctctctgaatgaagaacaggacaagcggtttgtctgcaagcattccatggtggatcgcggctggggcaacgggtgtggactgttcggcaaagggggaattgtgacatgcgcgatgtttacgtgcaagaaaaatatggaaggcaagatcgtccagcctgagaacctcgaatacaccattgttatcacaccccacagcggggaggagcatgccgtgggaaatgacaccggcaaacacggcaaggaaatcaaaattacacctcagtcttccatcaccgaggctgaactgacggggtatggaaccgtgacaatggagtgtagccccagaaccggccttgatttcaacgaaatggtcctgctccaaatggaggacaaggcctggctggtgcaccggcagtggtttcttgatctgccgctcccttggctgcccggggctgacacacagggatctaattggattcagaaggagaccctggttacgttcaaaaaccctcatgccaagaaacaagacgtggtcgtgctcggctcccaggaaggggccatgcacacagctctgaccggcgcgacagagatccagatgagctccggaaatcttctgtttaccggccatctcaagtgccgcctgagaatggataaacttcaactgaaggggatgtcttacagcatgtgtaccggaaagttcaaaattgttaaggaaatcgccgagacacagcacggcacgatcgtgattcgggtccagtatgagggggacggatccccctgcaaaatccccttcgaaattatggatctcgagaagagacatgtgctgggccgcctgatcaccgtcaaccctattgtgacagaaaaagacagcccggttaacatcgaggctgaacccccttttggggattcttacattatcatcggcgtggagcccggacagctcaagctgaattggttcaagaaaggctccagcattgggcaaatgtttgagaccacaatgcggggagccaagagaatggccatccttggcgacaccgcttgggatttcgggtctctgggaggcgtctttacgagcattgggaaagccctccaccaggtgttcggcgcgatctacggagctgccttttccggcgtttcttggacaatgaagattctgatcggggccatcattacctggatcggaatgaacagccgctccaccagcctgtctgtgtcccttgtcctcgtgggcgtgattacactgtatctgggggctatggttcaggccgacagcggatgtgtcgtgtcttggaaaaataaggaactcaagtgcggctccgggatcttcattaccgataacgtgcacacatggacggagcagtacaaatttcaacctgaaagcccctccaagctggcttctgccatccagaaagcgcatgaggaaggcatctgtggcattcggagcgtcaccagacttgagaatctgatgtggaagcagatcacaccggagctcaaccacattctgtccgaaaatgaggtgaaactgaccatcatgacaggcgacattaaggggatcatgcaggccggaaaacgctctcttcggcctcaacccaccgaactcaagtatagctggaagacgtggggcaaagctaagatgctgtccaccgagagccataaccagacattcctgatcgatgggcctgaaaccgccgagtgccccaatacaaacagagcttggaactctctcgaggttgaagactacggatttggcgtgttcaccacaaacatttggctgaaacttcgcgagaagcaggacgtcttttgtgattccaaactgatgagcgccgcgatcaaggacaatcgggccgtgcacgctgatatgggctattggattgaatctgccctcaacgacacctggaagatggagaaggcttccttcatcgaggttaagagctgccactggcctaaatctcatacgctgtggagcaatggggtgctggaatccgagatgattatccccaagagcttcgccggaccggtctctcagcacaactacagacctggctattacacacaaaccgccgggccctggcatcttggaaaactcgaaatggattttgacttctgtgagggcaccacagtggttgtgaccgaagattgcgggaaccgcggaccctccctgcggacgacaaccgctagcggcaagctgattacagagtggtgctgtagatcctgcaccctccctccgctgcggtaccgcggcgaggacgggtgttggtatggaatggaaatcagaccccttaaggagaaagaagagaatctggtcaactctctcgtgacagcgggccacgggcagatcgataattttagcctgggagtgctgggcatggcccttttcctcgaagagatgctgcggaccagagtcgggacgaagcatgctattctgctcgttgccgtgtcctttatgaccctgatcacaggaaacatgtctttccgcgaccttggccgggtgatggtcatggtgggcgccaccatgacagatgacattgggatgggagttacctacctggctctcctggccgcgtttaaagtgagacctacgttcgctgccggcctgcttctgcgcaagctcacaagcaaagagctgatgatggccaccatcgggattgctctcctgtcccagtctacaatccccgaaaccatccttgagctgaccgatgccctcgcgctgggaatgatggtcctgaagattgtgagaaatatggaaaagtatcaacttgctgttacaatcatggccattagctgcgtgcctaacgccgtcatcctgcagaatgcttggaaagtgtcctgtacgattctcgccgctgttagcgtgtctcccctgctcctgacctccagccagcagaaggccgactggatccctcttgcgctgacaatcaaaggcctcaaccccaccgccatttttctgacaaccctgtctcggacgtccaagaaacgcagctggccgcttaatgaggctatcatggccgtcgggatggtgtctattctggcttccagcctcctgaagaacgacatccctatgacaggacccctcgtggccggcggcctgcttaccgtctgctacgttctgaccgggagatccgccgatctggaactcgagcgggctacagacgtgaaatgggaggatcaagcggaaattagcggatctagccctatcctgtccattaccatctctgaggacggcagcatgtccatcaagaatgaagaggaggaacagacacttacgattctgatccgcaccgggctcctggtgatttctggactcttccccgtcagcatcccgattacagccgctgcctggtatctgtgggaggtgaagaaacagagagccggcgttctttgggatgtgccttctccccctcccgtcgggaaggctgaactggaggacggagcctaccggatcaaacagaagggcatcctgggctatagccaaattggggcgggagtgtacaaagaaggcacctttcacacaatgtggcacgttacccgcggggctgtgctcatgcatagaggaaagcggatcgagcccagctgggccgatgtcaagaaagacctgatttcctacggcgggggatggaaacttgagggcgaatggaaagagggcgaagaggtgcaggtcctggccctcgaacctgggaagaacccgcgcgctgtgcagacgaaacccggactgttcaagaccaatacaggcaccatcggggccgttagcctcgatttttctcctggaacatccggcagccccattgtggacagaaaggggaaagtcgtgggactgtatggcaacggcgttgtgacccggtctggggcgtacgtctccgctatcgcccagacagaaaagagcatcgaggataatcctgaaattgaggacgatatcttccgcaagaagcgccttacgattatggacctgcaccccggagccggcaaaaccaagcggtatctgcctgctatcgtgagagaagccattaagcgcgggctccggacactgatccttgctccgaccagagtggttgccgcggagatggaagaggccctgcgcggactccccattcggtaccaaacccctgctatcagagccgagcatacaggccgcgaaatcgtcgacctgatgtgtcacgctacgttcaccatgcggctcctgtcccccgtgagagtgcctaactataaccttattatcatggatgaggcccattttacagaccccgcctctattgctgcgcgggggtacatcagcacccgcgtcgaaatgggcgaggccgctggaattttcatgacagccaccccgcctggctccagagatccctttccccagagcaatgcccctatcatcgacgaggaacgggagattcccgaacgctcttggaactccgggcacgagtgggtgacggatttcaaaggaaagacagtttggtttgtgcctagcatcaaagctggcaatgacattgccgcgtgcctgagaaagaacgggaaaaaggtcatccagctgtctcggaagaccttcgatagcgaatatgtgaaaaccagaacaaatgactgggattttgttgtgaccacagacatttccgagatgggagctaacttcaaggccgagcgcgtcatcgatccgcggagatgtatgaaacccgtgatcctcaccgacggcgaagagagagttattctggccgggcctatgcccgtgacgcactctagcgctgcccaacggagaggccgcatcggacggaatcctaagaacgaaaatgaccagtacatttacatgggcgagccccttgaaaacgatgaggactgcgcgcattggaaagaggccaagatgctgctcgataatatcaacacaccggaagggattatcccttccatgtttgagcccgaaagagagaaagtcgacgctattgatggagaatatcgcctgagaggcgaggcccggaagaccttcgtggacctgatgcgcagaggggatctccctgtgtggcttgcttaccgggtcgccgctgagggaatcaattatgccgaccgcagatggtgttttgatggcgttaagaacaatcagatcctggaagagaacgtggaagtggagatttggacaaaagagggggaacggaagaaactgaagcccagatggctcgacgcgcgcatctactctgatcctctggcccttaaagagttcaaggagttcgctgccggccggaagtccctgaccctcaacctgattacggagatgggaagactgcccacctttatgacacagaaagctcgcgacgccctcgataatcttgccgtcctgcacaccgctgaagcgggcgggcgggcctataaccatgctctgtccgagctcccggagacactggaaacccttctgctcctgacactgctcgccaccgtgacgggaggcatcttcctttttctgatgagcgggaagggagttggcaaaatgacactgggcatgtgctgcattatcaccgcctctatcctcctgtggtacgctcaaattcagcctcactggatcgccgcgtccattatccttgagttctttctgattgtgctcctgatccccgaacccgagaagcagagaacccctcaggacaatcaactgacatatgtcgtgatcgccattctcaccgttgtggctgccacaatggctaacgaaatggggttccttgagaaaacgaagaaggacctgggactgggcagcatcgccacccaggagccggaatccaatattctcgatatcgacctgcggcccgcgtctgcctggacactttacgctgtcgccaccacatttgtgacccctatgctgcgccacagcattgagaactcctctgtcaatgtgagcctcacggctatcgccaaccaggctaccgttctgatggggctgggaaaaggctggcccctctccaagatggatattggggtgcctcttctggccatcggatgttacagccaggtgaatcccatcacactgaccgcggccctcctgcttctgattgctcattatgccatcattggccctggcctccaagctaaagccacaagagaagcccagaagcgggcggctgccgggatcatgaaaaacccgaccgtcgacggaattacggttatcgatctggaccccatcccttacgatcccaagttcgagaagcagctgggccaggtgatgctccttattctgtgcgtgacacaagtcctgatgatgcgcaccacatgggctctctgtgaagccctgacccttgccaccgggcctatctctacactgtgggagggaaatcccggcagattttggaacacgaccattgctgtgtccatggccaatatcttccgggggagctatctcgcgggagccggcctgctgttttctattatgaaaaacacaaccaatacacgcagaggcaccgggaacatcggagagacgctcggcgaaaagtggaaatcccggcttaatgctctgggaaagagcgagttccagatctacaaaaagtctggcattcaggaagttgaccgcacactggccaaagagggcatcaagagaggggagaccgatcaccatgctgtgagccggggatccgccaagctcagatggtttgtcgaacgcaacatggtgaccccggagggcaaagtcgtggacctgggctgcgggcggggaggctggtcttattactgtgggggacttaagaacgttagagaagtgaaaggcctgacaaaaggcgggcctgggcacgaggaacccattcccatgagcacctatggctggaatctcgtccgcctgcaatccggggtggatgttttcttcacacctcccgagaaatgcgacacgctgctctgtgatatcggagagagctcccctaacccgaccattgaagcgggccggacacttagagtgctgtctctggtcgagaattggctcaacaatgacacccagttttgcatcaaggtgctgaacccctacatgcctagcgtgatcgaaaagatggagacacttcagcgcaaatacgggggagccctggttcggaatcccctctccagaaactctacccatgaaatgtattgggtcagcaatgctacgggcaacattgtgtcctctgtgaatatgatcagccgcatgctgattaaccggttcaccatgaagcacaaaaaggccacatacgagcctgacgtcgatctggggtccggaaccagaaatatcggcattgagagcgaaatccccaacctcgacattatcggcaaacgcatcgagaagattaagcaggaacacgagacatcttggcattatgatcaagaccacccgtacaaaacctgggcttatcatgggtcctacgaaacaaagcagaccggaagcgcctcttccatggttaatggcgtggtgcggcttctgacgaaaccttgggatgtcgtgcccatggttacacagatggctatgaccgacaccacaccttttgggcagcaaagagtgttcaaggagaaagtcgatacgcgcacccaggagcccaaggaaggaacaaagaaactgatgaagatcaccgccgagtggctctggaaagaactgggcaagaaaaagacacctagaatgtgtacccgggaggagtttacacgcaaagtgagaagcaacgcggcccttggggctattttcaccgacgaaaacaagtggaagtctgcccgggaggctgttgaagattccagattttgggagctggtggacaaagaacggaatctccacctggagggaaagtgcgagacgtgtgtctataacatgatgggcaaacgcgaaaagaaactgggcgagttcgggaaggccaagggaagcagagccatctggtacatgtggctcggcgcgcggtttctggagttcgaggctcttgggtttctgaatgaagatcactggttctcccgcgagaacagcctctctggagtggagggcgaagggctgcataaacttggctacattctgagagacgtgagcaagaaagagggaggcgccatgtatgccgacgataccgctgggtgggacacacggatcaccctcgaagatctgaagaatgaggaaatggtcacaaaccacatggagggagagcataaacgcctggccgaagctatctttaagctcacctaccagaataaggttgtgagagtgcagcggcccacgccgcgcggcacagtcatggacattatctccagacgggatcaacgcgggtctggacaggtgggcacctatgggctgaacacattcaccaatatggaggcccagcttattagacaaatggaaggcgagggaatcttcaaaagcattcagcacctgacggttaccgaggaaatcgcggtgcagaactggctcgcccgggtcggccgcgagagactgtcccggatggctatctctggggacgattgcgtggttaagcctcttgacgatagatttgccagcgctctgacagccctcaatgacatgggaaaagtgcgcaaggatattcagcaatgggaaccctccaaaggctggaacgactggacccaggtccccttctgctctcatcactttcacgagctgatcatgaaggatgggcgggtgctggttgtgccttgtagaaatcaggacgaactcattggacgcgcgcggatcagccagggcgccgggtggtccctgaaggagacagcttgccttggcaaaagctacgcccaaatgtggtctctgatgtatttccatagacgcgacctccggctggctgccaacgctatttgttccgccgtcccgagccactgggtgcccacctctagaacaacctggtccatccatgcgaagcacgagtggatgacgacagaagatatgcttaccgtctggaatcgcgtgtggattcaggagaacccttggatggaagacaaaacccccgttgagagctgggaagaggtgccttacctgggaaagcgggaggatcagtggtgcggctccctcatcgggctgacatctagagccacctgggctaaaaacatccagacagccattaatcaagtccgcagcctgatcggaaacgaagagtatacggactacatgccctccatgaagcggtttagacgggaagaggaagaggccggcgtgctctggtga

SEQ ID NO: 20110 - RNA, 9876 nt, synthetic construct
  misc_feature 1..9876: note = derived and/or modified CDS sequence (opt5) from DENV-2__EU482663__SS-prME
  source 1..9876: mol_type = other RNA
agcgccggcatgatcattatgctgatccccacagtgatggctttccacctgacgacgagaaatggggaacctcatatgattgtcggaatccaggaaaagggcaaaagcctgctttttaagaccgaagacggggttaatatgtgcacactgatggccatggatctcggagaactgtgtgaagacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgttacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgtcttttgtgactccaagctgatgagcgctgccatcaaagataatcgcgctgtgcatgccgacatgggctattggatcgagtctgcgctcaacgatacctggaagattgagaaagcctccttcatcgaagtcaagaattgccactggcctaaaagccatacactgtggtctaacggcgtgctggagagcgaaatgattatccccaagaaccttgctgggccggtgtcccaacacaattaccggcctggataccacacccagattgccggcccctggcatctcgggaagctggagatggacttcgatttttgtgacggaacgacagtcatcgttaccgaagattgcggcaacagagggcccagcctgcgcaccacaaccgcttctggaaaactcattacggagtggtgctgtcggtcctgcacactgcctccgcttagatatcggggcgaggacggctgttggtacgggatggaaatccgccccctgaaggagaaagaagagaatctcgtgaacagcctggtgaccgccggacacggccaggtcgataatttctccctgggggtgcttggaatggccctctttctggaagagatgctgagaacacgggttggcaccaagcatgctatcctcctggtggcggtctctttcgtgacacttattaccgggaacatgagctttaaagacctgggaagagttgtggtcatggtgggcgccacgatggctgatgacatcggcatgggggttacctatctcgccctgctggccgctttcaaggtgcgccctacatttgccgcgggacttctgctccggaagctgacctccaaagagctcatgatgacaaccattggcatcgtcctgctttctcaaagcacgattcccgaaacagtgctggagctcaccgatgctctggccctggggatgatggtgcttaagatcgtcagaaatatggaaaaataccagctggccgttacaatcatggctattctctgcgtgcctaacgccgtgatcctgcagaatgcgtggaaggtctcctgtaccattctcgctgtggtttctgtgagccccctgcttctgacctccagccagcagaagaccgactggatccctctcgccctgacgattaagggactgaaccccaccgccatcttccttacaaccctgtctcgcacaaataaaaagagatcctggccgctcaacgaggctatcatggccgtcggcatggtgagcattctggcttcttccctcctgaagaatgacatccctatgaccgggccccttgttgccggaggcctgctgacggtgtgctatgtcctcacaggccggagcgcggatctggaacttgagcgcgccaccgacgtgaaatgggaggatcaggctgaaatttctgggtccagccctatcctgtccattaccatcagcgaggacggatctatgagcattaagaacgaagaggaggaacagacactcaccatcctgatcagaacaggcctcctggtcatttccgggctttttcccatctctattccgatcacggccgctgcctggtacctgtgggaggtgaaaaagcagcgggccggagttctgtgggatgtgccttctccccctcccatgggcaaagctgaactcgaggacggggcgtatcgcattaagcaaaagggaatcctgggctactcccagatcggcgccggggtctacaaagaaggaaccttccacacaatgtggcatgtgaccagaggcgctgttcttatgcacaaggggaaacggattgagccctcctgggccgatgtgaagaaagacctgatcagctatggaggcgggtggaagctcgagggagaatggaaggagggcgaagaggtccaggtgctggccctcgaacctggcaaaaatccgcgcgctgtgcagacaaagcccgggctgtttaaaaccaacacgggaaccattggcgccgtttcccttgatttctctcctgggacaagcggatcccccatcattgacaagaaaggcaaggtcgtggggctgtacggaaacggcgtggtcaccagaagcggcgcgtatgtgtctgctatcgcccaaacagagaagtccatcgaggataatcctgaaattgaggacgatatctttcggaaacgcagactgaccattatggacctccaccccggggccggaaagacaaaacggtacctgcctgctatcgttagagaagccattaagcgcggccttcggacgctgatcctcgcgccgaccagagtggtcgctgccgagatggaagaggccctgcgcgggctccccattcggtatcagacccctgctatcagagccgagcataccggacgcgaaatcgtggacctgatgtgtcacgctaccttcacaatgcggcttctgagccccgttagagtgcctaactacaatctgattatcatggatgaggcccatttcacggaccccgcgtctattgccgctcgcggctatatctccacccgggtcgaaatgggggaggccgctggcatttttatgacagccaccccgcctggaagcagagatcccttcccccagtccaacgcccctatcatcgacgaggaacgggagattcccgaacgctcttggaatagcggccacgagtgggtgacagattttaaagggaagaccgtttggttcgtgccttccatcaaggctggaaacgacattgcggcctgcctccgcaaaaatggcaagaaagtcatccaactgagccggaagacgtttgattctgaatacgtgaaaacacgcaccaacgactgggatttcgtggtcaccacagacatttccgagatgggggctaattttaaggccgagagagttatcgatccgcggagatgtatgaaacccgtgatccttaccgacggagaggaacgcgtgattctggccggccctatgcccgtcacacatagctctgctgcccagcggagagggcgcatcggccggaaccctaagaatgaaaacgaccagtacatttatatgggagagcccctcgaaaatgatgaggactgcgcgcactggaaggaggctaaaatgctgctggataacatcaataccccggaaggcattatccctagcatgttcgagcccgaaagagagaaggtggacgccattgatggggaataccgcctccggggagaggccagaaaaacgtttgttgaccttatgcgcagaggcgatctgcctgtgtggctggcttataaggtcgccgcggaggggatcaactacgccgaccggcgctggtgtttcgatggaatcaaaaacaatcagattctcgaagagaacgtggaagttgagatctggacaaaggagggcgaaagaaagaaactgaagccccggtggcttgacgctcgcatttattccgatcctctggccctcaaagagtttaaggagttcgctgccgggagaaaatctctgaccctgaatctcatcacagagatgggccggcttcccaccttcatgacgcaaaagaccagagacgctctggataacctggccgtgctccacacagcggaagccggaggccgcgcttacaatcatgccctgagcgagcttccggagaccctggaaacactcctgctgctcacccttctggctacagtcaccgggggaatttttctgttcctcatgtccggccgggggatcggaaagatgacgctgggcatgtgctgcatcattacagcctctatccttctgtggtatgcccagattcagcctcactggatcgctgcgagcattatcctcgagtttttcctgatcgtgctgctcattcccgaacccgagaaacagagaacccctcaagacaaccagcttacctacgtcgtgatcgccattctgacagttgtggctgccaccatggccaatgaaatgggctttctggagaagaccaagaaggacttcgggctcggatccatcgctacgcagcagccggagagcaacattctggatatcgaccttcgccccgcctctgcgtggaccctgtacgccgtggctacaacctttgtcacacctatgctccggcattccattgaaaatagctccgttaacgtgtctctgaccgccatcgctaatcaagccacggtgctgatgggcctcgggaaaggatggccccttagcaagatggatatcggcgtccctctgctggcgattgggtgttattcccaggtgaaccccatcaccctcacagccgctctgcttctgctcgttgcccactacgctattatcggacctggcctgcaggccaaggctaccagagaggcccagaaacgggcggccgctggcattatgaagaatccgacagtggacgggatcaccgtcatcgatctggaccccattccttatgatcccaaattcgaaaagcaactcggacaggtgatgcttctgatcctgtgcgtcacacaggtgctcatgatgcgcacaacctgggccctgtgtgaggctcttacactggccaccggccctatttctaccctctgggaagggaaccccggaagattttggaatacaacgatcgccgttagcatggcgaacattttccggggctcctacctggctggggccggactgctctttagcatcatgaaaaataccacaaacacccgcagaggcacaggcaacatcggggagacccttggagagaagtggaaatctcggctgaatgctctgggcaagtccgagttccaaatttataagaaaagcgggatccaggaggtggaccgcacgctcgccaaggaaggaattaaaagaggcgagacagatcaccatgccgtctctcgggggtccgctaagctgcgctggtttgtggagagaaacatggttaccccggaaggaaaagtggtcgaccttggctgcggcagagggggatggagctactattgtggcgggctgcggaatgtgcgcgaggtgaagggactcaccaagggcgggcctggacacgaagaacccatccccatgtctacatacggctggaacctggttcggctgcagagcggcgtcgatgtgttcttcattcctcccgaaaaatgcgacaccctcctttgtgatatcggggagtcctctcctaatccgacagtggaggccggaagaacgctgcgcgtcctgaacctcgttgaaaattggctgaacaataacacccagttttgcatcaaggtgcttaatccctacatgcctagcgtgattgagaaaatggaagcgctgcaacggaagtatggcggggccctcgtcagaaaccccctgtcccgcaatagcacacatgagatgtactgggtgtccaacgcttctggaaatatcgttagctccgtgaacatgatttctcggatgctgatcaacagattcaccatgcgccacaaaaaggccacatatgaacctgacgtcgacctcggcagcgggacccggaatattggaatcgagtccgagattcccaaccttgatatcatcggcaagagaattgagaagatcaagcaggagcatgaaacgtcttggcactacgaccaggatcacccgtataaaacctgggcttaccatggcagctatgagacaaagcagaccgggtccgccagctctatggtgaatggagttgtgcgcctgctgacaaaaccttgggacgtcctccccaccgtgacacaaatggcgatgaccgatacgacaccttttggccagcagcgggtgttcaaggaaaaggtcgacaccagaacccaggagcccaaagaggggacaaagaaactgatgaagattacggccgaatggctttggaaagagctgggaaagaaaaagacccctcgcatgtgtacaagagaagagtttacccggaaggttcgctccaacgctgccctcggcgctatcttcacagatgagaataaatggaaaagcgccagagaagctgtggaggactctcggttttgggaactggtggataaagagagaaacctgcacctcgaagggaagtgcgagacctgtgtctacaatatgatgggaaaacgggagaagaagctgggcgagttcggcaaagccaaggggtcccgcgcgatttggtacatgtggcttggagccagatttctggagttcgaagctctcggctttctgaacgaggaccattggttcagccgggaaaattctctttccggggtggagggagagggcctgcacaaactcgggtatatcctgcgcgatgttagcaagaaagaaggcggagccatgtacgctgacgacacagccggctgggataccagaatcacgctggaggacctcaagaacgaagagatggtgaccaatcacatggaaggggagcataagaaactggccgaggcgatttttaaacttacatatcaaaacaaagtcgtgcgggttcagcgccccaccccgagaggaacagtgatggatatcatttcccggcgcgaccagagaggcagcgggcaagtcggaacctacggcctgaatacgttcacaaacatggaagctcagctcatccggcagatggagggggaaggcgtgttcaagaatattcagcacctgaccgttacagaggaggtggccgtccaaaactggcttgcccgcgtgggaagagaacggctgtctcgcatggctatcagcggcgatgactgcgtcgtgaaacctctcgatgacagatttgccaacgctctgaccgccctgaatgatatggggaagatccggaaggacattcagcagtgggagccctccaaaggatggaacgattggacgcaggttcccttctgctctcatcactttcatgaactcatcatgaaggacggcagagtgctggtcgtgccttgtcgcaatcaagatgagcttattgggcgggcgagaatcagccagggagccggctggtccctgcgcgaaaccgcttgcctcgggaaatcttatgcccagatgtggagcctgatgtacttccaccggagagaccttcgcctggctgccaacgcgatttgttccgccgtgccgtctcactgggttcccacaagccggaccacatggtccatccatgctaagcacgagtggatgaccacagaggacatgctcaccgtgtggaatagagtctggattcgcgaaaacccttggatggaggataaaacgcccgtggaaagctgggaggaaatcccttatctgggcaagcgggaggaccagtggtgcggatctctgatcggcctcacatccagagccacctgggctaagaatattcaagccgctatcaaccaggttcgcagcctgattgggaatgaggaatacatcgattacatgccctctatgaaacggtttagacgggaggaagaggaagccggagtgctttggtga

SEQ ID NO: 20111 - RNA, 9876 nt, synthetic construct
  misc_feature 1..9876: note = derived and/or modified CDS sequence (opt5) from DENV-2__EU482664__SS-prME
  source 1..9876: mol_type = other RNA
accgccggcgtgatcattatgctgatccccacagctatggccttccacctcacgacccggaatggggagcctcatatgattgtcggacggcaggaaaagggcaagtccctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccatcaccgaggctgaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggattcagaaggagaccctggttacgttcaagaaccctcatgccaaaaagcaagacgtggtcgtgctcggctcccaggaaggggccatgcacacagctctgaccggcgcgacagagatccagatgagctccggaaatcttctgtttaccggccatctcaaatgcagactgcggatggataaacttcaactgaaagggatgtcttacagcatgtgtaccggaaagttcaagattgttaaagaaatcgccgagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggctgaacccccttttggggattcttacattatcatcggcgtggagcccggacagctcaaactgaattggttcaagaagggctccagcattgggcaaatgtttgagaccacaatgagaggagccaaacgcatggccatccttggcgacaccgcttgggatttcgggtctctgggaggcgtctttacgagcattgggaaggccctccaccaggtgttcggcgcgatctacggagctgccttttccggcgtttcttggacaatgaaaattctgatcggggccatcattacctggatcggaatgaacagccggtccaccagcctgtctgtgtcccttgtcctcgtgggcgtgattacactgtatctgggggctatggttcaggccgacagcggatgtgtcgtgtcttggaagaataaagaactcaagtgcggctccgggatcttcattaccgataacgtgcacacatggacggagcagtacaagtttcaacctgaaagcccctccaaactggcttctgccatccagaaggcgcatgaggaaggcatctgtggaattagaagcgtcacccgccttgagaatctgatgtggaaacagatcacaccggagctcaaccacattctgtccgaaaatgaggtgaagctgaccatcatgacaggcgacattaaagggatcatgcaggccggaaagcggtctcttagacctcaacccaccgaactcaaatatagctggaagacgtggggcaaggctaaaatgctgtccaccgagagccataaccagacattcctgatcgatgggcctgaaaccgccgagtgccccaatacaaaccgcgcttggaactctctcgaggttgaagactacggatttggcgtgttcaccacaaacatttggctgaaacttcgggagaaacaggacgtcttttgtgattccaagctgatgagcgccgcgatcaaagacaatagagccgtgcacgctgatatgggctattggattgaatctgccctcaacgacacctggaagatggagaaggcttccttcatcgaggttaaaagctgccactggcctaagtctcatacgctgtggagcaatggggtgctggaatccgagatgattatccccaagagcttcgccggaccggtctctcagcacaactaccgccctggctattacacacaaaccgccgggccctggcatcttggaaagctcgaaatggattttgacttctgtgagggcaccacagtggttgtgaccgaagattgcgggaaccggggaccctccctgagaacgacaaccgctagcggcaaactgattacagagtggtgctgtcggtcctgcaccctccctccgctgcgctacagaggcgaggacgggtgttggtatggaatggaaatccggccccttaaggagaaggaagagaatctggtcaactctctcgtgacagcgggccacgggcagatcgataattttagcctgggagtgctgggcatggcccttttcctcgaagagatgctgagaacccgcgtcgggacgaaacatgctattctgctcgttgccgtgtcctttgtgaccctgatcacaggaaacatgtctttccgggaccttggcagagtcatggtgatggttggcgccaccatgacagatgacattgggatgggagtgacctacctggctctcctggccgcgtttaaggtccgccctacgttcgctgccggcctgcttctgagaaaactcacaagcaaggagctgatgatggccaccatcgggattgctctcctgtcccagtctacaatccccgaaaccatccttgagctgaccgatgccctcgcgctgggaatgatggtgctgaaaattgttcggaatatggaaaagtatcaacttgctgtgacaatcatggccattagctgcgtccctaacgccgtgatcctgcagaatgcttggaaggtttcctgtacgattctcgccgctgtgagcgtctctcccctgctcctgacctccagccagcagaaagccgactggatccctcttgcgctgacaatcaagggcctcaaccccaccgccatttttctgacaaccctgtctcgcacgtccaaaaagagaagctggccgcttaatgaggctatcatggccgtggggatggtgtctattctggcttccagcctcctgaaaaacgacatccctatgacaggacccctcgtcgccggcggcctgcttaccgtttgctacgtgctgaccgggcggtccgccgatctggaactcgagcgcgctacagacgtgaagtgggaggatcaagcggaaattagcggatctagccctatcctgtccattaccatctctgaggacggcagcatgtccatcaaaaatgaagaggaggaacagacacttacgattctgatcagaaccgggctcctggtcatttctggactcttccccgtgagcatcccgattacagccgctgcctggtatctgtgggaggttaagaagcagcgggccggcgtgctttgggatgtcccttctccccctcccgtggggaaagctgaactggaggacggagcctaccgcatcaagcagaaaggcatcctgggctatagccaaattggggcgggagtttacaaggaaggcacctttcacacaatgtggcacgtgaccagaggggctgtcctcatgcatcggggaaaacgcatcgagcccagctgggccgatgtgaagaaggacctgatttcctacggcgggggatggaaacttgagggcgaatggaaggagggcgaagaggtccaggtgctggccctcgaacctgggaaaaacccgagagctgttcagacgaagcccggactgttcaaaaccaatacaggcaccatcggggccgtgagcctcgatttttctcctggaacatccggcagccccattgtcgaccggaaggggaaggtggttggactgtatggcaacggcgtggtcaccagatctggggcgtacgtgtccgctatcgcccagacagagaaaagcatcgaggataatcctgaaattgaggacgatatcttccgcaagaaacggcttacgattatggacctgcaccccggagccggcaagaccaaaagatatctgcctgctatcgtgcgcgaagccattaagcgggggctcagaacactgatccttgctccgacccgcgttgtcgccgcggagatggaagaggccctgcggggactccccattagataccaaacccctgctatccgcgccgagcatacaggccgggaaatcgtggacctgatgtgtcacgctacgttcaccatgagactcctgtcccccgtgcgggtccctaactataaccttattatcatggatgaggcccattttacagaccccgcctctattgctgcgcgcgggtacatcagcaccagagtggaaatgggcgaggccgctggaattttcatgacagccaccccgcctggctcccgggatccctttccccagagcaatgcccctatcatcgacgaggaacgcgagattcccgaaagatcttggaactccgggcacgagtgggttacggatttcaagggaaaaacagtgtggtttgtccctagcatcaaggctggcaatgacattgccgcgtgcctgcggaaaaacgggaagaaagtgatccagctgtctagaaagaccttcgatagcgaatatgttaagacccgcacaaatgactgggattttgtggtcaccacagacatttccgagatgggagctaacttcaaagccgagcgggtgatcgatccgagacgctgtatgaagcccgttatcctcaccgacggcgaagaacgggtgattctggccgggcctatgcccgtcacgcactctagcgctgcccaaagacgcggccggatcggaagaaatcctaaaaacgaaaatgaccagtacatttacatgggcgagccccttgaaaacgatgaggactgcgcgcattggaaggaggccaaaatgctgctcgataatatcaacacaccggaagggattatcccttccatgtttgagcccgaacgcgagaaggtggacgctattgatggagaatatagactgcggggcgaggcccgcaaaaccttcgtggacctgatgagaagaggggatctccctgtctggcttgcttaccgcgttgccgctgagggaatcaattatgccgacagacggtggtgttttgatggcgtgaagaacaatcagatcctggaagagaacgtggaagtcgagatttggacaaaggagggggaacgcaagaagctgaaaccccgctggctcgacgcgcggatctactctgatcctctggcccttaaggagttcaaagagttcgctgccggcagaaagagcctgaccctcaacctgattacggagatgggacgcctgcccacctttatgacacagaaggctcgggacgccctcgataatcttgccgtgctgcacaccgctgaagcgggcgggagagcctataaccatgctctgtccgagctcccggagacactggaaacccttctgctcctgacactgctcgccaccgttacgggaggcatcttcctttttctgatgagcgggaaaggagtgggcaagatgacactgggcatgtgctgcattatcaccgcctctatcctcctgtggtacgctcaaattcagcctcactggatcgccgcgtccattatccttgagttctttctgattgtcctcctgatccccgaacccgagaaacagcggacccctcaggacaatcaactgacatatgtggttatcgccattctcaccgtggtcgctgccacaatggctaacgaaatggggttccttgagaagacgaaaaaggacctgggactgggcagcgtggccacccaggagccggaatccaatatcctcgatattgacctgcgccccgcgtctgcctggacactttacgctgtcgccaccacatttgtgacccctatgctgagacacagcatcgagaactcctctgttaatgtgagcctcacggctattgccaaccaggctaccgtgctgatggggctgggaaagggctggcccctctccaaaatggatatcggggtccctcttctggccattggatgttacagccaggttaatcccatcacactgaccgcggccctcctgcttctgatcgctcattatgccattatcggccctggcctccaagctaaggccacacgggaagcccagaaacgcgcggctgccgggattatgaagaacccgaccgtggacggaatcacggtgattgatctggaccccatcccttacgatcccaaattcgagaagcagctgggccaggtcatgctccttatcctgtgcgtgacacaagttctgatgatgagaaccacatgggctctctgtgaagccctgacccttgccaccgggcctatttctacactgtgggagggaaatcccggccggttttggaacacgaccatcgctgtgtccatggccaatattttccgcgggagctatctcgcgggagccggcctgctgttttctatcatgaagaacacaaccaatacaagacggggcaccgggaacattggagagacgctcggcgaaaaatggaagtcccgccttaatgctctggggaaaagcgagttccagatctacaagaaatctggaatccaggaagtcgacagaacactggccaaggagggcattaaaagaggggaaaccgatcaccatgctgtgagcagaggatccgccaagctccgctggtttgtcgaacggaacatggtgaccccggagggcaaggttgtggacctgggctgcgggagaggaggctggtcttattactgtgggggacttaaaaacgtccgcgaagtgaagggcctgacaaaagggggacctggccacgaggaacccatccccatgagcacctatggctggaatctcgttcggctgcaatccggggtggatgtcttcttcacacctcccgagaagtgcgacacgctgctctgtgatattggagagagctcccctaacccgaccatcgaagcgggcagaacacttcgcgtgctgtctctggtggagaattggctcaacaatgacacccagttttgcattaaagttctgaacccctacatgcctagcgtcatcgaaaagatggagacacttcagcggaagtacgggggagccctggtgagaaatcccctctcccgcaactctacccatgaaatgtattgggtgagcaatgctacgggcaacatcgtctcctctgttaatatgattagccggatgctgatcaacagattcaccatgaaacacaagaaagccacatacgagcctgacgtggatctggggtccggaacccgcaatattggcatcgagagcgaaattcccaacctcgacatcattggcaagcggatcgagaaaatcaagcaggaacacgagacatcttggcattatgatcaagaccacccgtacaagacctgggcttatcatgggtcctacgaaacaaaacagaccggaagcgcctcttccatggtgaatggcgtcgtgagacttctgacgaagccttgggatgttgtgcccatggtcacacagatggctatgaccgacaccacaccttttgggcagcaacgcgtgttcaaagagaaggttgatacgagaacccaggagcccaaagaaggaacaaagaagctgatgaaaattaccgccgagtggctctggaaggaactgggcaaaaagaaaacacctcggatgtgtacccgcgaggagtttacaagaaaggtgcggagcaacgcggcccttggggctatcttcaccgacgaaaacaaatggaagtctgccagagaggctgtcgaagattcccggttttgggagctggtggacaaggaacgcaatctccacctggagggaaaatgcgagacgtgtgtgtataacatgatgggcaagagagagaagaagctgggcgagttcgggaaagccaagggaagccgggccatttggtacatgtggctcggcgcgcgctttctggagttcgaggctcttgggtttctgaatgaagatcactggttctccagagagaacagcctctctggagtcgagggcgaagggctgcataaacttggctacatcctgcgggacgttagcaaaaaggagggaggcgccatgtatgccgacgataccgctgggtgggacacacgcattaccctcgaagatctgaaaaatgaggaaatggtgacaaaccacatggagggagagcataagagactggccgaagctatctttaaactcacctaccagaataaggtggtccgggtgcagcgccccacgccgagaggcacagttatggacatcatttcccggcgcgatcaaagagggtctggacaggtgggcacctatgggctgaacacattcaccaatatggaggcccagcttatccggcaaatggaaggcgagggaattttcaagagcatccagcacctgacggtcaccgaggaaattgcggtgcagaactggctcgcccgcgttggcagagagcggctgtccagaatggctatctctggggacgattgcgtggtcaaacctcttgacgatcgctttgccagcgctctgacagccctcaatgacatgggaaaggtgcggaaagatatccagcaatgggaaccctccaagggctggaacgactggacccaggttcccttctgctctcatcactttcacgagctgattatgaaagatgggagagtgctggtcgtgccttgtcgcaatcaggacgaactcatcggacgggcgagaattagccagggcgccgggtggtccctgaaggagacagcttgccttggcaagagctacgcccaaatgtggtctctgatgtatttccatcgccgggacctcagactggctgccaacgctatctgttccgccgtcccgagccactgggtgcccacctctcgcacaacctggtccattcatgcgaaacacgagtggatgacgacagaagatatgcttaccgtttggaatcgggtgtggatccaggagaacccttggatggaagacaagacccccgtcgagagctgggaagaggtgccttacctgggaaaaagagaggatcagtggtgcggctccctcattgggctgacatctcgcgccacctgggctaagaacatccagacagccatcaatcaagtgcggagcctgattggaaacgaagagtatacggactacatgccctccatgaaaagatttcggagagaagaggaagaggccggcgttctctggtga

SEQ ID NO: 20112 - RNA, 9876 nt, synthetic construct
  misc_feature 1..9876: note = derived and/or modified CDS sequence (opt5) from DENV-2__EU482665__SS-prME
  source 1..9876: mol_type = other RNA
agcgccggaatgatcattatgctgatccccacagtgatggctttccacctgacaacgagaaatggggaacctcatatgattgtcggaatccaggaaaagggcaaatccctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaaaacggactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgctgaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagagaacccctcaagacaaccagcttacctacgtggtcatcgctattctgacagtggttgccgccaccatggctaatgaaatgggctttctggagaagaccaaaaaggacttcgggctcggatccatcgccacgcagcagccggagagcaacattctggatatcgaccttcgccccgcgtctgcctggaccctgtacgctgtggccacaacctttgtgacacctatgctccggcattccattgaaaatagctccgtcaacgtttctctgaccgctatcgccaatcaagcgacggtgctgatgggcctcgggaaaggatggccccttagcaagatggatatcggcgtgcctctgctggccattgggtgttattcccaggtcaaccccatcaccctcacagctgccctgcttctgctcgtggctcactacgccattatcggacctggcctgcaggctaaggccaccagagaggcgcagaaacgggccgctgccggcattatgaagaatccgacagttgacgggatcaccgtgatcgatctggaccccattccttatgatcccaaattcgaaaagcaactcggacaggtcatgcttctgatcctgtgcgtgacgcaggtcctcatgatgcgcacaacctgggctctgtgtgaggcccttacactggccaccggccctatttctaccctctgggaagggaaccccggaagattttggaatacaacgatcgcggtgagcatggctaacattttccggggctcctacctggccggggctggactgctctttagcatcatgaaaaataccacaaacacccgcagaggcacaggcaacatcggggagacccttggagagaagtggaaatctcggctgaatgccctgggcaagtccgagttccaaatttataagaaaagcgggatccaggaggttgaccgcacgctcgccaaggaaggaattaaaagaggcgagacagatcaccatgctgtgtctcgggggtccgccaagctgcgctggtttgtcgagagaaacatggtgaccccggaaggaaaagttgtggaccttggctgcggcagagggggatggagctactattgtggcgggctgaagaatgtccgggaggtgaagggactcaccaaaggcgggcctggacacgaagaacccatccccatgtctacatacggctggaacctggtgcgcctgcagagcggcgttgatgtcttcttcattcctcccgaaaagtgcgacaccctcctttgtgatatcggggagtcctctcctaatccgacagtggaggcgggacggacgctgagagtgctgaacctcgtcgaaaattggctgaacaataacacccagttttgcatcaaagttcttaatccctacatgcctagcgtgattgagaagatggaagccctgcaacgcaaatatggcggggctctcgtgcggaaccccctgtccagaaatagcacacatgagatgtactgggtctccaacgcctctggaaatatcgtgagctccgttaacatgatttctcgcatgctgatcaaccggttcaccatgagacacaagaaggctacatatgaacctgacgtggacctcggcagcgggacccgcaatattggaatcgagtccgagattcccaaccttgatatcatcggcaaacggattgaaaagatcaaacaggagcatgaaacgtcttggcactacgaccaggatcacccgtataagacctgggcctaccatggcagctatgagacaaaacagaccgggtccgcgagctctatggtcaatggagtggttagactgctgacaaagccttgggacgtgctccccaccgtcacacaaatggccatgaccgatacgacaccttttggccagcagcgcgtgttcaaggaaaaagtggacacccggacccaggagcccaaggaggggaccaaaaagctgatgaaaattacggctgaatggctttggaaggagctgggcaaaaagaagacccctagaatgtgtacacgcgaagagtttaccagaaaagtccggtccaacgccgctctcggcgccatcttcacagatgagaataagtggaaaagcgctcgcgaagccgttgaggactctagattttgggaactggtggataaggagcggaacctgcacctcgaagggaaatgcgagacctgtgtgtacaatatgatgggaaagagagagaagaaactgggcgagttcggcaaggcgaaagggtcccgggccatttggtacatgtggcttggagctcgctttctggagttcgaagccctcggctttctgaacgaggaccattggttcagcagagaaaattctctttccggggtcgagggagagggcctgcacaagctcgggtatatcctgcgggatgtgagcaaaaaggaaggcggagctatgtacgccgacgacacagccggctgggatacccgcatcacgctggaggacctcaagaacgaagagatggttaccaatcacatggaaggggagcataaaaagctggcggaggctatttttaaacttacatatcaaaacaaggtggtcagagtgcagcggcccaccccgcgcggaacagttatggatatcatttccagacgggaccagcgcggcagcgggcaagtgggaacctacggcctgaatacgttcacaaacatggaagcccagctcatcagacagatggagggggaaggcgtcttcaaaaatattcagcacctgaccgtgacagaggaggttgccgtgcaaaactggcttgctcgggtcggacgcgaaagactgtctcggatggccatcagcggcgatgactgcgtggtcaagcctctcgatgaccgctttgctaacgccctgaccgcgctgaatgatatggggaagatcagaaaagacattcagcagtgggagccctccaagggatggaacgattggacacaggtgcccttctgctctcatcactttcatgaactcatcatgaaagacggccgggttctggtggtcccttgtagaaatcaagatgagcttattgggcgcgcccggatcagccagggagctggctggtccctgagagaaaccgcctgcctcgggaagtcttatgctcagatgtggagcctgatgtacttccaccgccgggaccttagactggccgcgaacgccatttgttccgctgtgccgtctcactgggtgcccacaagccgcaccacatggtccatccatgccaaacacgagtggatgaccacagaggacatgctcaccgtttggaatcgggtgtggattagagaaaacccttggatggaggataagacgcccgtcgaaagctgggaggaaatcccttatctgggcaagcgcgaggaccagtggtgcggatctctgatcggcctcacatcccgggctacctgggccaaaaatattcaagctgccatcaaccaggtgagaagcctgattgggaatgaggaatacaccgattacatgccctctatgaagcgctttcggagagaggaagaggaagcgggagttctttggtga

SEQ ID NO: 20113 - RNA, 9876 nt, synthetic construct
  misc_feature 1..9876: note = derived and/or modified CDS sequence (opt5) from DENV-2__EU482666__SS-prME
  source 1..9876: mol_type = other RNA
accgccggagtgatcattatgctgatccccacagctatggccttccacctcacgacccggaatggggagcctcatatgattgtcggacggcaggaaaagggcaagtccctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaattccacatctacctgggtgacgtatggcacctgtacaaccacaggggagcaccggcgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaagcagcctgctacgctgagaaaatattgcatcgaagccaagctcacaaacaccaccacagagagccggtgtccgacccaaggagagccctctctgaatgaagaacaggacaaacgctttgtctgcaagcattccatggtggatagaggctggggcaacgggtgtggactgttcggcaaagggggaattgtgacatgcgcgatgtttacgtgcaaaaagaatatggaaggcaaaatcgtccagcctgagaacctcgaatacaccattgttatcacaccccacagcggggaggagcatgccgtgggaaatgacaccggcaagcacggcaaagaaatcaagattacacctcagtcttccatcaccgaggctgaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggattcagaaggagaccctggttacgttcaagaaccctcatgccaaaaagcaagacgtggtcgtgctcggctcccaggaaggggccatgcacacagctctgaccggcgcgacagagatccagatgagctccggaaatcttctgtttaccggccatctcaaatgcagactgcggatggataaacttcaactgaaagggatgtcttacagcatgtgtaccggaaagttcaagattgttaaagaaatcgccgagacacagcacggcacgatcgtgattagagtccagtatgagggggacggatccccctgcaagatccccttcgaaattatggatctcgagaaacgccatgtgctgggccggctgatcaccgtcaaccctattgtgacagaaaaggacagcccggttaacatcgaggctgaacccccttttggggattcttacattatcatcggcgtggagcccggacagctcaaactgaattggttcaagaagggctccagcattgggcaaatgtttgagaccacaatgagaggagccaaacgcatggccatccttggcgacaccgcttgggatttcgggtctctgggaggcgtctttacgagcattgggaaggccctccaccaggtgttcggcgcgatctacggagctgccttttccggcgtttcttggacaatgaaaattctgatcggggccatcattacctggatcggaatgaacagccggtccaccagcctgtctgtgtcccttgtcctcgtgggcgtgattacactgtatctgggggctatggttcaggccgacagcggatgtgtcgtgtcttggaagaataaagaactcaagtgcggctccgggatcttcattaccgataacgtgcacacatggacggagcagtacaagtttcaacctgaaagcccctccaaactggcttctgccatccagaaggcgcatgaggaaggcatctgtggaattagaagcgtcacccgccttgagaatctgatgtggaaacagatcacaccggagctcaaccacattctgtccgaaaatgaggtgaagctgaccatcatgacaggcgacattaaagggatcatgcaggccggaaagcggtctcttagacctcaacccaccgaactcaaatatagctggaagacgtggggcaaggctaaaatgctgtccaccgagagccataaccagacattcctgatcgatgggcctgaaaccgccgagtgccccaatacaaaccgcgcttggaactctctcgaggttgaagactacggatttggcgtgttcaccacaaacatttggctgaaacttcgggagaaacaggacgtcttttgtgattccaagctgatgagcgccgcgatcaaagacaatagagccgtgcacgctgatatgggctattggattgaatctgccctcaacgacacctggaagatggagaaggcttccttcatcgaggttaaaagctgccactggcctaagtctcatacgctgtggagcaatggggtgctggaatccgagatgattatccccaagagcttcgccggaccggtctctcagcacaactaccgccctggctatcatacacaaaccgccgggccctggcaccttggaaagctcgaaatggattttgacttctgtgagggcaccacagtggttgtgaccgaagattgcgggaaccggggaccctccctgagaacgacaaccgctagcggcaaactgattacagagtggtgctgtcggtcctgcaccctccctccgctgcgctacagaggcgaggacgggtgttggtacggaatggaaatccggccccttaaggagaaggaagagaatctggtcaactctctcgtgacagcgggccatgggcagatcgataattttagcctgggagtgctgggcatggcccttttcctcgaagagatgctgagaacccgcgtcgggacgaaacacgctattctgctcgttgccgtgtcctttatgaccctgatcacaggaaacatgtctttccgggaccttggcagagtgatggtcatggtgggcgccaccatgacagatgacattgggatgggagttacctatctggctctcctggccgcgtttaaggtgcgccctacgttcgctgccggcctgcttctgagaaaactcacaagcaaggagctgatgatggccaccatcgggattgctctcctgtcccagtctacaatccccgaaaccatccttgagctgaccgatgccctcgcgctgggaatgatggtcctgaaaattatgcggaatatggaaaagtaccaacttgctgtgacaatcatggccattagctgcgttcctaacgccgtgatcctgcagaatgcttggaaggtctcctgtacgattctcgccgctgtgagcgtttctcccctgctcctgacctccagccagcagaaagccgactggatccctcttgcgctgacaatcaagggcctcaaccccaccgccatttttctgacaaccctgtctcgcacgtccaaaaagagaagctggccgcttaatgaggctatcatggccgtggggatggtctctattctggcttccagcctcctgaaaaacgacatccctatgacaggacccctcgtggccggcggcctgcttaccgtgtgctatgtcctgaccgggcggtccgccgatctggaactcgagcgcgctacagacgttaagtgggaggatcaagcggaaattagcggatctagccctatcctgtccattaccatctctgaggacggcagcatgtccatcaaaaatgaagaggaggaacagacacttacgattctgatcagaaccgggctcctggtgatttctggactcttccccgtgagcatcccgattacagccgctgcctggtacctgtgggaggtcaagaagcagcgggccggcgtgctttgggatgttccttctccccctcccgtggggaaagctgaactggaggacggagcctatcgcatcaagcagaaaggcatcctgggctacagccaaattggggcgggagtctataaggaaggcacctttcacacaatgtggcatgtgaccagaggggctgttctcatgcaccggggaaaacgcatcgagcccagctgggccgatgtgaagaaggacctgatttcctacggcgggggatggaaacttgagggcgaatggaaggagggcgaagaggtccaggtgctggccctcgaacctgggaaaaacccgagagctgtccagacgaagcccggactgttcaaaaccaatacaggcaccatcggggccgtgagcctcgatttttctcctggaacatccggcagccccattgttgaccggaaggggaaggtggtcggactgtacggcaacggcgtggttaccagatctggggcgtatgtgtccgctatcgcccagacagagaaaagcatcgaggataatcctgaaattgaggacgatatcttccgcaagaaacggcttacgattatggacctgcatcccggagccggcaagaccaaaagatacctgcctgctatcgtccgcgaagccattaagcgggggctcagaacactgatccttgctccgacccgcgtggtggccgcggagatggaagaggccctgcggggactccccattagatatcaaacccctgctatccgcgccgagcacacaggccgggaaatcgttgacctgatgtgtcatgctacgttcaccatgagactcctgtcccccgtccgggtgcctaactacaaccttattatcatggatgaggcccactttacagaccccgcctctattgctgcgcgcgggtatatcagcaccagagtggaaatgggcgaggccgctggaattttcatgacagccaccccgcctggctcccgggatccctttccccagagcaatgcccctatcatcgacgaggaacgcgagattcccgaaagatcttggaactccgggcacgagtgggtcacggatttcaagggaaaaacagtgtggtttgttcctagcatcaaggctggcaatgacattgccgcgtgcctgcggaaaaacgggaagaaagtgatccagctgtctagaaagaccttcgatagcgaatacgtcaagacccgcacaaatgactgggattttgtggttaccacagacatttccgagatgggagctaacttcaaagccgagcgggtgatcgatccgagacgctgtatgaagcccgtcatcctcaccgacggcgaagaacgggtgattctggccgggcctatgcccgttacgcattctagcgctgcccaaagacgcggccggatcggaagaaatcctaaaaacgaaaatgaccagtatatttacatgggcgagccccttgaaaacgatgaggactgcgcgcactggaaggaggccaaaatgctgctcgataatatcaacacaccggaagggattatcccttccatgtttgagcccgaacgcgagaaggtggacgctattgatggagaatacagactgcggggcgaggcccgcaaaaccttcgtcgacctgatgagaagaggggatctccctgtgtggcttgcttatcgcgtggccgctgagggaatcaattacgccgacagacggtggtgttttgatggcgtcaagaacaatcagatcctggaagagaacgttgaagtggagatttggacaaaggagggggaacgcaagaagctgaaaccccgctggctcgacgcgcggatctattctgatcctctggcccttaaggagttcaaagagttcgctgccggcagaaagagcctgaccctcaacctgattacggagatgggacgcctgcccacctttatgacacagaaggctcgggacgccctcgataatcttgccgtgctgcataccgctgaagcgggcgggagagcctacaaccacgctctgtccgagctcccggagacactggaaacccttctgctcctgacactgctcgccaccgtcacgggaggcatcttcctttttctgatgagcgggaaaggagtgggcaagatgacactgggcatgtgctgcattatcaccgcctctatcctcctgtggtatgctcaaattcagcctcactggatcgccgcgtccattatccttgagttctttctgattgttctcctgatccccgaacccgagaaacagcggacccctcaggacaatcaactgacatacgtggtcatcgccattctcaccgtggttgctgccacaatggctaacgaaatggggttccttgagaagacgaaaaaggacctgggactgggcagcatcgccacccaggagccggaatccaatattctcgatatcgacctgcgccccgcgtctgcctggacactttatgctgtggccaccacatttgtcacccctatgctgagacatagcattgagaactcctctgtgaatgtcagcctcacggctatcgccaaccaggctaccgtgctgatggggctgggaaagggctggcccctctccaaaatggatattggggttcctcttctggccatcggatgttacagccaggtgaatcccatcacactgaccgcggccctcctgcttctgattgctcactacgccatcattggccctggcctccaagctaaggccacacgggaagcccagaaacgcgcggctgccgggatcatgaagaacccgaccgtggacggaattacggtcatcgatctggaccccatcccttatgatcccaaattcgagaagcagctgggccaggttatgctccttattctgtgcgtgacacaagtgctgatgatgagaaccacatgggctctctgtgaagccctgacccttgccaccgggcctatctctacactgtgggagggaaatcccggccggttttggaacacgaccattgctgtctccatggccaatatcttccgcgggagctacctcgcgggagccggcctgctgttttctattatgaagaacacaaccaatacaagacggggcaccgggaacatcggagagacgctcggcgaaaaatggaagtcccgccttaatgctctggggaaaagcgagttccagatctataagaaatctggcattcaggaagtggacagaacactggccaaggagggcatcaaaagaggggaaaccgatcatcacgctgttagcagaggatccgccaagctccgctggtttgtggaacggaacatggtcaccccggagggcaaggtggtcgacctgggctgcgggagaggaggctggtcttactattgtgggggacttaaaaacgtgcgcgaagttaagggcctgacaaaagggggacctggccatgaggaacccattcccatgagcacctacggctggaatctcgtgcggctgcaatccggggtcgatgtgttcttcacacctcccgagaagtgcgacacgctgctctgtgatatcggagagagctcccctaacccgaccattgaagcgggcagaacacttcgcgttctgtctctggtggagaattggctcaacaatgacacccagttttgcatcaaagtcctgaacccctatatgcctagcgtgatcgaaaagatggagacacttcagcggaagtacgggggagccctggtgagaaatcccctctcccgcaactctacccacgaaatgtactgggttagcaatgctacgggcaacattgtctcctctgtgaatatgatcagccggatgctgattaacagattcaccatgaaacacaagaaagccacatatgagcctgacgtggatctggggtccggaacccgcaatatcggcattgagagcgaaatccccaacctcgacattatcggcaagcggatcgagaaaattaagcaggaacatgagacatcttggcactacgatcaagaccatccgtataagacctgggcttaccacgggtcctatgaaacaaaacagaccggaagcgcctcttccatggtcaatggcgttgtgagacttctgacgaagccttgggatgtggtccccatggtgacacagatggctatgaccgacaccacaccttttgggcagcaacgcgttttcaaagagaaggtggatacgagaacccaggagcccaaagaaggaacaaagaagctgatgaaaatcaccgccgagtggctctggaaggaactgggcaaaaagaaaacacctcggatgtgtacccgcgaggagtttacaagaaaggtccggagcaacgcggcccttggggctattttcaccgacgaaaacaaatggaagtctgccagagaggctgtggaagattcccggttttgggagctggttgacaaggaacgcaatctccacctggagggaaaatgcgagacgtgtgtgtacaacatgatgggcaagagagagaagaagctgggcgagttcgggaaagccaagggaagccgggccatctggtatatgtggctcggcgcgcgctttctggagttcgaggctcttgggtttctgaatgaagatcattggttctccagagagaacagcctctctggagtcgagggcgaagggctgcacaaacttggctacattctgcgggacgtgagcaaaaaggagggaggcgccatgtacgccgacgataccgctgggtgggacacacgcatcaccctcgaagatctgaaaaatgaggaaatggtgacaaaccatatggagggagagcacaagagactggccgaagctatctttaaactcacctatcagaataaggtcgttcgggtgcagcgccccacgccgagaggcacagtgatggacattatctcccggcgcgatcaaagagggtctggacaggtcggcacctacgggctgaacacattcaccaatatggaggcccagcttattcggcaaatggaaggcgagggaatcttcaagagcattcagcatctgacggtgaccgaggaaatcgcggttcagaactggctcgcccgcgtgggcagagagcggctgtccagaatggctatctctggggacgattgcgtcgtgaaacctcttgacgatcgctttgccagcgctctgacagccctcaatgacatgggaaaggttcggaaagatattcagcaatgggaaccctccaagggctggaacgactggacccaggtgcccttctgctctcaccactttcatgagctgatcatgaaagatgggagagtcctggtggttccttgtcgcaatcaggacgaactcattggacgggcgagaatcagccagggcgccgggtggtccctgaaggagacagcttgccttggcaagagctatgcccaaatgtggtctctgatgtacttccaccgccgggacctcagactggctgccaacgctatttgttccgccgtgccgagccattgggtccccacctctcgcacaacctggtccatccacgcgaaacacgagtggatgacgacagaagatatgcttaccgtgtggaatcgggtctggattcaggagaacccttggatggaagacaagacccccgtggagagctgggaagaggttccttatctgggaaaaagagaggatcagtggtgcggctccctcatcgggctgacatctcgcgccacctgggctaagaacatccagacagccattaatcaagtgcggagcctgatcggaaacgaagagtacacggactatatgccctccatgaaaagatttcggagagaagaggaagaggccggcgtcctctggtga

SEQ ID NO: 20114 - RNA, 9876 nt, synthetic construct
  misc_feature 1..9876: note = derived and/or modified CDS sequence (opt5) from DENV-2__EU482667__SS-prME
  source 1..9876: mol_type = other RNA
agcgccggcatgatcattatgctgatccccaccgtgatggctttccacctgaccacgagaaatggggaacctcatatgattgtcggaatccaggaaaagggcaagagcctgctttttaagaccgaagacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgttacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaagccctggtgaccttcaagaaccctcatgctaaaaagcaagacgttgtggtcctcggaagccaggagggcgccatgcacacagccctgaccggggctacggaaatccagatgtcctctggcaatcttctgtttacaggacatctcaaatgccgcctgagaatggacaaacttcaactgaagggcatgagctactccatgtgtaccgggaaattcaaggtggtcaaagagattgcggagacacagcacggaaccatcgtgattaaggttcagtatgaaggcgatgggagcccctgcaaaatccccttcgagatcatggacctcgaaaagcggtacgtgctgggaagactgattaccgtcaaccctatcgtgacagagaaggattctccggttaacattgaagccgagcccccttttggcgactcctacatcattatcggggtggagcccggccagctcaaactgaattggttcaagaaaggaagctctattggccaaatgtttgaaacgaccatgcgcggggctaagcggatggccatccttggagatacagcctgggacttcggcagcctcgggggagtctttacctccatcggcaaagctctccatcaggtgttcggggccatttatggcgcggctttttctggagtgagctggacaatgaagatcctgattggcgttatcattacctggatcgggatgaactccagaagcacgtctctgtccgtcagccttgtgctcgtgggaatcgtcacactgtacctgggcgtgatggttcaggccgattctgggtgtgtggtctcctggaagaataaagagctcaagtgcggaagcggcattttcatcaccgacaacgtgcacacctggacagaacagtataaatttcaacctgagtccccctctaagctggccagcgctattcagaaagcccaggaagaggggatctgtggcattcgctccgttacccggcttgagaatctgatgtggaagcagatcacaccggaactcaaccacatcctggctgagaatgaagtgaaactgacgattatgaccggagatatcaagggcattatgcaagccgggaagagatctcttcgccctcagcccacagagctcaaatacagctggaagacctggggaaaagcgaagatgctgtccacagaaagctataaccagaccttcctgatcgacggccctgagacggccgagtgccccaataccaaccgggcttggaactctctcgaagtcgaggattacgggtttggagtgttcacaaccaacatttggctgaaacttaaggaaaagcaggacgtcttttgtgactccaaactgatgagcgccgctatcaaggataatagagccgtgcatgcggacatgggctattggatcgagtctgccctcaacgatacatggaaaattgagaaggcttccttcatcgaagtcaaaaattgccactggcctaagagccataccctgtggtctaacggcgtgctggagagcgaaatgattatccccaagaaccttgccgggccggtgtcccaacacaattaccgccctggataccacacacagattgctggcccctggcatctcgggaaactggagatggacttcgatttttgtgacggaaccacggtcatcgttacagaagattgcggcaaccgggggcccagcctgagaaccaccacagcctctggaaagctcattaccgagtggtgctgtcgctcctgcacgctgcctccgcttcggtatagaggcgaggacggctgttggtacgggatggaaatccggcccctgaaagagaaggaagagaatctcgtgaacagcctggtgacagccggacacggccaggtcgataatttctccctgggggtgcttggaatggctctctttctggaagagatgctgcgcaccagagttggcacaaaacatgcgatcctcctggtggccgtctctttcgtgacccttattacagggaacatgagctttaaggacctgggacgggttgtggtcatggtgggcgctaccatggccgatgacatcggcatgggggttacgtatctcgccctgctggctgccttcaaggtgagacctacctttgcggctggacttctgctccgcaaactgacatccaaggagctcatgatgaccacaattggcatcgtcctgctttctcaaagcaccattcccgaaacggtgctggagctcacagatgccctggccctggggatgatggtgcttaaaatcgtccggaatatggaaaagtaccagctggctgttaccatcatggccattctctgcgtgcctaacgcggtgatcctgcagaatgcttggaaagtctcctgtacaattctcgccgtggtttctgtgagccccctgcttctgacctccagccagcaaaagaccgactggatccctctcgccctgacaattaaaggactgaaccccacggctatcttccttaccacactgtctagaaccaataagaagcgctcctggccgctcaacgaggccatcatggctgtcggcatggtgagcattctggcctcttccctcctgaaaaatgacatccctatgacagggccccttgttgcgggaggcctgctgaccgtgtgctatgtcctcacgggcagaagcgccgatctggaacttgagcgggctacagacgtgaagtgggaggatcaggccgaaatttctgggtccagccctatcctgtccattaccatcagcgaggacggatctatgagcattaaaaacgaagaggaggaacagaccctcacaatcctgatccgcaccggcctcctggtcatttccgggctttttcccatctctattccgatcacagctgccgcctggtacctgtgggaggtgaagaaacagagagctggagttctgtgggatgtgccttctccccctcccatgggcaaggcggaactcgaggacggggcctatcggattaagcaaaaaggaatcctgggctactcccagatcggcgctggggtctacaaggaaggaacgttccacaccatgtggcatgtgacacgcggcgccgttcttatgcacaaagggaagagaattgagccctcctgggccgatgtgaaaaaggacctgatcagctatggaggcgggtggaagctcgagggagaatggaaagagggcgaagaggtccaggtgctggctctcgaacctggcaagaatccgcgggccgtgcagaccaaacccgggctgtttaagacaaacaccggaacgattggcgcggtttcccttgatttctctcctgggaccagcggatcccccatcattgacaaaaagggcaaggtcgtggggctgtacggaaacggcgtggtcacacgcagcggcgcttatgtgtctgccatcgcccaaaccgagaaatccatcgaggataatcctgaaattgaggacgatatctttagaaagcggcgcctgacaattatggacctccaccccggggctggaaaaaccaagagatacctgcctgccatcgttcgggaagcgattaaaagaggccttcgcacactgatcctcgctccgacgcgggtggtcgccgccgagatggaagaggctctgagagggctccccattcgctatcagacccctgccatccgggctgagcatacaggaagagaaatcgtggacctgatgtgtcacgccaccttcaccatgcgccttctgagccccgttcgggtgcctaactacaatctgattatcatggatgaggcgcatttcacagaccccgcctctattgctgccagaggctatatctccacgcgcgtcgaaatgggggaggctgccggcatttttatgaccgccacaccgcctggaagccgggatcccttcccccagtccaacgctcctatcatcgacgaggaaagagagattcccgaacggtcttggaatagcggccacgagtgggtgaccgattttaaggggaagacagtttggttcgtgccttccatcaaagcgggaaacgacattgccgcttgcctccgcaagaatggcaaaaaggtcatccaactgagcagaaaaacctttgattctgaatacgtgaagacgcggacaaacgactgggatttcgtggtcaccaccgacatttccgagatgggggccaattttaaagccgagcgcgttatcgatccgagacggtgtatgaagcccgtgatccttacagacggagaagagagagtgattctggctggccctatgcccgtcacccatagctctgccgcgcagcgccgggggagaatcggccgcaaccctaagaatgaaaacgaccagtacatttatatgggagagcccctcgaaaatgatgaggactgcgctcactggaaagaggccaagatgctgctggataacatcaatacaccggaaggcattatccctagcatgttcgagcccgaacgggagaaagtggacgccattgatggggaatacagactccgcggagaggctcggaagacctttgttgaccttatgagacgcggcgatctgcctgtgtggctggcctataaagtcgcggccgaggggatcaactacgctgacagacggtggtgtttcgatggaatcaagaacaatcagattctcgaagagaacgtggaagttgagatctggacgaaggagggcgaacgcaaaaagctgaaacccagatggcttgacgcccggatttattccgatcctctggctctcaaggagtttaaagagttcgccgctgggcgcaagtctctgacactgaatctcatcaccgagatgggcagacttcccacattcatgacccaaaagacgcgggacgccctggataacctggcggtgctccacaccgccgaagctggaggcagagcctacaatcatgctctgagcgagcttccggagacactggaaaccctcctgctgctcacacttctggccaccgtcacagggggaatttttctgttcctcatgtccggccgcgggatcggaaaaatgaccctgggcatgtgctgcatcattacggcctctatccttctgtggtatgctcagattcagcctcactggatcgcggccagcattatcctcgagtttttcctgatcgtgctgctcattcccgaacccgagaagcagcggacacctcaagacaaccagcttacctacgtcgtgatcgctattctgaccgttgtggccgccacaatggctaatgaaatgggctttctggagaaaaccaagaaagacttcgggctcggatccatcgccacacagcagccggagagcaacattctggatatcgaccttagacccgcgtctgcctggacgctgtacgctgtggccaccacatttgtcacccctatgctccgccattccattgaaaatagctccgttaacgtgtctctgacagctatcgccaatcaagcgaccgtgctgatgggcctcgggaagggatggccccttagcaagatggatatcggcgtccctctgctggccattgggtgttattcccaggtgaaccccatcacgctcaccgctgccctgcttctgctcgttgctcactacgccattatcggacctggcctgcaggctaaagccacacgggaggcgcagaagagagccgctgccggcattatgaaaaatccgaccgtggacgggatcacagtcatcgatctggaccccattccttatgatcccaagttcgaaaaacaactcggacaggtgatgcttctgatcctgtgcgtcacccaggtgctcatgatgcggacgacatgggctctgtgtgaggcccttaccctggccacaggccctatttctaccctctgggaagggaaccccggacgcttttggaataccacaatcgcggttagcatggctaacattttcagaggctcctacctggccggggctggactgctctttagcatcatgaagaatacgaccaacacacggcgcggcaccggcaacatcggggagacacttggagagaaatggaagtctagactgaatgccctgggcaagtccgagttccaaatttataaaaagagcgggatccaggaggtggaccggaccctcgccaaagaaggaattaagcgcggcgagacggatcaccatgctgtctctagagggtccgccaaactgcggtggtttgtggagcgcaacatggttacaccggaaggaaaggtggtcgaccttggctgcggcagagggggatggagctactattgtggcgggctgaagaatgtgcgggaggtgaaaggactcaccaagggcgggcctggacacgaagaacccatccccatgtctacctacggctggaacctggttagactgcagagcggcgtcgatgtgttcttcattcctcccgaaaaatgcgacacactcctttgtgatatcggggagtcctctcctaatccgaccgtggaggcgggacgcacactgcgggtcctgaacctcgttgaaaattggctgaacaataacacgcagttttgcatcaaggtgcttaatccctacatgcctagcgtgattgagaaaatggaagccctgcaaagaaagtatggcggggctctcgtccgcaaccccctgtcccggaatagcacccatgagatgtactgggtgtccaacgcctctggaaatatcgttagctccgtgaacatgatttctagaatgctgatcaaccgcttcacaatgcggcacaagaaagctacctatgaacctgacgtcgacctcggcagcgggacaagaaatattggaatcgagtccgagattcccaaccttgatatcatcggcaagcgcattgagaagatcaagcaggagcatgaaacctcttggcactacgaccaggatcacccgtataaaacgtgggcctaccatggcagctatgagaccaagcagacagggtccgcgagctctatggtgaatggagttgtgcggctgctgaccaagccttgggacgtcctccccacagtgacccaaatggccatgacagataccacgccttttggccagcagagagtgttcaaagaaaaggtcgacacacgcacccaggagcccaaagaggggaccaagaaactgatgaagattacagctgaatggctttggaaagagctgggaaagaagaaaacgcctcggatgtgtaccagagaagagtttacacgcaaggttagatccaacgccgctctcggcgccatcttcaccgatgagaataaatggaaaagcgctcgggaagccgtggaggactctcgcttttgggaactggtggataaagagagaaacctgcacctcgaagggaagtgcgagacatgtgtctacaatatgatgggaaagcgggagaaaaagctgggcgagttcggcaaagcgaaggggtccagagccatttggtacatgtggcttggagctcggtttctggagttcgaagccctcggctttctgaacgaggaccattggttcagccgcgaaaattctctttccggggtggagggagagggcctgcacaaactcgggtatatcctgagagatgttagcaagaaggaaggcggagctatgtacgccgacgacaccgccggctgggatacacggatcaccctggaggacctcaaaaacgaagagatggtgacgaatcacatggaaggggagcataagaaactggcggaggctatttttaaacttacctatcaaaacaaagtcgtgcgcgttcagagacccacaccgcggggaaccgtgatggatatcatttcccgcagagaccagcggggcagcgggcaagtcggaacatacggcctgaataccttcacgaacatggaagcccagctcatccgccagatggagggggaaggcgtgttcaagaatattcagcacctgacagttaccgaggaggtggccgtccaaaactggcttgctagagtgggacgggaacgcctgtctagaatggccatcagcggcgatgactgcgtcgtgaagcctctcgatgaccggtttgctaacgccctgacagcgctgaatgatatggggaaaatccgcaaggacattcagcagtgggagccctccaaaggatggaacgattggacccaggttcccttctgctctcatcactttcatgaactcatcatgaaggacggcagagtgctggtcgtgccttgtcggaatcaagatgagcttattgggagagcccgcatcagccagggagctggctggtccctgcgggaaacggcctgcctcgggaaatcttatgctcagatgtggagcctgatgtacttccacagacgcgaccttcggctggccgcgaacgccatttgttccgctgtgccgtctcactgggttcccaccagcagaacaacctggtccatccatgccaagcacgagtggatgacaaccgaggacatgctcacagtgtggaatcgcgtctggattcgggaaaacccttggatggaggataagacccccgtggaaagctgggaggaaatcccttatctgggcaaaagagaggaccagtggtgcggatctctgatcggcctcacgtcccgcgctacatgggccaagaatattcaagctgccatcaaccaggttcggagcctgattgggaatgaggaatacaccgattacatgccctctatgaaaagatttcgccgggaggaagaggaagcgggagtgctttggtga

SEQ ID NO: 20115 - RNA, 9876 nt, synthetic construct
  misc_feature 1..9876: note = derived and/or modified CDS sequence (opt5) from DENV-2__EU482668__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatccgcggcattatgcaagctgggaagcggtctcttagacctcagcccaccgagctcaaatacagctggaagacatggggaaaggccaaaatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaagaaaagcaggacgctttttgtgactccaaactgatgagcgccgctatcaaggataatcgggccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattacagacctggataccacacccagattgctggcccctggcatctcgggaaactggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaggagaaagaagagaatctcgttaacagcctggtgaccgccggacacggccaggtggataatttctccctgggggtccttggaatggctctctttctggaagagatgctgcggacaagagtgggcaccaagcatgcgatcctcctggttgccgtgtctttcgtcacacttattaccgggaacatgagctttaaagacctgggacgcgtggttgtgatggtcggcgctacgatggccgatgacatcggcatgggggtgacctatctcgccctgctggctgccttcaaggttcggcctacatttgcggctggacttctgctcagaaaactgacctccaaggagctcatgatgacaaccattggcatcgtgctgctttctcaaagcacgattcccgaaacagtcctggagctcaccgatgccctggccctggggatgatggtgcttaagatcgtgcgcaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatcttccttacaaccctgtctagaacaaataaaaagcggtcctggccgctcaacgaggccatcatggctgtgggcatggtcagcattctggcctcttccctcctgaaaaatgacatccctatgaccgggccccttgtggcgggaggcctgctgacggtttgctatgtgctcacaggccgcagcgccgatctggaacttgagagagctaccgacgtcaagtgggaggatcaggccgaaatttctgggtccagccctatcctgtccattaccatcagcgaggacggatctatgagcattaagaacgaagaggaggaacagacactcaccatcctgatccggacaggcctcctggtgatttccgggctttttcccatctctattccgatcacggctgccgcctggtacctgtgggaggtcaaaaagcagcgcgctggagtgctgtgggatgttccttctccccctcccatgggcaaagcggaactcgaggacggggcctatagaattaagcaaaaaggaatcctgggctactcccagatcggcgctggggtgtacaaggaaggaaccttccacacaatgtggcatgtcacccggggcgccgtgcttatgcacaaggggaaacgcattgagccctcctgggccgatgttaagaaagacctgatcagctatggaggcgggtggaagctcgagggagaatggaaagagggcgaagaggtgcaggtcctggctctcgaacctggcaagaatccgagagccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccggagcggcgcttatgtctctgccatcgcccaaacagagaaatccatcgaggataatcctgaaattgaggacgatatctttcgcaagagacggctgaccattatggacctccaccccggggctggaaagacaaaaagatacctgcctgccatcgtgcgcgaagcgattaagcggggccttagaacgctgatcctcgctccgacccgcgttgtggccgccgagatggaagaggctctgcgggggctccccattagatatcagacccctgccatccgcgctgagcataccggacgggaaatcgtcgacctgatgtgtcacgccaccttcacaatgagacttctgagccccgtgcgcgttcctaactacaatctgattatcatggatgaggcgcatttcacggaccccgcctctattgctgcccggggctatatctccaccagagtggaaatgggggaggctgccggcatttttatgacagccaccccgcctggaagccgggatcccttcccccagtccaacgctcctatcatcgacgaggaacgcgagattcccgaaagatcttggaatagcggccacgagtgggtcacagattttaaagggaagaccgtgtggttcgttccttccatcaaagcgggaaacgacattgccgcttgcctccggaagaatggcaagaaagtgatccaactgagccgcaagacgtttgattctgaatacgtcaaaacaagaaccaacgactgggatttcgtggtgaccacagacatttccgagatgggggccaattttaaggccgagcgggtcatcgatccgagacgctgtatgaaacccgttatccttaccgacggagaggaacgggtgattctggctggccctatgcccgtgacacatagctctgccgcgcagagacgcgggcggatcggcagaaaccctaagaatgaaaacgaccagtacatttatatgggagagcccctcgaaaatgatgaggactgcgctcactggaaagaggccaagatgctgctggataacatcaataccccggaaggcattatccctagcatgttcgagcccgaacgcgagaaggtcgacgccattgatggggaataccggctcagaggagaggctcgcaaaacgtttgtggaccttatgagacggggcgatctgcctgtttggctggcctataaggtggcggccgaggggatcaactacgctgaccgcagatggtgtttcgatggaatcaaaaacaatcagattctcgaagagaacgtcgaagtggagatctggacaaaggagggcgaacggaaaaagctgaagccccgctggcttgacgccagaatttattccgatcctctggctctcaaagagtttaaggagttcgccgctgggcggaaatctctgaccctgaatctcatcacagagatgggcagacttcccaccttcatgacgcaaaagacccgcgacgccctggataacctggcggttctccacacagccgaagctggaggccgggcctacaatcatgctctgagcgagcttccggagaccctggaaacactcctgctgctcacccttctggccacagtgaccgggggaatttttctgttcctcatgtccggcagagggatcggaaaaatgacgctgggcatgtgctgcatcattacagcctctatccttctgtggtatgctcagattcagcctcactggatcgcggccagcattatcctcgagtttttcctgatcgtcctgctcattcccgaacccgagaagcagcgcacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgcggcccgcgtctgcctggaccctctacgctgtggccacaaccttcgtgacacctatgctgagacattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaagccacccgggaggcgcagaagcgcgccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgagaacaacctgggctctttgtgaggccctgacactcgccaccggccctatttctaccctgtgggaagggaaccccggacggttctggaatacaacgatcgcggtgagcatggctaacatttttcgcggctcctacctggccggggctggactccttttcagcatcatgaaaaataccacaaacaccagacggggcacaggcaacatcggggagaccctgggagagaagtggaaatctcgcctgaatgccctcggcaagtccgaatttcaaatttataaaaagagcgggatccaggaggttgacagaacgctggccaaggaaggaattaaacggggcgagacagatcaccatgctgtgtctcgcgggtccgccaaacttagatggttcgtcgagcggaacatggtgaccccggaaggaaaagttgtggacctgggctgcggcagagggggatggagctactattgtggcgggctcaagaatgtccgcgaggtgaaaggactgaccaagggcgggcctggacacgaggaacccatccccatgtctacatacggctggaacctggtgcggctccagagcggcgttgatgtctttttcattcctcccgaaaagtgcgacacccttctgtgtgatatcggggagtcctctcctaatccgacagtggaggcgggaagaacgctgcgcgtgctcaacctggtcgaaaattggcttaacaataacacccagttctgcatcaaagttctgaatccctacatgcctagcgtgattgagaagatggaagccctccaacggaaatatggcggggctctggtgagaaaccccctgtcccgcaatagcacacatgagatgtactgggtctccaacgcctctggaaatatcgtgagctccgttaacatgatttctcggatgctcatcaacagatttaccatgcgccacaagaaagctacatatgaacctgacgtggaccttggcagcgggacccggaatattggaatcgagtccgagattcccaacctggatatcatcggcaagagaattgaaaagatcaaacaggagcatgaaacgtcttggcactacgaccaggatcacccgtataagacctgggcctaccatggcagctatgagacaaaacagaccgggtccgcgagctctatggtcaatggagtggttcgcctgctcacaaagccttgggacgtgctgcccaccgtcacacaaatggccatgaccgatacgacacctttcggccagcagcgggtgtttaaagaaaaggtggacaccagaacccaggagcccaaggaggggaccaagaaacttatgaaaattacggctgaatggctgtggaaggagctcggcaagaagaaaacccctcgcatgtgtacaagagaagagttcacccggaaggtccgctccaacgccgctctgggcgccatctttacagatgagaataagtggaaaagcgctagagaagccgttgaggactctcggttctgggaactggtggataaggagagaaacctccacctggaagggaaatgcgagacctgtgtgtacaatatgatgggaaagcgggagaagaaacttggcgaatttggcaaagcgaaagggtcccgcgccatttggtacatgtggctgggagctagattcctcgagtttgaagccctgggcttccttaacgaggaccattggtttagccgggaaaattctctgtccggggtcgagggagagggcctccacaagctggggtatatcctgcgcgatgtgagcaaaaaggaaggcggagctatgtacgccgacgacacagccggctgggataccagaatcacgctcgaggacctgaaaaacgaagagatggttaccaatcacatggaaggggagcataagaaacttgcggaggctattttcaaactgacatatcaaaacaaggtggtccgggtgcagcgccccaccccgagaggaacagttatggatatcatttcccggcgcgaccagagaggcagcgggcaagtgggaacctacggcctcaatacgtttacaaacatggaagcccagctgatccggcagatggagggggaaggcgtcttcaaaaatattcagcaccttaccgtgacagaggaggttgccgtgcataactggctggctcgcgtcggaagagaacggctctctcgcatggccatcagcggcgatgactgcgtggtcaagcctctggatgacagattcgctaacgccctgaccgcgctcaatgatatggggaaaatccggaaggacattcaacagtgggagccctccaagggatggaacgattggacacaggtgcccttttgctctcaccatttccacgaactgatcatgaaagacggccggattcttgttgtgccttgtcgcaatcaggatgagctgatcgggcgggccagaattagccaaggagctggctggtccctccgcgaaaccgcctgcctggggaagtcttatgctcagatgtggagccttatgtactttcaccggagagacctgcgcctcgccgcgaacgccatctgttccgctgtcccgtctcattgggtgcccacaagccggaccacatggtccattcacgccaaacatgagtggatgaccacagaggacatgctgaccgtgtggaatagagtttggatccgcgaaaacccttggatggaggataagacgcccgtggaaagctgggaggaaatcccttatctgggcaaacgggaggaccagtggtgcggatctctcattggcctgacatccagagctacctgggccaagaatatccaggctgccattaaccaagtccgcagccttatcgggaatgaggaatacaccgattacatgccctctatgaagcggttcagacgggaggaagaggaagcgggagtgctgtggtga

SEQ ID NO: 20116 - RNA, 9876 nt, synthetic construct
  misc_feature 1..9876: note = derived and/or modified CDS sequence (opt5) from DENV-2__EU482669__SS-prME
  source 1..9876: mol_type = other RNA
agcgccggcatgatcattatgctgatccccaccgtgatggctttccacctgacaacgagaaatggggaacctcatatgattgtcggaatccaggaaaagggcaaatccctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcgcgtgggtgacatatggcacctgtacgaccacaggggagcaccgcagagaaaagcggtccgtggctctcgtccctcatgtgggaatgggcctggagacccgcacagaaacctggatgtctagcgagggcgcctggaaacacgcccagagaatcgagacgtggattctgcggcatcccgggttcacaatcatggctgccattctcgcttacaccatcggaacaacccactttcagcgcgttctgattttcatccttctgaccgccgtggcgccttccatgacaatgagatgcattggcatctctaaccgggattttgtcgaaggggtgagcggaggctcctgggttgacatcgtgctcgagcacgggagctgtgtcacgaccatggccaagaataagcccacactggatttcgaacttattaaaaccgaggctaagcagcctgccacactgcgcaaatattgcatcgaagctaagctcaccaacacgacaaccgagtctagatgtccgacccaaggagagccctccctgaaagaagaacaagacaagcggtttgtgtgcaagcatagcatggtggatcgcggctggggcaatgggtgtggactgttcggcaaagggggaattgtcacatgcgccatgtttacctgcaagaaaaacatggaaggcaagatcgttcagcctgagaatctcgaatacacaattgtggtgacgccccactctggggaggagcatgcggtcggaaacgacaccggcaaacacggcaaggaaatcaaagtgacacctcagtccagcatcaccgaggttgaactgacagggtatggaaccgtgacgatggagtgttctcccagaaccggccttgatttcaatgaaatggtcctgctccaaatggagaacaaggcctggctggtgcaccggcagtggtttcttgacctgccgctcccttggctgcccggggctgataagcaggagtccaattggattcagaaagaaacactggttaccttcaagaaccctcatgccaaaaagcaagacgtggtcgtgctcggaagccaggagggcgctatgcacacagccctgaccggggccacggaaatccagatgtcctctggcaatcttctgtttacaggacatctcaaatgccgcctgagaatggacaaacttcaactgaagggcatgagctactccatgtgtaccgggaaattcaaggtcgtgaaagagattgctgagacacagcacggaaccatcgttattcgggtgcagtatgaaggcgatgggagcccctgcaagatccccttcgagatcatggacctcgagaagcggtacgtcctgggacgcctgattaccgtgaaccctatcgttacagagaaggattctccggtgaacattgaagcggagcccccttttggcgactcctacatcattatcggggtcgagcccggccagctcaagctgaattggttcaaaaagggaagctctattggccaaatgtttgaaacgaccatgagaggggccaaaagaatggctatccttggagatacagcctgggacttcggcagcctcgggggagtgtttacctccatcggcaaggccctccatcaggtgttcggggctatttatggcgccgcgttttctggagttagctggacaatgaaaatcctgattggcgtcatcattacctggatcgggatgaactcccgcagcacgtctctgtccgtgagccttgtgctcgtcggaatcgtgacactgtacctgggcgttatggtgcaggctgattctgggtgtgtcgtgtcctggaagaataaggagctcaaatgcggaagcggcattttcatcaccgacaacgttcacacctggacagaacagtataagtttcaacctgagtccccctctaaactggccagcgccattcagaaggctcaggaagaggggatctgtggcattcggtccgtgaccagacttgagaatctgatgtggaaacagatcacaccggaactcaaccacatcctggccgagaatgaagtcaagctgacgattatgaccggagatatcaaaggcattatgcaagctgggaagcgctctcttcggcctcagcccacagagctcaagtacagctggaaaacctggggaaaggccaaaatgctgtccacagaaagctataaccagaccttcctgatcgacggccctgagacggcggagtgccccaataccaacagagcctggaactctctcgaagtggaggattacgggtttggagttttcacaaccaacatttggctgaaacttaaagaaaagcaggacgctttttgtgactccaagctgatgagcgccgctatcaaagataatcgcgccgtgcatgcggacatgggctattggatcgagtctgccctcaacgatacatggaagattgagaaggctagcttcatcgaagtcaagaattgccactggcctaaaagccataccctgtggtctaacggcgtgctggagagcgaaatgattatccccaagaaccttgccgggccggtgtcccaacacaattaccggcctggataccacacacagattgctggcccctggcatctcgggaagctggagatggacttcgatttttgtgacggaaccacggtcatcgttacagaagattgcggcaacagagggcccagcctgcgcaccaccacagcctctggaaaactcattaccgagtggtgctgtcggtcctgcacgctgcctccgcttagatatcggggcgaggacggctgttggtacgggatggaaatccgccccctgaaggagaaagaagagaatctcgtgaacagcctggtgacagccggacacggccaggtcgataatttctccctgggggtgcttggaatggctctctttctggaagagatgctgagaacccgggttggcacaaagcatgcgatcctcctggtggccgtctctttcgtgacccttattacagggaacatgagctttaaagacctgggaagagttgtggtcatggtgggcgctaccatggccgatgacatcggcatgggggttacgtatctcgccctgctggctgccttcaaggtgcgccctacctttgcggctggacttctgctccggaagctgacatccaaagagctcatgatgaccacaattggcatcgtcctgctttctcaaagcaccattcccgaaacggtgctggagctcacagatgccctggccctggggatgatggtgcttaagatcgtcagaaatatggaaaaataccagctggctgttaccatcatggccattctctgcgtgcctaacgcggtgatcctgcagaatgcttggaaggtctcctgtacaattctcgccgtggtttctgtgagccccctgcttctgacctccagccagcagaagaccgactggatccctctcgccctgacaattaagggactgaaccccacggctatcttccttaccacactgtctcgcaccaataaaaagagatcctggccgctcaacgaggccatcatggctgtcggcatggtgagcattctggcctcttccctcctgaagaatgacatccctatgacagggccccttgttgcgggaggcctgctgaccgtgtgctatgtcctcacgggccggagcgccgatctggaacttgagcgcgctacagacgtgaaatgggaggatcaggccgaaatttctgggtccagccctatcctgtccattaccatcagcgaggacggatctatgagcattaagaacgaagaggaggaacagaccctcacaatcctgatcagaaccggcctcctggtcatttccgggctttttcccatctctattccgatcacagctgccgcctggtacctgtgggaggtgaaaaagcagcgggctggagttctgtgggatgtgccttctccccctcccatgggcaaagcggaactcgaggacggggcctatcgcattaagcaaaagggaatcctgggctactcccagatcggcgctggggtctacaaagaaggaacgttccacaccatgtggcatgtgacaagaggcgccgttcttatgcacaaggggaaacggattgagccctcctgggccgatgtgaagaaagacctgatcagctatggaggcgggtggaagctcgagggagaatggaaggagggcgaagaggtccaggtgctggctctcgaacctggcaaaaatccgcgcgccgtgcagaccaagcccgggctgtttaaaacaaacaccggaacgattggcgcggtttcccttgatttctctcctgggaccagcggatcccccatcattgacaagaaaggcaaggtcgtggggctgtacggaaacggcgtggtcacaagaagcggcgcttatgtgtctgccatcgcccaaaccgagaagtccatcgaggataatcctgaaattgaggacgatatctttcggaaacgcagactgacaattatggacctccaccccggggctggaaagaccaaacggtacctgcctgccatcgttagagaagcgattaagcgcggccttcggacactgatcctcgctccgacgagagtggtcgccgccgagatggaagaggctctgcgcgggctccccattcggtatcagacccctgccatcaaagctgagcatacaggaagagaaatcgtggacctgatgtgtcacgccaccttcaccatgcgccttctgagccccgttcgggtgcctaactacaatctgattatcatggatgaggcgcatttcacagaccccgcctctattgctgccagaggctatatctccacgcgcgtcgaaatgggggaggctgccggcatttttatgaccgccacaccgcctggaagccgggatcccttcccccagtccaacgctcctatcatcgacgaggaaagagagattcccgaacggtcttggaatagcggccacgagtgggtgaccgattacaaggggaagacagtttggtttgtgccttccatcaaagcgggaaacgacattgccgcttgcctccgcaagaatggcaaaaaggtcatccaactgagcagaaaaaccttcgattctgaatacgtgaagacgcggacaaacgactgggattttgtggtcaccaccgacatttccgagatgggggccaatttcaaagccgagcgcgttatcgatccgagacggtgtatgaagcccgtgatccttacagacggagaagagagagtgattctggctggccctatgcccgtcacccatagctctgccgcgcagcgccgggggagaatcggccgcaaccctaagaatgaaaacgaccagtatatttacatgggagagcccctcgaaaatgatgaggactgcgctcactggaaagaggccaagatgctgctggataacatcaatacaccggaaggcattatccctagcatgtttgagcccgaacgggagaaagtggacgccattgatggggaatatagactccgcggagaggctcggaagaccttcgttgaccttatgagacgcggcgatctgcctgtgtggctggcctacaaagtcgcggccgaggggatcaactatgctgacagacggtggtgttttgatggaatcaagaacaatcagattctcgaagagaacgtggaagttgagatctggacgaaggagggcgaacgcaaaaagctgaaacccagatggcttgacgcccggatttactccgatcctctggctctcaaggagttcaaagaatttgccgctgggcgcaagtctctgacactgaatctcatcaccgagatgggcagacttcccacattcatgacccaaaagacgcgggacgccctggataacctggcggtgctccacaccgccgaagctggaggcagagcctataatcatgctctgagcgagcttccggagacactggaaaccctcctgctgctcacacttctggccaccgtcacagggggaattttcctgtttctcatgtccggccgcgggatcggaaaaatgaccctgggcatgtgctgcatcattacggcctctatccttctgtggtacgctcagattcagcctcactggatcgcggccagcattatcctcgagttctttctgatcgtgctgctcattcccgaacccgagaagcagcggacacctcaagacaaccagcttacctacgtcgtgatcgctattctgaccgttgtggccgccacaatggctaatgaaatgggcttcctggagaaaaccaagaaagacctcgggctgggatccatcgccacacagcagccggagagcaacattcttgatatcgacctgagacccgcgtctgcctggacgctctatgctgtggccaccacatttgtcacccctatgctgcgccattccattgaaaatagctccgttaacgtgtctctgacagctatcgccaatcaagcgaccgtgctcatgggccttgggaagggatggcccctgagcaagatggatatcggcgtccctctgctcgccattgggtgttactcccaggtgaaccccatcacgctgaccgctgcccttctgctcctggttgctcactatgccattatcggacctggcctgcaggctaaagccacacgggaggcgcagaagagagccgctgccggcattatgaaaaatccgaccgtggacgggatcacagtcatcgatctcgaccccattccttacgatcccaagttcgaaaaacaacttggacaggtgatgctgctgatcctctgcgtcacccaggtgctgatgatgcggacgacatgggctctttgtgaggccctgaccctcgccacaggccctatttctaccctgtgggaagggaaccccggacgcttttggaataccacaatcgcggttagcatggctaacattttcagaggctcctatctggccggggctggactcctttttagcatcatgaagaatacgaccaacacacggcgcggcaccggcaacatcggggagacactgggagagaaatggaagtctagactgaatgccctcggcaagtccgagttccaaatttacaaaaagagcgggatccaggaggtggaccggaccctggccaaagaaggaattaagcgcggcgagacggatcaccatgctgtctctagagggtccgccaaacttcggtggtttgtggagcgcaacatggttacaccggaaggaaaggtggtcgacctgggctgcggcagagggggatggagctattactgtggcgggctcaagaatgtgcgggaggtgaaaggactgaccaagggcgggcctggacacgaagaacccatccccatgtctacctacggctggaacctggttagactccagagcggcgtcgatgtgttctttattcctcccgaaaaatgcgacacacttctgtgtgatatcggggagtcctctcctaatccgaccgtggaggcgggacgcacactgcgggtcctcaacctggttgaaaattggcttaacaataacacgcagttctgcatcaaggtgctgaatccctatatgcctagcgtgattgagaaaatggaagccctccaaagaaagtacggcggggctctggtccgcaaccccctgtcccggaatagcacccatgagatgtattgggtgtccaacgcctctggaaatatcgttagctccgtgaacatgatttctagaatgctcatcaaccgcttcacaatgcggcacaagaaagctacctacgaacctgacgtcgaccttggcagcgggacaagaaatattggaatcgagtccgagattcccaacctggatatcatcggcaagcgcattgagaagatcaagcaggagcatgaaacctcttggcactatgaccaggatcacccgtacaaaacgtgggcctatcatggcagctacgagaccaagcagacagggtccgcgagctctatggtgaatggagttgtgcggctgctcaccaagccttgggacgtcctgcccacagtgacccaaatggccatgacagataccacgccttttggccagcagagagtgttcaaagaaaaggtcgacacacgcacccaggagcccaaagaggggaccaagaaacttatgaagattacagctgaatggctgtggaaagagctcggaaagaagaaaacgcctcggatgtgtaccagagaagagtttacacgcaaggttagatccaacgccgctctgggcgccatcttcaccgatgagaataaatggaaaagcgctcgggaagccgtggaggactctcgcttttgggaactggtggataaagagagaaacctccacctggaagggaagtgcgagacatgtgtctacaatatgatgggaaagcgggagaagaaacttggcgagttcggcaaagcgaaagggtccagagccatttggtatatgtggctgggagctcggtttctcgagttcgaagccctgggctttcttaacgaggaccattggttcagccgcgaaaattctctgtccggggtggagggagagggcctccacaaactggggtacatcctgagagatgttagcaagaaggaaggcggagctatgtatgccgacgacaccgccggctgggatacacggatcaccctcgaggacctgaaaaacgaagagatggtgacgaatcacatggaaggggagcataagaaacttgcggaggctatttttaagctgacctaccaaaacaaagtcgtgcgcgttcagagacccacaccgcggggaaccgtgatggatatcatttcccgcagagaccagcggggcagcgggcaagtcggaacatatggcctcaataccttcacgaacatggaagcccagctgatccgccagatggagggggaaggcgtgtttaagacaattcagcaccttaccgttacagaggaggtggccgtccaaaattggctggctagagtgggacgggaacgcctctctagaatggccatcagcggcgatgactgcgtcgtgaagcctctggatgaccggttcgctaacgccctgaccgcgctcaacgatatggggaaaatccgcaaggacattcagcagtgggagccctccaaaggatggaatgattggacgcaggttcccttctgctctcatcactttcatgaactgatcatgaaggacggcagagtgcttgtcgtgccttgtcggaaccaagatgagctgattgggagagcccgcatcagccagggagctggctggtccctccgggaaaccgcctgcctggggaaatcttacgctcagatgtggagccttatgtatttccacagacgcgacctgcggctcgccgcgaatgccatttgttccgctgtgccgtctcactgggttcccacaagcagaaccacatggtccatccatgccaagcacgagtggatgaccacagaggacatgctgaccgtgtggaaccgcgtctggattcgggaaaatccttggatggaggataagacgcccgtggaaagctgggaggaaatcccttacctgggcaaaagagaggaccagtggtgcggatctctcatcggcctgacatcccgcgctacctgggccaagaacattcaagctgccatcaatcaggttcggagccttattgggaacgaggaatacaccgattatatgccctctatgaaaagatttcgccgggaggaagaggaagcgggagtgctgtggtga

SEQ ID NO: 20117 - RNA, 9876 nt, synthetic construct
  misc_feature 1..9876: note = derived and/or modified CDS sequence (opt5) from DENV-2__EU482670__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtgatgaaagagattgctgagacccagcacggaaccatcgtcattcgggtgcagtatgaaggcgatgggagcccctgcaagatccccttcgagatcatggacctcgagaagcggtacgttctgggacgcctgattacagtgaaccctatcgtcacggagaaggattctccggtgaacattgaagcggagcccccttttggcgactcctacatcattatcggggttgagcccggccagctcaagctgaattggttcaaaaagggaagctctattggccaaatgtttgaaaccacaatgagaggggccaaaagaatggctatccttggagataccgcctgggacttcggcagcctcgggggagtgtttacatccatcggcaaggccctccatcaggtcttcggggctatttatggcgccgcgttttctggagtgagctggaccatgaaaatcctgattggcgtgatcattacgtggatcgggatgaactcccgcagcacatctctgtccgttagccttgtcctcgtgggaatcgtgaccctgtacctgggcgtcatggtgcaggctgattctgggtgtgttgtgtcctggaagaataaggagctcaaatgcggaagcggcattttcatcaccgacaacgtccacacatggaccgaacagtataagtttcaacctgagtccccctctaaactggccagcgccattcagaaggctcaggaagaggggatctgtggcattcggtccgtgacaagacttgagaatctgatgtggaaacagatcacgccggaactcaaccacatcctggccgagaatgaagttaagctgaccattatgacaggagatatcaaaggcattatgcaagctgggaagcgctctcttcggcctcagcccaccgagctcaagtacagctggaaaacatggggaaaggccaaaatgctgtccaccgaaagccataaccagacgttcctgatcgacggccctgagaccgcggagtgccccaatacaaacagagcctggaactctctcgaagtggaggattatgggtttggagtcttcaccacaaacatttggctgaaacttaaagaaaagcaggacgctttttgtgactccaagctgatgagcgccgctatcaaagataatcgcgccgtgcacgcggacatgggctactggatcgagtctgccctcaacgatacctggaagattgagaaggctagcttcatcgaagttaagaattgccattggcctaaaagccacacactgtggtctaacggcgtgctggagagcgaaatgattatccccaagaaccttgccgggccggtctcccaacacaattatcggcctggataccatacccaggtggctggcccctggcacctcgggaagctggagatggacttcgatttttgtgacggaacgacagtgattgtcaccgaagattgcggcaacagagggcccagcctgcgcaccacaaccgcctctggaaaactcatcacggagtggtgctgtcggtcctgcacactgcctccgcttagataccggggcgaggacggctgttggtatgggatggaaattcgccccctgaaggagaaagaagagaatctcgttaacagcctggtgaccgccggacatggccaggtggataatttctccctgggggtccttggaatggctctctttctggaagagatgctgagaacacgggtgggcaccaagcacgcgatcctcctggttgccgtgtctttcgtcacacttatcaccgggaacatgagctttaaagacctgggaagagtggttgtgatggtcggcgctacgatggccgatgacattggcatgggggtgacctacctcgccctgctggctgccttcaaggttcgccctacatttgcggctggacttctgctccggaagctgacctccaaagagctcatgatgacaaccatcggcattgtgctgctttctcaaagcacgatccccgaaacagtcctggagctcaccgatgccctggccctggggatgatggtgcttaagattgtgagaaatatggaaaaatatcagctggctgtcacaatcatggccatcctctgcgttcctaacgcggtgattctgcagaatgcttggaaggtgtcctgtaccatcctcgccgtcgtgtctgttagccccctgcttctgacctccagccagcagaagacggactggattcctctcgccctgacgatcaagggactgaaccccaccgctattttccttacaaccctgtctcgcacaaataaaaagagatcctggccgctcaacgaggccatcatggctgtgggcatggtcagcatcctggcctcttccctcctgaagaatgacattcctatgaccgggccccttgtggcgggaggcctgctgacggtttgctacgtgctcacaggccggagcgccgatctggaacttgagcgcgctaccgacgtcaaatgggaggatcaggccgaaatctctgggtccagccctattctgtccatcaccattagcgaggacggatctatgagcatcaagaacgaagaggaggaacagacactcaccattctgatcagaacaggcctcctggtgatctccgggctttttcccatttctatcccgattacggctgccgcctggtatctgtgggaggtcaaaaagcagcgggctggagtgctgtgggatgttccttctccccctcccatgggcaaagcggaactcgaggacggggcctaccgcatcaagcaaaaggggattctgggctattcccagatcggcgctggggtgtacaaagaaggaaccttccatacaatgtggcacgtcaccagaggcgccgtgcttatgcacaaggggaaacggatcgagccctcctgggccgatgttaagaaagacctgattagctacggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccatcggcgcggtgtcccttgatttctctcctgggacaagcggatcccccattatcgacaagaaaggcaaggttgtcgggctgtatggaaacggcgtggtgaccagaagcggcgcttacgtctctgccattgcccaaacagagaagtccatcgaggataatcctgaaatcgaggacgatatttttcggaaacgcagactgaccatcatggacctccatcccggggctggaaagacaaaacggtatctgcctgccattgtgagagaagcgatcaagcgcggccttcggacgctgattctcgctccgaccagagttgtggccgccgagatggaagaggctctgcgcgggctccccatccggtaccagacccctgccattagagctgagcacaccggacgcgaaatcgtcgacctgatgtgtcatgccaccttcacaatgcggcttctgagccccgtgagagttcctaactataatctgatcattatggatgaggcgcacttcacggaccccgcctctatcgctgcccgcggctacatttccacccgggtggaaatgggggaggctgccggcatctttatgacagccaccccgcctggaagcagagatcccttcccccagtccaacgctcctattatcgacgaggaacgggagatccccgaacgctcttggaatagcggccatgagtgggtcacagattttaaagggaagaccgtgtggttcgttccttccattaaggcgggaaacgacatcgccgcttgcctccgcaaaaatggcaagaaagtgattcaactgagccggaagacgtttgattctgaatatgtcaaaacacgcaccaacgactgggatttcgtggtgaccacagacatctccgagatgggggccaattttaaggccgagagagtcattgatccgcggagatgtatgaaacccgttatccttaccgacggagaggaacgcgtgatcctggctggccctatgcccgtgacacacagctctgccgcgcagcggagagggcgcattggccggaaccctaagaatgaaaacgaccagtacatctacatgggagagcccctcgaaaatgatgaggactgcgctcactggaaggaggccaaaatgctgctggataacattaataccccggaaggcatcattcctagcatgttcgagcccgaaagagagaaggtcgacgccatcgatggggaatatcgcctccggggagaggctagaaaaacgtttgtggaccttatgcgcagaggcgatctgcctgtttggctggcctacaaggtggcggccgaggggattaactatgctgaccggcgctggtgtttcgatggaatcaaaaacaatcagatcctcgaagagaacgtcgaagtggagatttggacaaaggagggcgaaagaaagaaactgaagccccggtggcttgacgcccgcatctactccgatcctctggctctcaaagagtttaaggagttcgccgctgggagaaaatctctgaccctgaatctcattacagagatgggccggcttcccaccttcatgacgcaaaagaccagagacgccctggataacctggcggttctccatacagccgaagctggaggccgcgcctataatcacgctctgagcgagcttccggagaccctggaaacactcctgctgctcacccttctggccacagtgaccgggggaatctttctgttcctcatgtccggccgggggattggaaagatgacgctgggcatgtgctgcatcatcacagcctctattcttctgtggtacgctcagatccagcctcattggattgcggccagcatcattctcgagtttttcctgatcgtcctgctcatccccgaacccgagaaacagagaacccctcaagacaaccagcttacctatgtggtcattgctatcctgacagtggttgccgccaccatggctaatgaaatgggctttctggagaagaccaagaaggacctcgggctgggatccattgccacgcagcagccggagagcaacatccttgatattgacctgcgccccgcgtctgcctggaccctctacgctgtggccacaaccttcgtgacacctatgctgcggcactccatcgaaaatagctccgtcaacgtttctctgaccgctattgccaatcaagcgacggtgctcatgggccttgggaaaggatggcccctgagcaagatggatatcggcgtgcctctgctcgccatcgggtgttactcccaggtcaaccccattaccctgacagctgcccttctgctcctggtggctcactatgccatcattggacctggcctgcaggctaaggccaccagagaggcgcagaaacgggccgctgccggcatcatgaagaatccgacagttgacgggattaccgtgatcgatctcgaccccatcccttacgatcccaaatttgaaaagcaacttggacaggtcatgctgctgattctctgcgtgacgcaggtcctgatgatgcgcacaacctgggctctttgtgaggccctgacactcgccaccggccctatctctaccctgtgggaagggaaccccggaagattctggaatacaacgattgcggtgagcatggctaacatctttcggggctcctatctggccggggctggactccttttcagcattatgaaaaataccacaaacacccgcagaggcacaggcaacatgggggagaccctgggagagaagtggaaatctcggctgaatgccctcggcaagtccgaatttcaaatctacaagaaaagcgggatccaggaggttgaccgcacgctggccaaggaaggaattaaaagaggcgagacagatcatcacgctgtgtctcgggggtccgccaaacttcgctggttcgtcgagagaaacatggtgaccccggaaggaaaagttgtggacctgggctgcggccggggaggatggagctattactgtggcgggctcaagaatgtcagagaggtgaagggactgaccaaaggcgggcctggacatgaagaacccatccccatgtctacatatggctggaacctggtgcgcctccagagcggcgttgatgtctttttcattcctcccgaaaagtgcgacacccttctgtgtgatatcggggagtcctctcctaatccgacagtggaggcgggacggacgctgagagtgctcaacctggtcgaaaattggcttaacaataacacccagttctgcattaaagttctgaatccctacatgcctagcgtgatcgagaagatggaagccctccaacgcaaatacggcggggctctggtgcggaaccccctgtccagaaatagcacacacgagatgtattgggtctccaacgcctctggaaatatcgtgagctccgttaacatgatttctcgcatgctcatcaaccggtttaccatgagacataagaaggctacatacgaacctgacgtggaccttggcagcgggacccgcaatattggaatcgagtccgagattcccaacctggatatcattggcaaacggatcgaaaagatcaaacaggagcacgaaacgtcttggcactatgaccaggatcatccgtacaagacctgggcctatcacggcagctacgagacaaaacagaccgggtccgcgagctctatggtcaatggagtggttagactgctcacaaagccttgggacgtgctgcccaccgtcacacaaatggccatgaccgatacgacacctttcggccagcagcgcgtgtttaaggaaaaagtggacacccggacccaggagcccaaggaggggaccaagaaacttatgaaaattacggctgaatggctgtggaaggagctcggcaaaaagaagacccctagaatgtgtacacgcgaagagttcaccagaaaagtccggtccaacgccgctctgggcgccatctttacagatgagaataagtggaaaagcgctcgcgaagccgttgaggactctagattctgggaactggtggataaggagcggaacctccatctggaagggaaatgcgagacctgtgtgtataatatgatgggaaagagagagaagaaacttggcgaatttggcaaggcgaaagggtcccgggccatttggtacatgtggctgggagctcgcttcctcgagtttgaagccctgggcttccttaacgaggaccactggtttagcagagaaaattctctgtccggggtcgagggagagggcctccacaagctggggtacatcctgcgggatgtgagcaaaaaggaaggcggagctatgtatgccgacgacacagccggctgggatacccgcattacgctcgaggacctgaagaacgaagagatggttaccaatcatatggaaggggagcacaagaaacttgcggaggctatcttcaaactgacataccaaaacaaagtggtcagagtgcagcggcccaccccgcgcggaacagttatggatatcatttccagacgggaccagcgcggcagcgggcaagtgggaacctatggcctcaatacgtttacaaacatggaagcccagctgatcagacagatggagggggaaggcgtcttcaaaaatattcagcatcttaccgtgacagaggaggttgccgtgcaaaactggctggctcgggtcggacgcgaaagactctctcggatggccatcagcggcgatgactgcgtggtcaagcctctggatgaccgcttcgctaacgccctgaccgcgctcaatgatatggggaagattagaaaagacatccagcagtgggagccctccaagggatggaacgattggacacaggtgcccttttgctctcaccatttccacgaactgatcatgaaagacggccggattcttgttgtgccttgtagaaatcaagatgagctgatcgggcgcgcccggattagccagggagctggctggtccctcagagaaaccgcctgcctggggaagtcttacgctcagatgtggagccttatgtattttcaccgccgggacctgagactcgccgcgaacgccatctgttccgctgtcccgtctcattgggtgcccacaagccgcaccacatggtccattcacgccaaacatgagtggatgaccacagaggacatgctgaccgtgtggaatcgggtttggatcagagaaaacccttggatggaggataagacgcccgtggaaagctgggaggaaattccttacctgggcaagcgcgaggaccagtggtgcggatctctcatcggcctgacatcccgggctacctgggccaaaaatatccaagctgccattaaccaggtcagaagccttatcgggaatgaggaatataccgattacatgccctctatgaagcgcttccggagagaggaagaggaagcgggagtgctgtggtga

SEQ ID NO: 20118 - RNA, 9876 nt, synthetic construct
  misc_feature 1..9876: note = derived and/or modified CDS sequence (opt5) from DENV-2__EU482671__SS-prME
  source 1..9876: mol_type = other RNA
agcgccggaatgatcattatgctgatccccaccgtgatggctttccacctgacgacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttatttgcaagcatagcatggtggatcgcggctggggcaatgggtgtggactgttcggcaaagggggaatcgtgacctgcgctatgtttacatgcaagaaaaacatggaaggcaagattgtccagcctgagaatctcgaatacacgatcgttgtgacaccccactctggggaggagcatgccgtgggaaacgacacaggcaaacacggcaaggaaatcaaagtcacccctcagtccagcattacagaggcggaactgaccgggtatggaacggtgaccatggagtgttctcccagaacaggccttgatttcaatgaaatggttctgctccaaatggagaacaaggcctggctggtgcaccggcagtggtttcttgacctgccgctcccttggctgcccggggctgataagcaggagtccaattggatccagaaagaaaccctggtcacattcaagaaccctcatgccaaaaagcaagacgtggttgtgctcggaagccaggagggcgctatgcacaccgccctgacgggggccacagaaattcagatgtcctctggcaatcttctgtttaccggacatctcaaatgccgcctgagaatggacaaacttcaactgaagggcatgagctactccatgtgtacagggaaattcaaggtcgtgcgggagatcgctgagacccagcacggaaccattgtcatcagagtgcagtatgaaggcgatgggagcccctgcaaaatccccttcgagattatggacctcgaaaagcgctacgttctgggacggctgatcacagtgaaccctattgtcacggagaaagattctccggtgaacatcgaagcggagcccccttttggcgactcctacattatcattggggttgagcccggccagctcaagctgaattggttcaagaaaggaagctctatcggccaaatgtttgaaaccacaatgagaggggccaagcgcatggctatccttggagataccgcctgggacttcggcagcctcgggggagtgtttacatccattggcaaagccctccatcaggtcttcggggctatctatggcgccgcgttttctggagtgagctggaccatgaagattctgatcggcgtgattatcacgtggatcgggatgaactcccggagcacatctctgtccgttagccttgtcctcgtgggaattgtgaccctgtacctgggcgtcatggtgcaggctgattctgggtgtgttgtgtcctggaaaaataaggagctcaagtgcggaagcggcatcttcattaccgacaacgtccacacatggaccgaacagtataaatttcaacctgagtccccctctaagctggccagcgccatccagaaagctcaggaagaggggatttgtggcatcagatccgtgacacgccttgagaatctgatgtggaagcagatcacgccggaactcaaccacattctggccgagaatgaagttaaactgaccatcatgacaggagatattaagggcatcatgcaagctgggaaacggtctcttagacctcagcccaccgagctcaagtacagctggaagacatggggaaaagccaagatgctgtccaccgaaagctataaccagacgttcctgattgacggccctgagaccgcggagtgccccaatacaaaccgcgcctggaactctctcgaagtggaggattacgggtttggagtcttcaccacaaacatctggctgaaacttaaggaaaaacaggacgctttttgtgactccaagctgatgagcgccgctatcaaggataatcgggccgtgcatgcggacatgggctattggattgagtctgccctcaacgatacctggaaaatcgagaaggcttccttcattgaagttaaaaattgccactggcctaagagccatacactgtggtctaacggcgtgctggagagcgaaatgatcattcccaaaaaccttgccgggccggtctcccaacacaattacagacctggataccacacccagatcgctggcccctggcatctcgggaagctggagatggacttcgatttttgtgacggaacgacagtgattgtgaccgaagattgcggcaaccgcgggcccagcctgcggaccacaaccgcctctggaaagctcatcacggagtggtgctgtagatcctgcacactgcctccgcttcggtatcgcggcgaggacggctgttggtacgggatggaaatcagacccctgaaagagaaggaagagaatctcgtcaacagcctggttaccgccggacacggccaggtggataatttctccctgggggtgcttggaatggctctctttctggaagagatgctgcggacaagagtcggcaccaaacatgcgattctcctggtggccgtttctttcgtgacacttatcaccgggaacatgagctttaaggacctgggacgcgtcgtggttatggtgggcgctacgatggccgatgacattggcatgggggtcacctatctcgccctgctggctgccttcaaagtgcggcctacatttgcggctggacttctgctcagaaagctgacctccaaggagctcatgatgacaaccatcggcattgttctgctttctcaaagcacgatccccgaaacagtgctggagctcaccgatgccctggccctggggatgatggtccttaaaatcgtgcgcaatatggaaaagtaccagctggctgtgacaattatggccatcctctgcgtccctaacgcggttattctgcagaatgcttggaaagtgtcctgtaccatcctcgccgtggtctctgtgagccccctgcttctgacctccagccagcaaaagacagactggattcctctcgccctgacgatcaaaggactgaaccccaccgctatcttccttacaaccctgtctagaacaaataagaaacggtcctggccgctcaacgaggccattatggctgttggcatggtgagcatcctggcctcttccctcctgaagaatgacattcctatgaccgggccccttgtcgcgggaggcctgctgacggtgtgctatgttctcacaggccgcagcgccgatctggaacttgagagagctaccgacgtgaagtgggaggatcaggccgaaatctctgggtccagccctattctgtccatcaccattagcgaggacggatctatgagcatcaaaaacgaagaggaggaacagacactcaccatcctgattcggacaggcctcctggtcatctccgggctttttcccatttctatcccgattacggctgccgcctggtacctgtgggaggtgaagaaacagcgcgctggagtcctgtgggatgtgccttctccccctcccatgggcaaggcggaactcgaggacggggcctatagaatcaaacaaaagggaatcctgggctactcccagattggcgctggggtttacaaggaaggaaccttccacacaatgtggcatgtgacccggggcgccgtccttatgcacaaagggaagcgcatcgagccctcctgggccgatgtgaaaaaggacctgattagctatggaggcgggtggaaactcgagggagaatggaaggagggcgaagaggttcaggtgctggctctcgaacctggcaagaatccgagagccgtccagacaaaacccgggctgtttaagaccaacacgggaaccatcggcgcggtgtcccttgatttctctcctgggacaagcggatcccccattatcgacaaaaagggcaaagtggttgggctgtacggaaacggcgtcgtgacccggagcggcgcttatgtgtctgccatcgcccaaacagagaagtccattgaggataatcctgaaatcgaggacgatatttttcgcaagagacggctgaccatcatggacctccaccccggggctggaaaaacaaagagatacctgcctgccattgtccgcgaagcgatcaaacggggccttagaacgctgattctcgctccgacccgcgtggttgccgccgagatggaagaggctctgcgggggctccccatcagatatcagacccctgccatccgcgctgagcataccggacgggaaattgtggacctgatgtgtcacgccaccttcacaatgagacttctgagccccgtccgcgtgcctaactacaatctgatcattatggatgaggcgcatttcacggaccccgcctctatcgctgcccggggctatatttccaccagagttgaaatgggggaggctgccggcatctttatgacagccaccccgcctggaagccgggatcccttcccccagtccaacgctcctatcattgacgaggaacgcgagatccccgaaagatcttggaatagcggccacgagtgggtgacagattttaaggggaaaaccgtctggttcgtgccttccattaaggcgggaaacgacatcgccgcttgcctccggaagaatggcaaaaaggttattcaactgagccgcaaaacgtttgattctgaatacgtgaagacaagaaccaacgactgggatttcgtcgtgaccacagacatctccgagatgggggccaattttaaagccgagcgggtgatcgatccgagacgctgtatgaagcccgtcattcttaccgacggagaggaacgggttatcctggctggccctatgcccgtgacacatagctctgccgcgcagagacgcgggcggattggcagaaaccctaaaaatgaaaacgaccagtacatctatatgggagagcccctcgaaaatgatgaggactgcgctcactggaaggaggccaagatgctgctggataacattaataccccggaaggcatcattcctagcatgttcgagcccgaacgcgagaaagtggacgccatcgatggggaataccggctcagaggagaggctcgcaagacgtttgtcgaccttatgagacggggcgatctgcctgtgtggctggcctataaagttgcggccgaggggatcaactacgctgaccgcagatggtgtttcgatggaattaagaacaatcagatcctcgaagagaacgtggaagtcgagatttggacaaaagagggcgaacggaagaagctgaaaccccgctggcttgacgccagaatctattccgatcctctggctctcaaggagtttaaagagttcgccgctgggcggaagtctctgaccctgaatctcattacagagatgggcagacttcccaccttcatgacgcagaagacacgcgacgccctggataacctggcggtgctccacacagccgaagctggaggccgggcctacaatcatgctctgagcgagcttccggagaccctggaaacactcctgctgctcacccttctggccacagttaccgggggaatctttctgttcctcatgtccggcagagggatcggaaagatgacgctgggcatgtgctgcattatcacagcctctattcttctgtggtatgctcagatccagcctcactggattgcggccagcatcatcctcgagtttttcctgattgtgctgctcatccccgaacccgagaagcagcgcacccctcaagacaaccagcttacctacgtcgtgattgctatcctgacagtcgtggccgccaccatggctaatgaaatgggctttctggagaaaacaaagaaagacctcgggctgggatccattgccacgcagcagccggagagcaacatccttgatattgacctgcggcccgcgtctgcctggaccctctacgctgttgccacaaccttcgtgacacctatgctgagacattccatcgaaaatagctccgtgaacgtctctctgaccgctatcgccaatcaagcgacggttctcatgggccttgggaagggatggcccctgagcaaaatggatattggcgtgcctctgctcgccatcgggtgttattcccaggtgaaccccattaccctgacagctgcccttctgctcctggtcgctcactacgccatcattggacctggcctgcaggctaaggccacccgggaggcgcagaagcgcgccgctgccggcatcatgaaaaatccgacagtggacgggatcaccgttattgatctcgaccccatcccttatgatcccaagtttgaaaaacaacttggacaggtgatgctgctgattctctgcgtcacacaggtgctgatgatgagaacaacctgggctctttgtgaggccctgacactcgccaccggccctatctctaccctgtgggaagggaaccccggacggttctggaatacaacgattgcggtcagcatggctaacatctttcgcggctcctacctggccggggctggactccttttcagcatcatgaagaataccacaaacaccagacggggcacaggcaacatgggggagaccctgggagagaaatggaagtctcgcctgaatgccctcggcaaatccgaatttcaaatttataagagaagcgggatccaggaggtggaccggacgctggccaaggaaggaattaaacgcggcgagacagatcaccatgctgtttctagagggtccgccaaacttcggtggttcgtggagagaaacatggtcaccccggaaggaaaagtggttgacctgggctgcggccgcgggggatggagctactattgtggcgggctcaagaatgtgcgggaggtcaaaggactgaccaagggcgggcctggacacgaggaacccatccccatgtctacatacggctggaacctggtgagactccagagcggcgtggatgtctttttcattcctcccgaaaagtgcgacacccttctgtgtgatatcggggagtcctctcctaatccgacagtcgaggcgggacgcacgctgcgggtgctcaacctggtggaaaattggcttaacaataacacccagttctgcatcaaagtcctgaatccctacatgcctagcgttattgagaagatggaagccctccaaagaaaatatggcggggctctggtgcgcaaccccctgtcccggaatagcacacatgagatgtactgggtgtccaacgcctctggaaatatcgtcagctccgtgaacatgatttctagaatgctcatcaaccgctttaccatgcggcacaagaaagctacatatgaacctgacgttgaccttggcagcgggaccagaaatattggaatcgagtccgagattcccaacctggatatcatcggcaagcgcattgaaaagatcaaacaggagcatgaaacgtcttggcactacgaccaggatcacccgtataagacctgggcctaccatggcagctatgagacaaaacagaccgggtccgcgagctctatggtgaatggagtcgtgcggctgctcacaaagccttgggacgttctgcccaccgtgacacaaatggccatgaccgatacgacacctttcggccagcagagagtctttaaagaaaaggtggacacccgcacccaggagcccaaggaggggaccaagaaacttatgaaaattacggctgaatggctgtggaaggagctcggcaagaagaaaacccctagaatgtgtacacgggaagagttcacccgcaaggtgagatccaacgccgctctgggcgccatctttacagatgagaataagtggaaaagcgctcgggaagccgtcgaggactctagattctgggaactggttgataaggagcggaacctccacctggaagggaaatgcgagacctgtgtgtacaatatgatgggaaagcgcgagaagaaacttggcgaatttggcaaagcgaaagggtccagagccatttggtacatgtggctgggagctcggttcctcgagtttgaagccctgggcttccttaacgaggaccattggtttagccgcgaaaattctctgtccggggtggagggagagggcctccacaagctggggtatatcctgagagatgtcagcaaaaaggaaggcggagctatgtacgccgacgacacagccggctgggatacccggatcacgctcgaggacctgaaaaacgaagagatggtgaccaatcacatggaaggggagcataagaaacttgcggaggctattttcaaactgacatatcaaaacaaggttgtgcgcgtccagagacccaccccgcggggaacagtgatggatatcatttcccgcagagaccagcggggcagcgggcaagttggaacctacggcctcaatacgtttacaaacatggaagcccagctgatccgccagatggagggggaaggcgtgttcaaaaatattcagcaccttaccgtcacagaggaggtggccgttcaaaactggctggctagagtgggacgggaacgcctctctagaatggccatcagcggcgatgactgcgtcgtgaagcctctggatgaccggttcgctaacgccctgaccgcgctcaatgatatggggaaaatcagaaaggacattcagcagtgggagccctccaagggatggaacgattggacgcaggtccccttttgctctcatcacttccatgaactgatcatgaaagacggccgcgtgcttgttgtgccttgtcggaatcaagatgagctgattgggagagcccgcatcagccagggagctggctggtccctccgggaaaccgcctgcctggggaagtcttatgctcagatgtggagccttatgtactttcacagacgcgacctgcggctcgccgcgaacgccatttgttccgctgtcccgtctcactgggtgcccacaagcagaaccacatggtccatccatgccaaacacgagtggatgaccacagaggacatgctgaccgtgtggaatcgcgtttggattcgggaaaacccttggatggaggataagacgcccgtggaaagctgggaggaaatcccttatctgggcaaaagagaggaccagtggtgcggatctctcatcggcctgacatcccgcgctacctgggccaagaatattcaagctgccatcaaccaggtccggagccttattgggaatgaggaatacaccgattacatgccctctatgaagagattccggagagaggaagaggaagcgggagtgctgtggtga

SEQ ID NO: 20119 - RNA, 9876 nt, synthetic construct
  misc_feature 1..9876: note = derived and/or modified CDS sequence (opt5) from DENV-2__EU482674__SS-prME
  source 1..9876: mol_type = other RNA
agcgccggaatgatcattatgctgatccccaccgtgatggctttccacctcacgacgagaaatggggagcctcatatgattgtctccatccaggaaaagggaaaatctctgctttttaagaccgaggacggcgttaatatgtgcacactgatggccatggatctcggggaactgtgtgaggacaccattacatacaaatgcccgcttctgcggcaaaacgaacccgaggatatcgactgttggtgcaattccacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgttctgattttcatccttctgacagctgtggccccttctatgacgatgagatgcattggaatcagcaaccgggattttgtcgaaggcgtgtccgggggaagctgggttgacatcgtgctcgagcacggctcttgtgtcaccacaatggcgaagaataagcccaccctggatttcgaacttattaaaacagaggccaagcagcctgctaccctgcgcaaatattgcatcgaagccaagctcacgaacacaaccaccgagtccagatgtccgacacaaggggagcccagcctgaaagaagaacaagacaagcggtttgtgtgcaagcattctatggtggatcgcggatggggcaatggctgtgggctgttcggaaaaggcgggattgtcacatgcgctatgtttacatgcaagaaaaacatggaaggaaagatcgttcagcctgagaatctcgaatacacgattgtggtgacaccccactccggcgaggagcatgccgtcgggaacgacacaggaaaacacggcaaggaaatcaaagtgacccctcagagctctatcacagaggcggaactgaccggctatgggacggttaccatggagtgttcccccagaacaggacttgatttcaatgaaatggtgctgctccaaatggagaacaaggcctggctggtccaccggcagtggtttcttgacctgccgctcccttggctgcccggcgctgataagcaggagagcaattggattcagaaagaaaccctggtgacattcaagaaccctcatgccaaaaagcaagacgttgtggtcctcgggtcccaggagggagctatgcacaccgccctgacgggcgccacagaaatccagatgtctagcgggaatcttctgtttaccggccatctcaaatgccgcctgagaatggacaaacttcaactgaagggaatgtcctacagcatgtgtacaggcaaattcaaggtggtcaaagagattgctgagacccagcacgggaccatcgtgattcgggttcagtatgaaggagatggctctccctgcaagatccccttcgagatcatggacctcgagaagagatacgtgctggggcgcctgattacagtcaaccctatcgtgacggagaaggattccccggttaacattgaagcggagcccccttttggagacagctacatcattatcggcgtggagcccgggcagctcaagctgaattggttcaaaaagggctctagcattggacaaatgtttgaaaccacaatgcggggcgccaaaagaatggctatccttggggataccgcctgggacttcggatccctgggcggggtctttacatctatcggaaaggccctccatcaggtgttcggcgctatttatggggccgcgtttagcggcgtgtcctggaccatgaaaatcctgattggagttatcattacgtggatcggcatgaacagccgctctacatccctgagcgtctctcttgtgctcgtggggatcgtcaccctgtacctgggagtgatggttcaggctgattccggctgtgtggtcagctggaagaataaggagctcaaatgcgggtccggaattttcatcaccgacaacgtgcacacatggaccgaacagtataagtttcaacctgagtctcccagcaaactggcctccgccattcagaaggctcaggaagagggcatctgtgggattcggtctgttacaagacttgagaatctgatgtggaaacagatcacgccggaactcaaccacatcctggccgagaatgaagtgaagctgaccattatgacaggcgatatccgcggaattatgcaagctggcaaacggagccttagacctcagcccaccgagctcaagtactcctggaagacatgggggaaagccaagatgctgagcaccgaatcttataaccagacgttcctgatcgacggacctgagaccgcggagtgccccaatacaaaccgcgcctggaactccctcgaagtcgaggattacggctttggggtgttcaccacaaacatttggctgaaacttaaggaaaaacaggacgctttttgtgacagcaagctgatgtctgccgctatcaaggataatcgggccgttcatgcggacatgggatattggatcgagtccgccctcaacgatacctggaaaattgagaaggctagcttcatcgaagtgaaaaattgccactggcctaagtctcatacactgtggagcaacggcgtcctggagtccgaaatgattatccccaaaaaccttgccggcccggtgagccaacacaattacagacctgggtaccacacccagattgctggaccctggcatctcggcaagctggagatggacttcgatttttgtgacgggacgacagtgatcgtcaccgaagattgcggaaaccgcggcccctctctgcggaccacaaccgcctccgggaagctcattacggagtggtgctgtagaagctgcacactgcctccgcttcggtatcgcggagaggacggctgttggtacggcatggaaatcagacccctgaaagagaaggaagagaatctcgttaactccctggtgaccgccgggcacggacaggtggataatttctctctgggcgtccttgggatggctctctttctggaagagatgctgcggacaagagtgggaaccaaacatgcgatcctcctggttgccgtgagcttcgtcacacttattaccggcaacatgtcctttaaggacctggggcgcgtggttgtgatggtcggagctacgatggccgatgacatcggcatgggcgtgacctatctcgccctgctggctgccttcaaagttcggcctacatttgcggctgggcttctgctcagaaagctgacctctaaggagctcatgatgacaaccattggaatcgtgctgcttagccaatccacgattcccgaaacagtcctggagctcaccgatgccctggccctgggcatgatggtgcttaaaatcgtgcgcaatatggaaaagtaccagctggctgtcacaatcatggccattctctgcgttcctaacgcggtgatcctgcagaatgcttggaaagtgtcttgtaccattctcgccgtcgtgagcgttagccccctgcttctgaccagctctcagcaaaagacagactggatccctctcgccctgacgattaaagggctgaaccccaccgctatcttccttacaaccctgtccagaacaaataagaaacggagctggccgctcaacgaggccatcatggctgtgggaatggtctctattctggcctccagcctcctgaagaatgacatccctatgaccggcccccttgtggccgggggactgctgacggtttgctatgtgctcacaggccgctctgccgatctggaacttgagagagctaccgacgtcaagtgggaggatcaggccgaaatttccggcagctcccctatcctgagcattaccatctctgaggacgggagcatgtccattaaaaacgaagaggaggaacagacactcaccatcctgatccggacaggactcctggtgatttctggcctttttcccatcagcattccgatcacggctgccgcctggtacctgtgggaggtcaagaaacagcgcgctggggtgctgtgggatgttccttctccccctcccatgggaaaggcggaactcgaggacggcgcctatagaattaaacaaaaggggatcctgggacacagccagatcggcgctggcgtgtacaaggaagggaccttccatacaatgtggcacgtcacccggggagccgtgcttatgcacaaaggcaagcgcattgagcccagctgggccgatgttaaaaaggacctgatctcctacgggggaggctggaaactcgagggggaatggaaggagggagaagaggtgcaggtcctggctctcgaacctggcaagaatccgagagccgtgcagacaaaacccggcctgtttaagaccaacacggggaccattggagcggtgtctcttgatttcagccctggcacatccgggagccccatcattgacaaaaagggaaaagttgtcggcctgtatgggaacggagtggtgacccggtctggcgcttacgtctccgccatcgcccaaacagagaagaatatcgaggataaccctgaaattgaggacgatatctttcgcaagagacggctgaccattatggacctccatcccggcgctgggaaaacaaagagatatctgcctgccatcgtgcgcgaagcgattaaacggggacttagaacgctgatcctcgctccgacccgcgttgtggccgccgagatggaagaggctctgcggggcctccccattagataccagacccctgcgatccgcgctgagcacaccgggcgggaaatcgtcgacctgatgtgtcatgccaccttcacaatgagacttctgagccccgtgcgcgttcctaattataacctgattatcatggatgaggcgcacttcacggaccccgcctctattgctgcccggggatacatctccaccagagtggaaatgggcgaggctgccgggatttttatgacagccaccccgcctggcagccgggatcccttcccccagtccaatgctcctatcatcgacgaggaacgcgagattcccgaaagatcttggaacagcggacatgagtgggtcacagattttaagggcaaaaccgtgtggttcgttccttccatcaaggcggggaatgacattgccgcttgcctccggaagaacggcaagaaggtgatccaactgagccgcaaaacgtttgattctgaatatgtcaagacaagaaccaatgactgggatttcgtggtgaccacagacatttccgagatgggcgccaactttaaagccgagcgggtcatcgatccgagacgctgtatgaagcccgttatccttaccgacggggaagaacgggtgattctggctggacctatgcccgtgacacacagctctgccgcgcagagacgcggccggatcgggagaaatcctaaaaacgaaaatgaccagtacatttacatgggcgagcccctcgaaaacgatgaggactgcgctcactggaaggaggccaagatgctgctggataatatcaacaccccggaaggaattatccctagcatgttcgagcccgaacgcgagaaagtcgacgccattgatggcgaatatcggctcagaggggaggctcgcaagacgtttgtggaccttatgagacggggagatctgcctgtttggctggcctacaaagtggcggccgagggcatcaactatgctgaccgcagatggtgtttcgatgggatcaagaataaccagattctcgaagagaatgtcgaagtggagatctggacaaaagagggagaacggaagaagctgaaaccccgctggcttgacgccagaatttactccgatcctctggctctcaaggagtttaaagagttcgccgctggccggaagtctctgaccctgaacctcatcacagagatggggagacttcccaccttcatgacgcagaagacccgcgacgccctggataatctggcggttctccatacagccgaagctggcggacgggcctataaccacgctctgagcgagcttccggagaccctggaaacactcctgctgctcacccttctggccacagtgaccggcgggatttttctgttcctcatgtccggaagaggcatcgggaagatgacgctgggaatgtgctgcatcattacagcctctatccttctgtggtacgctcagattcagcctcattggatcgcggccagcattatcctcgagtttttcctgatcgtcctgctcattcccgaacccgagaagcagcgcacccctcaagacaatcagcttacctatgtggtcatcgctattctgacagtggttgccgccaccatggctaacgaaatgggctttctggagaaaacaaagaaagacctcggcctggggtccatcgccacgcagcagccggagagcaatattcttgatatcgacctgcggcccgcgtctgcctggaccctctacgctgtggccacaaccttcgtgacacctatgctgagacactccattgaaaacagctccgtcaatgtttctctgaccgctatcgccaaccaagcgacggtgctcatgggacttggcaaggggtggcccctgagcaaaatggatatcggagtgcctctgctcgccattggctgttactcccaggtcaatcccatcaccctgacagctgcccttctgctcctggtggctcactatgccattatcgggcctggactgcaggctaaggccacccgggaggcgcagaagcgcgccgctgccggcattatgaaaaacccgacagttgacggcatcaccgtgatcgatctcgaccccattccttacgatcccaagtttgaaaaacaacttgggcaggtcatgctgctgatcctctgcgtgacgcaggtcctgatgatgagaacaacctgggctctttgtgaggccctgacactcgccaccggacctatttctaccctgtgggaaggcaatcccgggcggttctggaacacaacgatcgcggtgagcatggctaatatttttcgcggatcctatctggccggcgctgggctccttttcagcatcatgaagaacaccacaaacaccagacggggaacaggcaatatcggcgagaccctgggggagaaatggaagtctcgcctgaacgccctcggaaaatccgaatttcaaatttacaagaagtccggcatccaggaggttgacagaacgctggccaaagaagggattaagcggggagagacagatcatcacgctgtgtctcgcggctccgccaaacttagatggttcgtcgagcggaatatggtgaccccggaagggaaggttgtggacctgggatgcggcagaggcgggtggagctattactgtggaggcctcaaaaacgtccgcgaggtgaaggggctgaccaagggaggccctgggcatgaggaacccatccccatgtctacatatggatggaatctggtgcggctccagagcggcgttgatgtctttttcattcctcccgaaaaatgcgacacccttctgtgtgatatcggcgagtcctctcctaacccgacagtggaggcggggagaacgctgcgcgtgctcaatctggtcgaaaactggcttaataacaatacccagttctgcatcaaggttctgaacccctacatgcctagcgtgattgagaaaatggaagccctccaacggaagtacggaggcgctctggtgagaaatcccctgtcccgcaacagcacacacgagatgtattgggtctccaatgcctctgggaacatcgtgagctccgttaacatgatttctcggatgctcatcaatagatttaccatgcgccataaaaaggctacatacgaacctgacgtggaccttggaagcggcacccggaacattgggatcgagtccgagaagcccaatctggatattatcggaaaaagaatcgaaaagattaaacaggagcacgaaacgtcttggcactatgaccaggatcatccgtacaagacctgggcctatcacggcagctacgagacaaaacagaccggctccgcgagctctatggtcaacggggtggttcgcctgctcacaaagccttgggacgtgctgcccaccgtcacacaaatggccatgaccgatacgacacctttcggacagcagcgggtgtttaaggaaaaagtggacaccagaacccaggagcccaaggagggcaccaagaaacttatgaaaatcacggctgaatggctgtggaaagagctcgggaaaaagaagacccctcgcatgtgtacaagagaagagttcacccggaaagtccgctccaatgccgctctgggagccatttttacagatgagaacaagtggaaaagcgctagagaagccgttgaggactctcggttctgggaactggtggataaggagagaaatctccatctggaaggcaaatgcgagacctgtgtgtataacatgatggggaagcgggagaagaaacttggagaatttggcaaggcgaaaggctcccgcgccatctggtacatgtggctgggggctagattcctcgagtttgaagccctgggattccttaatgaggaccactggtttagccgggaaaactctctgtccggcgtcgagggggagggactccacaagctgggctacattctgcgcgatgtgagcaaaaaggaagggggcgctatgtatgccgacgacacagccggatgggataccagaatcacgctcgaggacctgaagaatgaagagatggttaccaaccatatggaaggcgagcacaagaaacttgcggaggctatcttcaaactgacataccaaaataaagtggtccgggtgcagcgccccaccccgagagggacagttatggatattatctcccggcgcgaccagagaggaagcggccaagtggggacctatggactcaacacgtttacaaatatggaagcccagctgattcggcagatggagggcgaaggggtcttcaaaaacatccagcatcttaccgtgacagaggaggttgccgtgcacaactggctggctcgcgtcggcagagaacggctctctcgcatggccattagcggagatgactgcgtggtcaagcctctggatgacagattcgctaatgccctgaccgcgctcaacgatatgggcaagatccggaaagacatccaacagtgggagccctccaaggggtggaatgattggacacaggtgcccttttgctctcatcacttccacgaactgattatgaaagacggaagagttcttgtggtcccttgtcgcaaccaggatgagctgatcggccgggccagaattagccaaggggctggatggtccctccgcgaaaccgcctgcctgggcaagtcttacgctcagatgtggagccttatgtattttcatcggagagacctgcgcctcgccgcgaatgccatctgttccgctgtgccgtctcactgggtgcccacaagccggaccacatggtccattcatgccaaacacgagtggatgaccacagaggacatgctgaccgtttggaacagagtgtggatccgcgaaaatccttggatggaggataagacgcccgtcgaaagctgggaggaaattccttacctggggaagcgggaggaccagtggtgcggctctctcatcggactgacatccagagctacctgggccaaaaacatccaggctgccattaatcaagtgcgcagccttatcggcaacgaggaatataccgattacatgccctctatgaagcggttcagacgggaggaagaggaagcgggggttctgtggtga

SEQ ID NO: 20120 - RNA, 9876 nt, synthetic construct
  misc_feature 1..9876: note = derived and/or modified CDS sequence (opt5) from DENV-2__EU482676__SS-prME
  source 1..9876: mol_type = other RNA
tccgcctccatgatcattatgctgatccccaccgtgatggctttccacctcacaacgagaaatggagagcctcatatgattgtcgggatccaggaaaagggaaaatctctgctttttaagaccgaggacggcgttaatatgtgcacactgatggccatggatctcggggaactgtgtgaggacaccattacatacaaatgcccgcttctgcggcaaaatgaacccgaggatatcgactgttggtgcaattccacctccacatgggtgacctatggaacgtgtaccacaaccggcgagcaccgcagagaaaagcggtctgtggcgctcgtccctcatgtggggatgggactggagacacgcaccgaaacgtggatgagctccgagggcgcttggaaacacgcccagagaatcgagacatggattctgcggcatcccggcttcaccatcatggccgctattctcgcctacacaatcgggaccacccactttcagcgcgttctgattttcatccttctgacagctgtggccccttctatgacgatgagatgcattggaatctccaaccgggattttgtcgaaggcgtgtccgggggaagctgggttgacatcgtgctcgagcacggctcttgtgtcaccacaatggcgaagaataagcccaccctggatttcgaacttattaaaacagaggccaagcagcctgctaccctgcgcaaatattgcatcaaggccaaactcacgaacacaaccaccgaatccagatgtccgacacaaggggagcccagcctgaaggaggaacaggacaagcggtttgtgtgcaaacattctatggtggatcgcggatggggcaatggctgtgggctgttcggaaagggcgggattgttacatgcgctatgtttacatgcaaaaagaacatggagggaagaatcgttcagcctgaaaatctcgagtacacgattgtggtgacaccccactccggcgaggaacatgccgtcgggaacgacacaggaaaacacggcaaggagatcaaagtgacccctcagagctctatcacagaagcggagctgaccggctatgggacggttaccatggaatgtagcccccggacaggacttgatttcaatgagatggtgctgctccaaatggaaaacaaggcctggctggtccaccgccagtggtttcttgacctgccgctcccttggctgcccggcgctgataagcaggagagcaattggattcagaaagagaccctggtgacattcaagaaccctcatgccaaaaagcaagacgttgtggtcctcgggtcccaggaaggagctatgcacaccgccctgacgggcgccacagagatccagatgtctagcgggaatcttctgtttaccggccatctcaaatgcagactgcggatggacaaacttcaactgaagggaatgtcctacagcatgtgtacaggcaaattcaaggtggtcaaagaaattgctgagacccagcacgggaccatcgtgattagagttcagtatgagggagatggctctccctgcaagatccccttcgaaatcatggacctcgagaaacgctacgtgctggggcggctgattacagtcaaccctatcgtgacggaaaaggattccccggttaacattgaggcggaacccccttttggagacagctacatcattatcggcgtggagcccgggcagctcaagctgaattggttcaaaaagggctctagcattggacaaatgtttgagaccacaatgagaggcgccaaacgcatggctatccttggggataccgcctgggacttcggatccctgggcggggtctttacatctatcggaaaggccctccatcaggtgttcggcgctatttatggggccgcgtttagcggcgtgtcctggaccatgaaaatcctgattggagttatcattacgtggatcggcatgaacagccggtctacatccctgagcgtctctcttgtgctcgtggggatcgtcaccctgtacctgggagtgatggttcaggctgattccggctgtgtggtcagctggaagaataaggaactcaaatgcgggtccggaattttcatcaccgacaacgtgcacacatggaccgagcagtataagtttcaacctgaatctcccagcaaactggcctccgccattcagaaggctcaggaggaaggcatctgtgggattagatctgttacacgccttgagaatctgatgtggaaacagatcacgccggagctcaaccacatcctggccgaaaatgaggtgaagctgaccattatgacaggcgatatcaaaggaattatgcaagctggcaagcggagccttagacctcagcccaccgaactcaagtactcctggaaaacatgggggaaggccaaaatgctgagcaccgagtcttataaccagacgttcctgatcgacggacctgaaaccgcggagtgccccaatacaaaccgcgcctggaactccctcgaggtcgaagattacggctttggggtgttcaccacaaacatttggctgaaacttaaagagaagcaggacgtcttttgtgacagcaagctgatgtctgctgccatcaaagataatcgggctgtgcatgccgacatgggatattggatcgaatccgcgctcaacgatacctggaagattgagagagccagcttcatcgaggtcaaaaattgccactggcctaagtctcatacactgtggagcaacggcgtgctggaatccgagatgattatccccaaaaaccttgctggcccggtgagccaacacaattaccgccctgggtaccacacccagattgccggaccctggcatctcggcaagctggaaatggacttcgatttttgtgacgggacgacagtcatcgttaccgaggattgcggaaaccggggcccctctctgagaaccacaaccgcttccgggaagctcattacggaatggtgctgtcggagctgcacactgcctccgcttcgctatagaggagaggacggctgttggtacggcatggagatccggcccctgaaagaaaaggaggaaaatctcgtgaactccctggtgaccgccgggcacggacaggtcgataatttctctctgggcgtgcttgggatggccctctttctggaggaaatgctgagaacacgcgttggaaccaaacatgctatcctcctggtggcggtcagcttcgtgacacttattaccggcaacatgtcctttaaggacctggggcgggttgtggtcatggtgggagccacgatggctgatgacatcggcatgggcgttacctatctcgccctgctggccgctttcaaagtgagacctacatttgccgcggggcttctgctccgcaagctgacctctaaggagctcatgatgacaaccattggaatcgtcctgcttagccaatccacgattcccgagacagtgctggaactcaccgatgctctggccctgggcatgatggtgcttaaaatcgtcagaaatatggagaagtaccagctggccgttacaatcatggctattctctgcgtgcctaacgccgtgatcctgcagaatgcgtggaaagtctcttgtaccattctcgctgtggttagcgtgagccccctgcttctgaccagctctcagcaaaagacagactggatccctctcgccctgacgattaaagggctgaaccccaccgccatcttccttacaaccctgtcccggacaaataagaaacgcagctggccgctcaacgaagctatcatggccgtcggaatggtgtctattctggcttccagcctcctgaagaatgacatccctatgaccggcccccttgttgccgggggactgctgacggtgtgctatgtcctcacaggcagatctgcggatctggagcttgaacgggccaccgacgtgaagtgggaggatcaggctgagatttccggcagctcccctatcctgagcattaccatctctgaagacgggagcatgtccattaaaaacgaggaagaggagcagacactcaccatcctgatccgcacaggactcctggtcatttctggcctttttcccatcagcattccgatcacggccgctgcctggtacctgtgggaagtgaagaaacagagagccggggttctgtgggatgtgccttctccccctcccatgggaaaggctgagctcgaagacggcgcgtatcggattaaacaaaaggggatcctgggatacagccagatcggcgccggcgtctacaaggaggggaccttccacacaatgtggcatgtgacccgcggagctgttcttatgcacaaaggcaagagaattgaacccagctgggccgatgtgaaaaaggacctgatctcctatgggggaggctggaaactcgagggggagtggaaggaaggagaggaagtccaggtgctggccctcgagcctggcaagaatccgcgggctgtgcagacaaaacccggcctgtttaagaccaacacggggaccattggagccgtttctcttgatttcagccctggcacatccgggagccccatcattgacaaaaagggaaaagtcgtgggcctgtacgggaacggagtggtcacccgctctggcgcgtatgtgtccgctatcgcccaaacagaaaagagcatcgaggataatcctgagattgaagacgatatctttagaaagcggagactgaccattatggacctccaccccggcgccgggaaaacaaagcgctacctgcctgctatcgttcgggaggccattaaaagaggacttcgcacgctgatcctcgcgccgacccgggtggtcgctgccgaaatggaggaagccctgagaggcctccccattcgctatcagacccctgctatccgggccgagcataccgggagagagatcgtggacctgatgtgtcacgctaccttcacaatgcgccttctgtctcccgttcgggtgcctaactacaatctgattatcatggatgaagcccatttcacggaccccgcgtccattgccgctagaggatatatcagcacccgggtcgagatgggcgaagccgctgggatttttatgacagccaccccgcctggctcccgcgatcccttcccccagtctaacgcccctatcatcgacgaggagagagaaattcccgagcggagctggaactccggacacgaatgggtgacagattttaagggcaaaaccgtttggttcgtgcctagcatcaaggctgggaacgacattgcggcctgcctccgcaagaatggcaagaaggtcatccaactgtctagaaaaacgtttgattccgagtacgtgaagacacggaccaacgactgggatttcgtggtcaccacagacattagcgaaatgggcgctaattttaaagccgagagagttatcgatccgcgccggtgtatgaagcccgtgatccttaccgacggggaggaaagagtgattctggccggacctatgcccgtcacacattctagcgctgcccagcgccggggcagaatcgggcgcaaccctaaaaatgagaacgaccagtacatttatatgggcgaacccctcgagaatgatgaagactgcgcgcactggaaggaggctaagatgctgctggataacatcaataccccggagggaattatcccttccatgttcgaacccgagcgggaaaaagtggacgccattgatggcgagtacagactccgcggggaagccagaaagacgtttgttgaccttatgcggcgcggagatctgcctgtgtggctggcttataaagtcgccgcggagggcatcaactacgccgacagacggtggtgtttcgatgggatcaagaacaatcagattctcgaggaaaacgtggaggttgaaatctggacaaaagagggagagcgcaagaagctgaaacccagatggcttgacgctcggatttattctgatcctctggccctcaaggaatttaaagagttcgctgccggcagaaagagcctgaccctgaatctcatcacagaaatggggcgccttcccaccttcatgacgcagaagacccgggacgctctggataacctggccgtgctccacacagcggaggccggcggcagagcttacaatcatgccctgtccgaacttccggagaccctggagacactcctgctgctcacccttctggctacagtcaccggcgggatttttctgttcctcatgtctggacgcggcatcgggaagatgacgctgggaatgtgctgcatcattacagccagcatccttctgtggtatgcccagattcagcctcactggatcgctgcgtccattatcctcgaatttttcctgatcgtgctgctcattcccgagcccgaaaagcagcggacccctcaagacaaccagcttacctacgtcgtgatcgccattctgacagttgtggctgccaccatggccaatgagatgggctttctggagaaaacgaagaaagacttcggcctcgggagcatcgctacgcagcagccggagtctaacattctggatatcgaccttagacccgcctccgcgtggaccctgtacgccgtggctacaacctttgtcacacctatgctccggcatagcattgaaaattcctctgttaacgtgagcctgaccgccatcgctaatcaagccacggtgctgatgggactcggcaaggggtggcccctttccaaaatggatatcggagtccctctgctggcgattggctgttattctcaggtgaaccccatcaccctcacagccgctctgcttctgctcgttgcccactacgctattatcgggcctggactgcaggccaaggctacccgcgaagcccagaagagagcggccgctggcattatgaaaaatccgacagtggacggcatcaccgtcatcgatctggaccccattccttatgatcccaagttcgagaaacaactcgggcaagtgatgcttctgatcctgtgcgtcacacaggtgctcatgatgcggacaacctgggccctgtgtgaagctcttacactggccaccggacctattagcaccctctgggagggcaaccccgggcgcttttggaatacaacgatcgccgtttccatggcgaacattttcagaggaagctacctggctggcgccgggctgctcttttctatcatgaagaataccacaaacacccggcgcggaacaggcaacatcggcgaaacccttggggagaaatggaagtccagactgaatgctctgggaaaaagcgagttccaaatttataagaagtctggcatccaggaagtggaccggacgctcgccaaagaggggattaagcgcggagaaacagatcaccatgccgtctccagaggcagcgctaaactgcggtggtttgtggagagaaacatggttaccccggaggggaaggtggtcgaccttggatgcggccgcggcgggtggtcttactattgtggaggcctgcggaatgtgagagaagtgaaagggctcaccaagggaggccctgggcacgaggaacccatccccatgagcacatacggatggaacctggttcgcctgcagtccggcgtcgatgtgttcttcattcctcccgagaagtgcgacaccctcctttgtgatatcggcgaatctagccctaatccgacagtggaggccgggcggacgctgagagtcctgaacctcgttgagaattggctgaacaataacacccagttttgcatcaaagtgcttaatccctacatgccttccgtgattgaaaagatggaggcgctgcaacgcaaatatggaggcgccctcgtccggaaccccctgagcagaaattccacacatgaaatgtactgggtgtctaacgctagcgggaatatcgtttcctctgtgaacatgattagccgcatgctgatcaaccggttcaccatgagacacaagaaagccacatatgagcctgacgtcgacctcggatccggcacccgcaatattgggatcgaatctgagattcccaaccttgatatcatcggaaagcggattgagaagatcaaacaggaacatgagacgagctggcactacgaccaggatcacccgtataagacctgggcttaccatggctcctatgaaacaaaacagaccggcagcgcctcttccatggtgaatggggttgtgagactgctgacaaagccttgggacgtcctccccaccgtgacacaaatggcgatgaccgatacgacaccttttggacagcagcgcgtgttcaaagagaaggtcgacaccagaacccaggaacccaaggagggcaccaaaaagctgatgaaaattacggccgagtggctttggaaggaactggggaaaaagaaaacccctcggatgtgtacacgcgaggaatttaccagaaaggttcggagcaacgctgccctcggagctatcttcacagatgagaataagtggaaatctgccagagaggctgtggaagactcccggttttgggagctggtggataaggaacgcaacctgcacctcgagggcaaatgcgaaacctgtgtctacaatatgatggggaagagagagaaaaagctgggagagttcggcaaggccaaaggcagccgggcgatttggtacatgtggcttggggcccgctttctggagttcgaggctctcggatttctgaacgaagaccattggttctctagagaaaattcccttagcggcgtggaaggggagggactgcacaagctcggctatatcctgcgggatgtttccaaaaaggaagggggagccatgtacgctgacgacacagccggatgggatacccgcatcacgctggaggacctcaaaaacgaggaaatggtgaccaatcacatggagggcgaacataagaagctggccgaggcgatttttaaacttacatatcaaaacaaggtcgtgagagttcagcggcccaccccgcgcgggacagtgatggatatcattagcagacgggaccagcgcggatctggccaagtcgggacctacggactgaatacgttcacaaacatggaggctcagctcatcagacagatggaaggcgagggggtgttcaaaaatattcagcacctgaccgttacagaagaggtggccgtccaaaactggcttgcccgggtgggccgcgagagactgagccggatggctatctccggagatgactgcgtcgtgaagcctctcgatgacagatttgccaacgctctgaccgccctgaatgatatgggcaaaatccgcaaggacattcagcagtgggaaccctctaaggggtggaacgattggacgcaggttcccttctgcagccatcactttcatgagctcatcatgaaagacggacgggtgctggtcgtgccttgtagaaatcaagatgaacttattggccgcgcgcggatctcccagggggccggatggtctctgagagagaccgcttgcctcggcaagagctatgcccagatgtggtccctgatgtacttccaccgccgggaccttagactggctgccaacgcgatttgttctgccgtgccgagccactgggttcccacatcccgcaccacatggagcatccatgctaaacacgaatggatgaccacagaggacatgctcgccgtgtggaatcgggtctggattagagagaacccttggatggaagataagacccccgtggagtcttgggaagagatcccttatctggggaaacgcgaagaccagtggtgcggctccctgatcggactcacgagccgggctacatgggccaagaatattcaagctgccatcaaccaggttagatctctgattggcaatgaggagtacaccgattacatgccctccatgaagcggtttagacgcgaagaggaagaggcgggggtgctttggtga

SEQ ID NO: 20121 - RNA, 9876 nt, synthetic construct
  misc_feature 1..9876: note = derived and/or modified CDS sequence (opt5) from DENV-2__EU482677__SS-prME
  source 1..9876: mol_type = other RNA
agcgccggcatgatcattatgctgatccccaccgtcatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcgtgaccgacaacgttcacacatggaccgaacagtataagtttcaacctgagtccccctctaaactggccagcgccatccagaaggctcaggaagaggggatttgtggcatccggtccgtgacaagacttgagaatctgatgtggaaacagattacgccggaactcaaccacatcctggccgagaatgaagtcaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagttttcaccacaaacatctggctgaaacttaaagaaaagcaggacgctttttgtgactccaagctgatgagcgccgctattaaagataatcgcgccgtgcatgcggacatgggctattggatcgagtctgccctcaacgatacctggaagatcgagaaggctagcttcattgaagtcaagaattgccactggcctaaaagccatacactgtggtctaacggcgtgctggagagcgaaatgatcattcccaagaaccttgccgggccggtgtcccaacacaattaccggcctggataccacacccagatcgctggcccctggcatctcgggaagctggagatggacttcgatttttgtgacggaacgacagtcattgttaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaattcgccccctgaaggagaaagaagagaatctcgtgaacagcctggtgaccgccggacacggccaggtcgataatttctccctgggggtgcttggaatggctctctttctggaagagatgctgagaacacgggttggcaccaagcatgcgatcctcctggtggccgtctctttcgtgacacttatcaccgggaacatgagctttaaagacctgggaagagttgtggtcatggtgggcgctacgatggccgatgacattggcatgggggttacctatctcgccctgctggctgccttcaaggtgcgccctacatttgcggctggacttctgctccggaagctgacctccaaagagctcatgatgacaaccatcggcattgtcctgctttctcaaagcacgatccccgaaacagtgctggagctcaccgatgccctggccctggggatgatggtgcttaagattgtcagaaatatggaaaaataccagctggctgttacaatcatggccatcctctgcgtgcctaacgcggtgattctgcagaatgcttggaaggtctcctgtaccatcctcgccgtggtttctgtgagccccctgcttctgacctccagccagcagaagaccgactggattcctctcgccctgacgatcaagggactgaaccccaccgctattttccttacaaccctgtctcgcacaaataaaaagagatcctggccgctcaacgaggccatcatggctgtcggcatggtgagcatcctggcctcttccctcctgaagaatgacattcctatgaccgggccccttgttgcgggaggcctgctgacggtgtgctatgtcctcacaggccggagcgccgatctggaacttgagcgcgctaccgacgtgaaatgggaggatcaggccgaaatctctgggtccagccctattctgtccatcaccattagcgaggacggatctatgagcatcaagaacgaagaggaggaacagacactcaccattctgatcagaacaggcctcctggtcatctccgggctttttcccatttctatcccgattacggctgccgcctggtacctgtgggaggtgaaaaagcagcgggctggagttctgtgggatgtgccttctccccctcccatgggcaaagcggaactcgaggacggggcctatcgcatcaagcaaaagggcattctgggatactcccagatcggcgctggggtctacaaagaaggaaccttccacacaatgtggcatgtgaccagaggcgccgttcttatgcacaaggggaaacggatcgagccctcctgggccgatgtgaagaaagacctgattagctatggaggcgggtggaagctcgagggagaatggaaggagggcgaagaggtccaggtgctggctctcgaacctggcaaaaatccgcgcgccgtgcagacaaagcccgggctgtttaaaacctccacgggaaccatcggcgcggtttctcttgatttcagccctgggacatccggaagccccattatcgacaagaaaggcaaggtcgtggggctgtacggaaacggcgtggtcaccagatctggcgcttatgtgtccgccattgcccaaacagaaaagagcatcgaggataaccctgaaatcgaggacgatatttttcggaaacgcagactgaccatcatggacctccaccccggggctggaaagacaaaacggtacctgcctgccattgttagagaagcgatcaagcgcggccttcggacgctgattctcgctccgaccagagtggtcgccgccgagatggaagaggctctgcgcgggctccccatccggtatcagacccctgccattagagctgagcataccggacgcgaaatcgtggacctgatgtgtcacgccaccttcacaatgcggcttctgtctcccgttagagtgcctaattacaacctgatcattatggatgaggcgcatttcacggaccccgcctccatcgctgcccgcggctatattagcacccgggtcgaaatgggggaggctgccggcatctttatgacagccaccccgcctggatccagagatcccttcccccagtctaatgctcctattatcgacgaggaacgggagatccccgaacgcagctggaactccggccacgagtgggtgacagattttaaagggaagaccgtttggttcgtgcctagcattaaggcgggaaatgacatcgccgcttgcctccgcaaaaacggcaagaaagtcattcaactgtctcggaagacgtttgattccgaatacgtgaaaacaaagaccaatgactgggatttcgtggtcaccacagacatcagcgagatgggggccaactttaaagccgagcgcgttattgatccgagacggtgtatgaagcccgtgatccttaccgacggagaagagagagtgatcctggctggccctatgcccgtcacacattctagcgccgcgcagcgccgggggagaattggccgcaatcctaagaacgaaaatgaccagtacatctatatgggagagcccctcgaaaacgatgaggactgcgctcactggaaagaggccaagatgctgctggataatattaacaccccggaaggcatcattccttccatgttcgagcccgaacgggagaaagtggacgccatcgatggggaatacagactccgcggagaggctcggaagacgtttgttgaccttatgagacgcggcgatctgcctgtgtggctggcctataaagtcgcggccgaggggattaattacgctgacagacggtggtgtttcgatggaatcaagaacaaccagatcctcgaagagaatgtggaagttgagatttggacaaaggagggcgaacgcaaaaagctgaaacccagatggcttgacgcccggatctattctgatcctctggctctcaaggagtttaaagagttcgccgctgggcgcaagagcctgaccctgaacctcattacagagatgggcagacttcccaccttcatgacgcaaaaggcccgggacgcgctggataatctggccgtgctccacaccgctgaagccggaggcagagcttacaaccatgccctgtccgagcttccggagacactggaaaccctcctgctgctcacacttctggccaccgtcacagggggaatctttctgttcctcatgtctggccgcgggattggaaaaatgaccctgggcatgtgctgcatcatcacggctagcattcttctgtggtatgcgcagatccagcctcactggattgccgcttccatcattctcgagtttttcctgatcgtgctgctcatccccgaacccgagaagcagcggacacctcaagacaatcagcttacctacgtcgtgattgccatcctgaccgttgtggccgctacaatggccaacgaaatgggctttctggagaaaaccaagaaagacctcgggctgggaagcattgcgacacagcagccggagtctaatatccttgatattgacctgagacccgcctccgcttggacgctctacgccgtggctaccacattcgtcacccctatgctgcgccatagcatcgaaaactcctctgttaatgtgagcctgacagccattgcgaaccaagccaccgtgctcatgggccttgggaagggatggcccctgtccaagatggatatcggcgtccctctgctcgctatcgggtgttattctcaggtgaatcccattacgctgaccgccgcccttctgctcctggttgcccactacgctatcattggacctggcctgcaggccaaagcgacacgggaggcccagaagagagctgccgctggcatcatgaaaaacccgaccgtggacgggattacagtcatcgatctcgaccccatcccttatgatcccaagtttgaaaaacaacttggacaggtgatgctgctgattctctgcgtcacccaggtgctgatgatgcggacgacatgggccctttgtgaggccctgaccctcgcgacaggccctatcagcaccctgtgggaagggaatcccggacgcttctggaacaccacaattgctgtttccatggccaatatctttagaggcagctacctggctggggccggactccttttctctattatgaagaacacgaccaatacacggcgcggcaccggcaacatcggggagacactgggagagaaatggaagtccagactgaacgccctcggcaagagcgaatttcaaacctataaaaagtctgggatccaggaggtggaccggacgctggctaaagaaggaattaagcgcggcgagacagatcaccatgccgtctccagagggagcgcgaaacttcggtggttcgtggagcgcaatatggttaccccggaaggaaaggtggtcgacctgggctgcggcagagggggatggtcttactattgtggcgggctcaagaacgtgcgggaggtgaaaggactgaccaagggcgggcctggacacgaagaacccatccccatgagcacatacggctggaatctggttagactccagtccggcgtcgatgtgtttttcattcctcccgaaaaatgcgacacccttctgtgtgatatcggggagtctagccctaacccgacagtggaggccggacgcacgctgcgggtcctcaatctggttgaaaactggcttaataacaatacccagttctgcattaaggtgctgaacccctacatgccttccgtgatcgagaaaatggaagctctccaaagaaagtatggcggggccctggtccgcaatcccctgagccggaactccacacatgagatgtactgggtgtctaatgctagcggaaacatcgtttcctctgtgaatatgattagcagaatgctcatcaaccgctttaccatgcggcacaagaaagccacatatgaacctgacgtcgaccttggctccgggaccagaaacattggaaatgagtctgagatccccaacctggatattatcggcaagcgcattgagaaaatcaagcaggagcatgaaacgagctggcactacgaccaggatcacccgtataaaacctgggcgtaccatggctcctatgagacaaagcagaccgggagcgcctcttccatggtgaatggagttgtgcggctgctcacaaagccttgggacgtcctgcccaccgtgacacaaatggctatgaccgatacgacacctttcggccagcagagagtgtttaaagaaaaggtcgacacccgcacccaggagcccaaagaggggacaaagaaacttatgaagatcacggccgaatggctgtggaaagagctcggaaagaagaaaacccctcggatgtgtacaagagaagagttcacccgcaaggttagaagcaacgctgccctgggcgctatttttacagatgagaataaatggaagtctgcccgggaagcggtggaggactcccgcttctgggaactggtggataaagagagaaacctccacctggaagggaagtgcgagacctgtgtctacaatatgatgggaaagcgggagaagaaacttggcgaatttggcaaagccaaagggagcagagctatctggtacatgtggctgggagcccggttcctcgagtttgaagctctgggcttccttaacgaggaccattggttttctcgcgaaaattccctgagcggggtggagggagagggcctccacaaactggggtatattctgagagatgtttccaagaaggaaggcggagccatgtacgccgacgacacagcgggctgggatacccggatcacgctcgaggacctgaaaaacgaagagatggtgaccaatcacatggaaggggagcataagaaacttgctgaggccattttcaagctgacatatcaaaacaaagtcgtgcgcgttcagagacccaccccgcggggaacagtgatggatatcatcagccgcagagaccagcggggctctgggcaagtcggaacctacggcctcaatacgtttacaaacatggaagcccagctgattcgccagatggagggggaaggcgtgttcaagaatatccagcaccttaccgttacagaggaggtggctgtccaaaactggctggccagagtgggacgggaacgcctcagcagaatggctatttccggcgatgactgcgtcgtgaagcctctggatgaccggttcgccaacgcgctgaccgccctcaatgatatggggaaaatccgcaaggacattcagcagtgggagccctctaaaggatggaacgattggacgcaggttcccttttgcagccatcacttccatgaactgatcatgaaggacggcagagtgcttgtcgtgccttgtcggaatcaagatgagctgatcgggagagctcgcatttcccagggagccggctggtctctccgggaaaccgcttgcctggggaaaagctatgcccagatgtggtcccttatgtactttcacagacgcgacctgcggctcgcggccaacgctatctgttctgccgtgccgagccactgggttcccacatccagaaccacatggagcattcatgctaagcacgagtggatgaccacagaggacatgctgaccgtgtggaatcgcgtctggatccgggaaaacccttggatggaggataagacgcccgtggaatcttgggaggaaattccttatctgggcaaaagagaggaccagtggtgcggatccctcatcggcctgacaagccgcgccacctgggctaagaatattcaagttgccatcaaccaggtgcggtctcttatcgggaatgaggaatacaccgattacatgccctccatgaaaagattccgccgggaggaagaggaagcgggagtcctgtggtga

SEQ ID NO: 20122 - RNA, 9876 nt, synthetic construct
  misc_feature 1..9876: note = derived and/or modified CDS sequence (opt5) from DENV-2__EU482678__SS-prME
  source 1..9876: mol_type = other RNA
agcgccggcatgatcattatgctgatccccaccgtcatggctttccacctgacaacgcggaatggggagcctcatatgattgtcggaatccaggaaaagggcaagtccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgatgagcaggaatccaattggattcagaaggagaccctggtgacattcaaaaaccctcatgccaagaaacaagacgttgtggtcctcggaagccaggaaggcgctatgcacaccgccctgacgggggccacagagatccagatgtcctctggcaatcttctgtttaccggacatctcaagtgccgcctgagaatggacaaacttcaactgaagggcatgagctactccatgtgtacagggaagttcaaagtggtcaaggagattgctgaaacccagcacggaaccatcgtgattcgggttcagtatgagggcgatgggagcccctgcaaaatccccttcgaaatcatggacctcgagaagagatacgtgctgggacgcctgattacagtcaaccctatcgtgacggaaaaagattctccggttaacattgaggcggagcccccttttggcgactcctacatcattatcggggtggaacccggccagctcaagctgaattggttcaagaaaggaagctctattggccaaatgtttgagaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggaactcaagtgcggaagcggcattttcatcaccgacaacgtgcacacatggaccgagcagtataaatttcaacctgaatccccctctaagctggccagcgccattcagaaagctcaggaggaggggatctgtggcattcggtccgttacaagacttgaaaatctgatgtggaagcagatcacgccggagctcaaccacatcctggccgaaaatgaggtgaaactgaccattatgacaggagatatcaagggcattatgcaagctgggaaacgctctcttcggcctcagcccaccgaactcaagtacagctggaagacatggggaaaagccaagatgctgtccaccgagagctataaccagacgttcctgatcgacggccctgagaccacagaatgccccaataccaacagagcgtggaactctctcgaggtcgaagattacgggtttggagtgttcacaaccaacatttggctgaaacttaaggagaaacaggacgccttttgtgactccaagctgatgagcgctgccatcaaggataatcgcgctgttcatgccgacatgggctattggatcgagtctgcgctcaacgatacatggaaaattgaaaaggcctccttcatcgaggtgaaaaattgccactggcctaagagccataccctgtggtctaacggcgtcctggaaagcgagatgattatccccaaaaaccttgctgggccggtgtcccaacacaattaccggcctggataccacacgcagattgccggcccctggcatctcgggaagctggaaatggacttcgatttttgtgacggaacaaccgtgatcgtcaccgaggattgcggcaacagagggcccagcctgcgcacaaccacggcttctggaaagctcattacagagtggtgctgtcggtcctgcaccctgcctccgcttagatatcggggcgaagacggctgttggtacgggatggagatccgccccctgaaagaaaaggaggaaaatctcgttaacagcctggtgacagccggacacggccaggtggataatttctccctgggggtccttggaatggccctctttctggaggagatgctgagaacccgggtgggcacaaaacatgctatcctcctggttgcggtgtctttcgtcacccttattacggggaacatgagctttaaggacctgggaagagtggttgtgatggtcggcgccaccatggctgatgacatcggcatgggggtgacatatctcgccctgctggccgctttcaaagttcgccctacctttgccgcgggacttctgctccggaagctgacatccaaggaactcatgatgaccacgattggcatcgtgctgctttctcaaagcacaattcccgagaccgtcctggaactcacagatgctctggccctggggatgatggtgcttaaaatcgtgagaaatatggagaagtaccagctggccgtcaccatcatggctattctctgcgttcctaacgccgtgatcctgcagaatgcgtggaaagtgtcctgtaccattctcgctgtcgtgtctgttagccccctgcttctgacatccagccagcaaaagacggactggatccctctcgccctggccattaaaggactgaaccccaccgctatcttccttacaaccctgtctcgcacaaataagaaaagatcctggccgctcaacgaagccatcatggctgtgggcatggtcagcattctggcctcttccctcctgaagaatgacatccctatgaccgggccccttgtggcgggaggcctgctgacggtttgctatgtgctcacaggccggagcgccgatctggagcttgagcgcgctaccgacgtcaagtgggaagatcaggccgagatttctgggtccagccctatcctgtccattaccatcagcgaagacggatctatgagcattaaaaacgaggaggaggaacagacactcaccatcctgatcagaacaggcctcctggtgatttccgggctttttcccatctctattccgatcacggctgccgcctggtacctgtgggaagtcaagaaacagcgggctggagtgctgtgggatgttccttctccccctcccatgggcaaggcggagctcgaagacggggcctatcgcattaaacaaaagggaatcctgggctactcccagatcggcgctggggtgtacaaggagggaaccttccacacaatgtggcatgtcaccagaggcgccgtgcttatgcacaaagggaagcggattgagccctcctgggccgatgttaaaaaggacctgatcagctatggaggcgggtggaaactcgaaggagagtggaaggaaggcgaggaagtgcaggtcctggctctcgagcctggcaagaatccgcgcgccgtgcagacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgaccagaagcggcgcttatgtctctgccatcgcccaaacagagaagtccatcgaagataatcctgagattgaagacgatatctttcggaagcgcagactgaccattatggacctccaccccggggctggaaaaacaaagcggtacctgcctgccatcgtgagagaggcgattaaacgcggccttcggacgctgatcctcgctccgaccagagttgtggccgccgaaatggaggaggctctgcgcgggctccccattcggtatcagacccctgccatcagagctgaacataccggacgcgagatcgtcgacctgatgtgtcacgccaccttcacaatgcggcttctgagccccgtgagagttcctaactacaatctgattatcatggatgaagcgcatttcacggaccccgcctctattgctgcccgcggctatatctccacccgggtggagatgggggaggctgccggcatttttatgacagccaccccgcctggaagcagagatcccttcccccagtccaacgctcctatcatcgacgaggaacgggaaattcccgagcgctcttggaatacaggccacgaatgggtcaccgattttaaggggaaaacggtgtggttcgttcctagcatcaaggcgggaaacgacattgccgcttgcctcagaaagaatggcaaaaaggtgatccaactgtcccggaaaacatttgatagcgagtacgtcaagacccgcaccaacgactgggatttcgtggtgacaaccgacatttctgagatgggggccaattttaaagccgaaagagtcatcgatccgcggagatgtatgaagcccgttatccttacagacggagaggaacgcgtgattctggctggccctatgcccgtgacccattccagcgccgcgcagcggagagggcgcatcggccggaaccctaaaaatgagaacgaccagtacatttatatgggagaacccctcgagaatgatgaggactgcgctcactggaaggaagccaagatgctgctggataacatcaatacgccggagggcattatcccttctatgttcgaacccgagagagaaaaagtcgacgccattgatggggagtaccgcctccggggagaggctagaaagacatttgtggaccttatgcgcagaggcgatctgcctgtttggctggcctataaagtggcggccgaagggatcaactacgctgaccggcgctggtgtttcgatggaatcaagaacaatcagattctcgaggaaaacgtcgaggtggagatctggaccaaagaaggcgagagaaagaagctgaaaccccggtggcttgacgcccgcatttatagcgatcctctggctctcaaggaatttaaagagttcgccgctgggagaaagtccctgacactgaatctcatcaccgaaatgggccggcttcccacgttcatgacccagaagacgagagacgccctggataacctggcggttctccacaccgccgaggctggaggccgcgcctacaatcatgctctgtctgagcttccggaaacactggagaccctcctgctgctcacacttctggccaccgtgacagggggaatttttctgttcctcatgagcggccgggggatcggaaagatgacactgggcatgtgctgcatcattaccgcctccatccttctgtggtatgctcagattcagcctcactggatcgcggcctctattatcctcgaatttttcctgatcgtcctgctcattcccgagcccgaaaagcagagaacccctcaagacaaccagcttacatacgtggtcatcgctattctgaccgtggttgccgccacaatggctaatgagatgggctttctggagaaaacgaagaaagacctcgggctgggaagcatcgccacccagcagccggaatccaacattcttgatatcgacctgcgccccgcgagcgcctggacactctacgctgtggccaccacattcgtgacccctatgctgcggcattctattgagaatagcagcgtcaacgtttccctgacggctatcgccaatcaagcgaccgtgctcatgggccttgggaagggatggcccctgtctaaaatggatatcggcgtgcctctgctcgccattgggtgttatagccaggtcaaccccatcacactgaccgctgcccttctgctcctggtggctcactacgccattatcggacctggcctgcaggctaaggccacaagagaagcgcagaagcgggccgctgccggcattatgaaaaatccgaccgttgacgggatcacggtgatcgatctcgaccccattccttatgatcccaagtttgagaaacaacttggacaggtcatgctgctgatcctctgcgtgacacaggtcctgatgatgcgcaccacatgggctctttgtgaagccctgaccctcgccaccggccctatttccacactgtgggaggggaaccccggaagattctggaatacgaccatcgcggtgtctatggctaacatttttcggggcagctacctggccggggctggactccttttctccatcatgaagaatacaaccaacacacgcagaggcaccggcaacatcggggagacgctgggagaaaaatggaaaagccggctgaatgccctcggcaaatctgagtttcaaatttataagaagtccgggatccaggaagttgaccgcacactggccaaagagggaattaagagaggcgagaccgatcaccatgctgtgagccgggggtctgccaaacttcgctggttcgtcgaaagaaacatggtgaccccggagggaaaggttgtggacctgggctgcggcagagggggatggtcctactattgtggcgggctcaaaaatgtccgggaagtgaagggactgacaaagggcgggcctggacacgaggaacccatccccatgagcacctacggctggaacctggtgcgcctccagtctggcgttgatgtctttttcattcctcccgagaaatgcgacacacttctgtgtgatatcggggagagctcccctaatccgacggtggaagcgggacggaccctgagagtgctcaacctggtcgagaattggcttaacaataacacacagttctgcatcaaggttctgaatccctacatgccttctgtgattgagaagatggaggccctccaacgcaagtatggcggggctctggtgcggaaccccctgagcagaaattccacccatgaaatgtactgggtcagcaacgcctccggaaatatcgtgtctagcgttaacatgatttcccgcatgctcatcaaccggtttacaatgagacacaaaaaggctacctatgagcctgacgtggaccttggctctgggacgcgcaatattggaatcgagagcgaaattcccaacctggatatcatcggcaagcggattgagaaaatcaagcaggaacatgagacctcctggcactacgaccaggatcacccgtataaaacatgggcctaccatggctcttatgaaaccaagcagacagggagcgcgtccagcatggtcaatggagtggttagactgctcaccaaaccttgggacgtgctgcccacagtcacccaaatggccatgacggatacaacccctttcggccagcagcgcgtgtttaaggagaaggtggacacccggacacaggagcccaaagaagggacgaagaaacttatgaagattaccgctgagtggctgtggaaagaactcggaaagaaaaagacacctagaatgtgtacccgcgaggagttcacaagaaaggtccggtctaacgccgctctgggcgccatctttaccgatgaaaataaatggaagtccgctcgcgaggccgttgaagacagcagattctgggagctggtggataaagaacggaacctccacctggaggggaagtgcgagacatgtgtgtacaatatgatgggaaaaagagaaaagaaacttggcgagtttggcaaagcgaaggggtctcgggccatttggtacatgtggctgggagctcgcttcctcgaatttgaggccctgggcttccttaacgaagaccattggttttccagagagaatagcctgtctggggtcgagggagaaggcctccacaaactggggtatatcctgcgggatgtgtccaagaaagagggcggagctatgtacgccgacgacaccgccggctgggatacgcgcatcaccctcgaagacctgaagaacgaggaaatggttacaaatcacatgaagggggagcataagaaacttgcggaggctattttcaaactgacctatcaaaacaaagtggtcagagtgcagcggcccacaccgcgcggaaccgttatggatatcattagcagacgggaccagcgcggctccgggcaagtgggaacgtacggcctcaatacatttaccaacatggaagcccagctgatcagacagatggagggggaaggcgtcttcaaaaatattcagcaccttacagtgaccgaggaggttgccgtgcaaaactggctggctcgggtcggacgcgaaagactcagccggatggccatctctggcgatgactgcgtggtcaagcctctggatgaccgcttcgctaacgccctgacggcgctcaatgatatggggaagatcagaaaagacattcagcagtgggagcccagcaagggatggaacgattggacccaggtgcccttttgctcccatcacttccatgaactgatcatgaaagacggccgggttcttgtggtcccttgtagaaatcaagatgagctgattgggcgcgcccggatctctcagggagctggctggagcctcagagaaacagcctgcctggggaagtcctatgctcagatgtggtctcttatgtactttcaccgccgggacctgagactcgccgcgaacgccatttgtagcgctgtgccgtcccactgggtgcccacctctcgcacaacctggagcatccatgccaaacacgagtggatgacaaccgaggacatgctgacggtttggaatcgggtgtggattagagaaaacccttggatggaggataagacacccgtcgaatcctgggaggaaatcccttatctgggcaagcgcgaggaccagtggtgcggaagcctcatcggcctgacctctcgggctacctgggccaaaaatattcaagctgccatcaaccaggtgagatcccttattgggaatgaggaatacacagattacatgcccagcatgaagcgcttccggagagaggaagaggaagcgggagttctgtggtga

SEQ ID NO: 20123 - RNA, 9876 nt, synthetic construct
  misc_feature 1..9876: note = derived and/or modified CDS sequence (opt5) from DENV-2__EU482679__SS-prME
  source 1..9876: mol_type = other RNA
agcgccggaatgatcattatgctgatccccacagtgatggctttccacctgacaacgagaaatggggagcctcatatgattgttggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagccataaccagacgttcctgatcgacggccctgagaccgcggagtgccccaatacaaacagagcctggaactctctcgaagtcgaggattatgggtttggagtgttcaccacaaacatttggctgaaacttaaagaaaagcaggacgctttttgtgactccaagctgatgagcgccgctatcaaagataatcgcgccgttcacgcggacatgggctactggatcgagtctgccctcaacgatacctggaagattgagaaggctagcttcatcgaagtgaagaattgccattggcctaaaagccacacactgtggtctaacggcgtcctggagagcgaaatgattatccccaagaaccttgccgggccggtgtcccaacacaattatcggcctggataccatacccagattgctggcccctggcacctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagataccggggcgaggacggctgttggtatgggatggaaatccgccccctgaaggagaaagaagagaatctcgttaacagcctggtgaccgccggacatggccaggtggataatttctccctgggggtccttggaatggctctctttctggaagagatgctgagaacacgggtgggcaccaagcacgcgatcctcctggttgccgtgtctttcgtcacacttattaccgggaacatgagctttaaagacctgggaagagtggttgtgatggtcggcgctacgatggccgatgacatcggcatgggggtgacctacctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaatatcagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctacgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtatctgtgggaggtcaaaaagcagcgggctggagtgctgtgggatgttccttctccccctcccatgggcaaagcggaactcgaggacggggcctaccgcattaagcaaaagggaatcctgggctattcccagatcggcgctggggtgtacaaagaaggaaccttccatacaatgtggcacgtcaccagaggcgccgtgcttatgcacaaggggaaacggattgagccctcctgggccgatgttaagaaagacctgatcagctacggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtatggaaacggcgtggtgaccagaagcggcgcttacgtctctgccatcgcccaaacagagaagtccatcgaggataatcctgaaattgaggacgatatctttcggaaacgcagactgaccattatggacctccatcccggggctggaaagacaaaacggtatctgcctgccatcgtgagagaagcgattaagcgcggccttcggacgctgatcctcgctccgaccagagttgtggccgccgagatggaagaggctctgcgcgggctccccattcggtaccagacccctgccatcagagctgagcacaccggacgcgaaatcgtcgacctgatgtgtcatgccaccttcacaatgcggcttctgagccccattagagtgcctaactataatctgatcattatggatgaggcgcacttcacggaccccgcctctatcgctgcccgcggctacatttccacccgggttgaaatgggggaggctgccggcatctttatgacagccaccccgcctggaagcagagatcccttcccccagtccaacgctcctatcattgacgaggaacgggagatccccgaacgctcttggaatagcggccatgagtgggtgacagattttaaagggaagaccgtctggttcgtgccttccattaaggcgggaaacgacatcgccgcttgcctccgcaaaaatggcaagaaagttattcaactgagccggaagacgtttgattctgaatatgtgaaaacacgcaccaacgactgggatttcgtcgtgaccacagacatctccgagatgggggccaattttaaggccgagagagtgatcgatccgcggagatgtatgaaacccgtcattcttaccgacggagaggaacgcgttatcctggctggccctatgcccgtgacacacagctctgccgcgcagcggagagggcgcattggccggaaccctaagaatgaaaacgaccagtacatctacatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaatatcgcctccggggagaggctagaaaaacgtttgtcgaccttatgcgcagaggcgatctgcctgtgtggctggcctacaaggttgcggccgaggggatcaactatgctgaccggcgctggtgtttcgatggaattaaaaacaatcagatcctcgaagagaacgtggaagtcgagatttggacaaaggagggcgaaagaaagaaactgaagccccggtggcttgacgcccgcatctactccgatcctctggctctcaaagagtttaaggagttcgccgctgggagaaaatctctgaccctgaatctcattacagagatgggccggcttcccaccttcatgacgcaaaagaccagagacgccctggataacctggcggtgctccatacagccgaagctggaggccgcgcctataatcacgctctgagcgagcttccggagaccctggaaacactcctgctgctcacccttctggccacagttaccgggggaatctttctgttcctcatgtccggccgggggatcggaaagatgacgctgggcatgtgctgcattatcacagcctctattcttctgtggtacgctcagatccagcctcattggattgcggccagcatcatcctcgagtttttcctgattgtgctgctcatccccgaacccgagaaacagagaacccctcaagacaaccagcttacctatgtcgtgattgctatcctgacagtcgtggccgccaccatggctaatgaaatgggctttctggagaagaccaagaaggacctcgggctgggatccattgccacgcagcagccggagagcaacatccttgatattgacctgcgccccgcgtctgcctggaccctctacgctgttgccacaaccttcgtgacacctatgctgcggcactccatcgaaaatagctccgtgaacgtctctctgaccgctatcgccaatcaagcgacggttctcatgggccttgggaaaggatggcccctgagcaagatggatattggcgtgcctctgctcgccatcgggtgttactcccaggtgaaccccattaccctgacagctgcccttctgctcctggtcgctcactatgccatcattggacctggcctgcaggctaaggccaccagagaggcgcagaaacgggccgctgccggcatcatgaagaatccgacagtggacgggatcaccgttattgatctcgaccccatcccttacgatcccaaatttgaaaagcaacttggacaggtgatgctgctgattctctgcgtcacacaggtgctgatgatgcgcacaacctgggctctttgtgaggccctgacactcgccaccggccctatctctaccctgtgggaagggaaccccggaagattctggaatacaacgattgcggtcagcatggctaacatctttcggggctcctatctggccggggctggactccttttcagcatcatgaaaaataccacaaacacccgcagaggcacaggcaacatgggggagaccctgggagagaagtggaaatctcggctgaatgccctcggcaagtccgaatttcaaatttacaagaaaagcgggatccaggaggtggaccgcacgctggccaaggaaggaattaaaagaggcgagacagatcatcacgctgtttctcgggggtccgccaaacttcgctggttcgtggagagaaacatggtcaccccggaaggaaaagtggttgacctgggctgcggcagagggggatggagctattactgtggcgggctcaagaatgtgcgggaggtcaagggactgaccaaaggcgggcctggacatgaagaacccatccccatgtctacatatggctggaacctggtgcgcctccagagcggcgtggatgtctttttcattcctcccgaaaagtgcgacacccttctgtgtgatatcggggagtcctctcctaatccgacagtcgaggcgggacggacgctgagagtgctcaacctggtggaaaattggcttaacaataacacccagttctgcatcaaagtcctgaatccctacatgcctagcgttattgagaagatggaagccctccaacgcaaatacggcggggctctggtgcggaaccccctgtccagaaatagcacacacgagatgtattgggtgtccaacgcctctggaaatatcgtcagctccgtgaacatgatttctcgcatgctcatcaaccggtttaccatgagacataagaaggctacatacgaacctgacgttgaccttggcagcgggacccgcaatattggaatcgagtccgagattcccaacctggatatcatcggcaaacggattgaaaagatcaaacaggagcacgaaacgtcttggcactatgaccaggatcatccgtacaagacctgggcctatcacggcagctacgagacaaaacagaccgggtccgcgagctctatggtgaatggagtcgtgagactgctcacaaagccttgggacgttctgcccaccgtgacacaaatggccatgaccgatacgacacctttcggccagcagcgcgtctttaaggaaaaagtggacacccggacccaggagcccaaggaggggaccaagaaacttatgaaaattacggctgaatggctgtggaaggagctcggcaaaaagaagacccctagaatgggcacacgcgaagagttcaccagaaaagtgcggtccaacgccgctctgggggccatctttacagatgagaataagtggaaaagcgctcgcgaagccgtcgaggactctagattctgggaactggttgataaggagcggaacctccatctggaaggaaaatgtgagacctgcgtgtataatatgatgggcaagagagagaagaaacttggcgaatttgggaaggcgaaaggatcccgggccatttggtacatgtggctgggcgctcgcttcctcgagtttgaagccctggggttccttaacgaggaccactggtttagcagagaaaattctctgtccggagtggagggcgaggggctccacaagctgggctacatcctgcgggatgtcagcaaaaaggaaggaggcgctatgtatgccgacgacacagccgggtgggatacccgcatcacgctcgaggacctgaagaacgaagagatggtgaccaatcatatggaaggagagcacaagaaacttgcggaggctattttcaaactgacataccaaaacaaagttgtgagagtccagcggcccaccccgcgcggcacagtgatggatatcatttccagacgggaccagcgcgggagcggacaagttggcacctatgggctcaatacgtttacaaacatggaagcccagctgatcagacagatggagggcgaaggagtgttcaaaaatattcagcatcttaccgtcacagaggaggtggccgttcaaaactggctggctcgggtgggccgcgaaagactctctcggatggccatcagcggggatgactgtgtcgtgaagcctctggatgaccgcttcgctaacgccctgaccgcgctcaatgatatgggaaagatcagaaaagacattcagcagtgggagccctccaagggctggaacgattggacgcaggtccccttttgctctcaccatttccacgaactgatcatgaaagacgggcgggtgcttgttgtgccttgcagaaatcaagatgagctgattggacgcgcccggatcagccagggcgctgggtggtccctcagagaaaccgcctgtctgggcaagtcttacgctcagatgtggagccttatgtattttcaccgccgggacctgagactcgccgcgaacgccatttgctccgctgtcccgtctcattgggtgcccacaagccgcaccacatggtccatccacgccaaacatgagtggatgaccacagaggacatgctgaccgtgtggaatcgggtttggattagagaaaacccttggatggaggataagacgcccgtggaaagctgggaggaaatcccttacctgggaaagcgcgaggaccagtggtgtggctctctcatcgggctgacatcccgggctacctgggccaaaaatattcaagctgccatcaaccaggtcagaagccttattggaaatgaggaatataccgattacatgccctctatgaagcgcttccggagagaggaagaggaagcgggcgtgctgtggtga

SEQ ID NO: 20124 - RNA, 9876 nt, synthetic construct
  misc_feature 1..9876: note = derived and/or modified CDS sequence (opt5) from DENV-2__EU482774__SS-prME
  source 1..9876: mol_type = other RNA
agcgccggcatgatcattatgctgatccccaccgtgatggctttccacctcacaacgagaaatggggaacctcatatgattgtcggaatccaggaaaagggcaaatccctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcttcattggcgttatcattacgtggatcgggatgaactcccgcagcacatctctgtccgtcagcctggtgcttgtgggaatcgtcaccctctacctgggcgtgatggttcaggctgattctgggtgtgtggtctcctggaagaataaggagctgaaatgcggaagcggcatttttatcaccgacaacgtgcacacatggaccgaacagtataagttccaacctgagtccccctctaaactcgccagcgccattcagaaggctcaggaagaggggatctgtggcattcggtccgttacaagactggagaatcttatgtggaaacagatcacgccggaactgaaccacatcctcgccgagaatgaagtgaagctgaccattatgacaggagatatcaaaggcattatgcaagctgggaagcgctctctgcggcctcagcccaccgagcttaagtacagctggaaaacatggggaaaggccaaaatgctctccaccgaaagccataaccagacgtttctgatcgacggccctgagaccgcggagtgccccaatacaaacagagcctggaactctctggaagtcgaggattatgggttcggagtgtttaccacaaacatttggctcaagctgaaagaaaagcaggacgctttctgtgactccaaacttatgagcgccgctatcaaagataatcgcgccgttcacgcggacatgggctactggatcgagtctgccctgaacgatacctggaagattgagaaggctagcttcatcgaagtgaagaattgccattggcctaaaagccacacactctggtctaacggcgtcctggagagcgaaatgattatccccaagaacctggccgggccggtgtcccaacacaattatcggcctggataccatacccagattgctggcccctggcaccttgggaagctcgagatggactttgatttctgtgacggaacgacagtgatcgtcaccgaagattgcggcaacagagggcccagcctgcgcaccacaaccgcctctggaaaactgattacggagtggtgctgtcggtcctgcacactccctccgctgagataccggggcgaggacggctgttggtatgggatggaaatccgcccccttaaggagaaagaagagaatctggttaacagcctcgtgaccgccggacatggccaggtggataatttttccctgggggtcctgggaatggctcttttcctcgaagagatgctgagaacacgggtgggcaccaagcacgcgatcctgctcgttgccgtgtcttttgtcacactgattaccgggaacatgagcttcaaagaccttggaagagtggttgtgatggtcggcgctacgatggccgatgacatcggcatgggggtgacctacctggccctcctggctgcctttaaggttcgccctacattcgcggctggactgcttctgcggaagctcacctccaaagagctgatgatgacaaccattggcatcgtgctcctgtctcaaagcacgattcccgaaacagtccttgagctgaccgatgccctcgccctggggatgatggtgctgaagatcgtgagaaatatggaaaaatatcagcttgctgtcacaatcatggccattctgtgcgttcctaacgcggtggtgctccagaatgcttggaaggtctcctgtaccatcctggccgtggtttctgtgagccccctcctgcttacctccagccagcagaaaaccgactggattcctctggccctcacgatcaagggactgaaccccaccgctatttttctgacaaccctttctcgcacaaataaaaagagatcctggccgctgaacgaggccatcatggctgtcggcatggtgagcatcctcgcctcttccctgctcaagaatgacattcctatgaccgggcccctggttgcgggaggccttctgacggtgtgctacgtcctgacaggccggagcgccgatctcgaactggagcgcgctaccgacgtgaaatgggaggatcaggccgaaatctctgggtccagccctattctttccatcaccattagcgaggacggatctatgagcatcaagaacgaagaggaggaacagacactgaccattctcatcagaacaggcctgctcgtcatctccgggctgttccccatttctatcccgattacggctgccgcctggtatctttgggaggtgaaaaagcagcgggctggagttctgtgggatgtgccttctccccctcccatgggcaaagcggaactggaggacggggcctaccgcatcaagcaaaagggcattctcggatattcccagatcggcgctggggtctacaaagaaggaacctttcatacaatgtggcacgtgaccagaggcgccgttctgatgcacaaggggaaacggatcgagccctcctgggccgatgtgaagaaagaccttattagctacggaggcgggtggaagctggagggagaatggaaggagggcgaagaggtccaggtgctcgctctggaacctggcaaaaatccgcgcgccgtgcagacaaagcccgggctgttcaaaaccaacacgggaaccatcggcgcggtttccctggatttttctcctgggacaagcggatcccccattatcgacaagaaaggcaaggtcgtggggctttatggaaacggcgtggtcaccagaagcggcgcttacgtgtctgccattgcccaaacagagaagtccatcgaggataatcctgaaatcgaggacgatattttccggaaacgcagactgaccatcatggacctgcatcccggggctggaaagacaaaacggtatctccctgccattgttagagaagcgatcaagcgcggcctgcggacgcttattctggctccgaccagagtggtcgccgccgagatggaagaggctctccgcgggctgcccatccggtaccagacccctgccattaaagctgagcacaccggaagagaaatcgtggacctcatgtgtcatgccaccttcacaatgcgcctgcttagccccgttcgggtgcctaactataatctgatcattatggatgaggcgcactttacggaccccgcctctatcgctgccagaggctacatttccacccgcgtcgaaatgggggaggctgccggcatcttcatgacagccaccccgcctggaagccgggatccctttccccagtccaacgctcctattatcgacgaggaaagagagatccccgaacggtcttggaatagcggccatgagtgggtgacagatttcaaggggaagaccgtttggtttgtgccttccattaaagcgggaaacgacatcgccgcttgcctgcgcaagaatggcaaaaaggtcattcaactcagcagaaaaacgttcgattctgaatatgtgaagacacggaccaacgactgggattttgtggtcaccacagacatctccgagatgggggccaatttcaaagccgagcgcgttattgatccgagacggtgtatgaagcccgtgatcctgaccgacggagaagagagagtgatccttgctggccctatgcccgtcacacacagctctgccgcgcagcgccgggggagaattggccgcaaccctaagaatgaaaacgaccagtacatctacatgggagagcccctggaaaatgatgaggactgcgctcactggaaagaggccaagatgctcctggataacattaataccccggaaggcatcattcctagcatgtttgagcccgaacgggagaaagtggacgccatcgatggggaatatagactgcgcggagaggctcggaagacgttcgttgacctcatgagacgcggcgatcttcctgtgtggctggcctacaaagtcgcggccgaggggattaactatgctgacagacggtggtgttttgatggaatcaagaacaatcagatcctggaagagaacgtggaagttgagatttggacaaaggagggcgaacgcaaaaagctcaaacccagatggctggacgcccggatctactccgatcctcttgctctgaaggagttcaaagagttcgccgctgggcgcaagtctctcaccctgaatctgattacagagatgggcagactccccacctttatgacgcaaaagacccgggacgcccttgataacctggcggtgctgcatacagccgaagctggaggcagagcctataatcacgctctcagcgagctgccggagacccttgaaacactgctcctgctgaccctccttgccacagtcaccgggggaatcttcctgtttctgatgtccggccgcgggattggaaaaatgacgctcggcatgtgctgcatcatcacagcctctattctgctttggtacgctcagatccagcctcattggattgcggccagcatcattctggagttctttctcatcgtgctgctgatccccgaacccgagaagcagcggacccctcaagacaaccagctcacctatgtcgtgattgctatccttacagttgtggccgccaccatggctaatgaaatgggcttcctggagaaaacaaagaaagacctggggctcggatccattgccacgcagcagccggagagcaacatcctggatattgaccttagacccgcgtctgcctggaccctgtacgctgtggccacaacctttgtcacacctatgctccgccactccatcgaaaatagctccgttaacgtgtctctgaccgctattgccaatcaagcgacggtgctgatgggcctcgggaagggatggccccttagcaagatggatatcggcgtccctctgctggccatcgggtgttactcccaggtgaaccccattaccctcacagctgccctgcttctgctcgttgctcactatgccatcattggacctggcctgcaggctaaagccacccgggaggcgcagaagagagccgctgccggcatcatgaaaaatccgacagtggacgggattaccgtcatcgatctggaccccatcccttacgatcccaagttcgaaaaacaactcggacaggtgatgcttctgattctgtgcgtcacgcaggtcctcatgatgcggacaacctgggctctgtgtgaggcccttacactggccaccggccctatctctaccctctgggaagggaaccccggacgcttttggaatacaacgattgcggttagcatggctaacatcttcagaggctcctatctggccggggctggactgctctttagcattatgaagaataccacaaacacccggcgcggcacaggcaacatcggggagacccttggagagaaatggaagtctagactgaatgccctgggcaagtccgagttccaaatctacaaaaagagcgggattcaggaggtggaccggacgctcgccaaagaaggaatcaagcgcggcgagacagatcatcacgctgtctctagagggtccgccaaactgcggtggtttgtggagcgcaacatggttaccccggaaggaaaggtggtcgaccttggctgcggcagagggggatggagctattactgtggcgggctgaagaatgtgcgggaggtgaaaggactcaccaagggcgggcctggacatgaagaacccattcccatgtctacatatggctggaacctggttagactgcagagcggcgtcgatgtgttcttcatccctcccgaaaaatgcgacaccctcctttgtgatattggggagtcctctcctaatccgacagtggaggcgggacgcacgctgcgggtcctgaacctcgttgaaaattggctgaacaataacacccagttttgcatcaaggtgcttaatccctacatgcctagcgtgatcgagaaaatggaagccctgcaaagaaagtacggcggggctctcgtccgcaaccccctgtcccggaatagcacacacgagatgtattgggtgtccaacgcctctggaaatattgttagctccgtgaacatgatctctagaatgctgattaaccgcttcaccatgcggcataagaaagctacatacgaacctgacgtcgacctcggcagcgggaccagaaatatcggaattgagtccgagatccccaaccttgatattatcggcaagcgcatcgagaaaattaagcaggagcacgaaacgtcttggcactatgaccaggatcatccgtacaaaacctgggcctatcacggcagctacgagacaaagcagaccgggtccgcgagctctatggtgaatggagttgtgcggctgctgacaaagccttgggacgtcctccccaccgtgacacaaatggccatgaccgatacgacaccttttggccagcagagagtgttcaaagaaaaggtcgacacccgcacccaggagcccaaagaggggacaaagaaactgatgaagatcacggctaaatggctttggaaggaactgggaaagaaaaagacccctcggatgtgtacaagagaggaatttacccgcaaagttagatccaacgccgctctcggcgccattttcacagatgagaataagtggaaaagcgctcgggaggccgtggaagactctcgcttttgggagctggtggataaggaaagaaacctgcatctcgaggggaagtgcgaaacctgtgtctataatatgatgggaaaacgggagaagaaactgggcgagttcggcaaggcgaaagggtccagagccatctggtacatgtggcttggagctcggtttctggagttcgaggccctcggctttctgaacgaagaccactggttcagccgcgaaaattctctttccggggtggaaggagagggcctgcacaagctcgggtacattctgagagatgttagcaagaaagagggcggagctatgtatgccgacgacacagccggctgggatacccggatcacgctggaagacctcaagaacgaggaaatggtgaccaatcatatggagggggaacacaaaaagctggcggaggctatctttaaacttacataccaaaacaaggtcgtgcgcgttcagagacccaccccgcggggaacagtgatggatattatctcccgcagagaccagcggggcagcgggcaagtcggaacctatggcctgaatacgttcacaaacatggaggcccagctcattcgccagatggaaggggagggcgtgttcaagaatatccagcatctgaccgttacagaagaggtggccgtccaaaactggcttgctagagtgggacgggagcgcctgtctagaatggccattagcggcgatgactgcgtcgtgaaacctctcgatgaccggtttgctaacgccctgaccgcgctgaatgatatggggaagatccgcaaagacatccagcagtgggaaccctccaagggatggaacgattggacgcaggttcccttctgctctcaccattttcacgagctcattatgaaagacggcagagtgctggtcgtgccttgtcggaatcaagatgaacttatcgggagagcccgcattagccagggagctggctggtccctgcgggagaccgcctgcctcgggaagtcttacgctcagatgtggagcctgatgtatttccacagacgcgaccttcggctggccgcgaacgccatctgttccgctgtgccgtctcattgggttcccacaagcagaaccacatggtccattcacgccaagcatgaatggatgaccacagaggacatgctcaccgtgtggaatcgcgtctggatccgggagaacccttggatggaagataaaacgcccgtggagagctgggaagagattccttacctgggcaagagagaagaccagtggtgcggatctctgatcggcctcacatcccgcgctacctgggccaaaaatatccaagctgccattaaccaggttcggagcctgatcgggaatgaggagtataccgattacatgccctctatgaagagatttcgccgggaagaggaagaggcgggagtgctttggtga

SEQ ID NO: 20125 - RNA, 9876 nt, synthetic construct
  misc_feature 1..9876: note = derived and/or modified CDS sequence (opt5) from DENV-2__EU482775__SS-prME
  source 1..9876: mol_type = other RNA
agcgccggaatgatcattatgctgatccccacagtgatggctttccacctgacgacgagaaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatccgcggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttattaccgggaacatgagctttaaggacctgggacgcgtggttgtgatggtcggcgctacgatggccgatgacatcggcatgggggtgacctatctcgccctgctggctgccttcaaagttcggcctacatttgcggctggacttctgctcagaaagctgacctccaaggagctcatgatgacaaccattggcatcgtgctgctttctcaaagcacgattcccgaaacagtcctggagctcaccgatgccctggccctggggatgatggtgcttaaaatcgtgcgcaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctagaacaaataagaaacggtcctggccgctcaacgaggccatcatggctgtgggcatggtcagcattctggcctcttccctcctgaagaatgacatccctatgaccgggccccttgtggcgggaggcctgctgacggtttgctatgtgctcacaggccgcagcgccgatctggaacttgagagagctaccgacgtcaagtgggaggatcaggccgaaatttctgggtccagccctatcctgtccattaccatcagcgaggacggatctatgagcattaaaaacgaagaggaggaacagacactcaccatcctgatccggacaggcctcctggtgatttccgggctttttcccatctctattccgatcacggctgccgcctggtacctgtgggaggtcaagaaacagcgcgctggagtgctgtgggatgttccttctccccctcccatgggcaaggcggaactcgaggacggggcctatagaattaaacaaaagggaatcctgggctactcccagatcggcgctggggtgtacaaggaaggaaccttccacacaatgtggcatgtcacccggggcgccgtgcttatgcacaaagggaagcgcattgagccctcctgggccgatgttagaaaagacctgatcagctatggaggcgggtggaagctcgagggagaatggaaagagggcgaagaggtgcaggtcctggctctcgaacctggcaagaatccgcgggccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccgcagcggcgcttatgtctctgccatcgcccaaacagagaaatccatcgaggataatcctgaaattgaggacgatatctttagaaagcggagactgaccattatggacctccaccccggggctggaaagacaaaacgctacctgcctgccatcgtgcgggaagcgattaagagaggccttcgcacgctgatcctcgctccgacccgggttgtggccgccgagatggaagaggctctgagagggctccccattcgctatcagacccctgccatccgggctgagcataccggaagagaaatcgtcgacctgatgtgtcacgccaccttcacaatgcgccttctgagccccgtgcgggttcctaactacaatctgattatcatggatgaggcgcatttcacggaccccgcctctattgctgccagaggctatatctccacccgggtggaaatgggggaggctgccggcatttttatgacagccaccccgcctggaagccgcgatcccttcccccagtccaacgctcctatcatcgacgaggaaagagagattcccgaacggtcttggaatagcggccacgagtgggtcacagattttaaagggaagaccgtgtggttcgttccttccatcaaagcgggaaacgacattgccgcttgcctccgcaagaatggcaagaaagtgatccaactgagcagaaagacgtttgattctgaatacgtcaaaacacggaccaacgactgggatttcgtggtgaccacagacatttccgagatgggggccaattttaaggccgagagagtcatcgatccgcgccggtgtatgaaacccgttatccttaccgacggagaagagagagtgattctggctggccctatgcccgtgacacatagctctgccgcgcagcgccgggggagaatcggccgcaaccctaagaatgaaaacgaccagtacatttatatgggagagcccctcgaaaatgatgaggactgcgctcactggaaagaggccaagatgctgctggataacatcaataccccggaaggcattatccctagcatgttcgagcccgaacgggagaaggtcgacgccattgatggggaatacagactccgcggagaggctagaaaaacgtttgtggaccttatgcggcgcggcgatctgcctgtttggctggcctataaggtggcggccgaggggatcaactacgctgacagacggtggtgtttcgatggaatcaaaaacaatcagattctcgaagagaacgtcgaagtggagatctggacaaaggagggcgaacgcaaaaagctgaagcccagatggcttgacgcccggatttattccgatcctctggctctcaaagagtttaaggagttcgccgctgggagaaaatctctgaccctgaatctcatcacagagatgggccgccttcccaccttcatgacgcaaaagacccgggacgccctggataacctggcggttctccacacagccgaagctggaggcagagcctacaatcatgctctgagcgagcttccggagaccctggaaacactcctgctgctcacccttctggccacagtgaccgggggaatttttctgttcctcatgtccggccgcgggatcggaaaaatgacgctgggcatgtgctgcatcattacagcctctatccttctgtggtatgctcagattcagcctcactggatcgcggccagcattatcctcgagtttttcctgatcgtcctgctcattcccgaacccgagaagcagcggacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgagacccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaagccacccgcgaggcgcagaagagagccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgcggacaacctgggctctttgtgaggccctgacactcgccaccggccctatttctaccctgtgggaagggaaccccggacgcttctggaatacaacgatcgcggtgagcatggctaacatttttagaggctcctacctggccggggctggactccttttcagcatcatgaaaaataccacaaacacccggcgcggcacaggcaacatcggggagaccctgggagagaagtggaaatctagactgaatgccctcggcaagtccgaatttcaaatttataaaaagagcgggatccaggaggttgaccggacgctggccaaggaaggaattaaacgcggcgagacagatcaccatgctgtgtctagagggtccgccaaacttcggtggttcgtcgagagaaacatggtgaccccggaaggaaaagttgtggacctgggctgcggccgcgggggatggagctactattgtggcgggctcaagaatgtccgggaggtgaaaggactgaccaagggcgggcctggacacgaagaacccatccccatgtctacatacggctggaacctggtgagactccagagcggcgttgatgtctttttcattcctcccgaaaagtgcgacacccttctgtgtgatatcggggagtcctctcctaatccgacagtggaggcgggacgcacgctgcgggtgctcaacctggtcgaaaattggcttaacaataacacccagttctgcatcaaagttctgaatccctacatgcctagcgtgattgagaagatggaagccctccaaagaaaatatggcggggctctggtgcgcaaccccctgtcccggaatagcacacatgagatgtactgggtctccaacgcctctggaaatatcgtgagctccgttaacatgatttctagaatgctcatcaaccgctttaccatgcggcacaagaaagctacatatgaacctgacgtggaccttggcagcgggaccagaaatattggaatcgagtccgagattcccaacctggatatcatcggcaagcgcattgaaaagatcaaacaggagcatgaaacgtcttggcactacgaccaggatcacccgtataagacctgggcctaccatggcagctatgagacaaaacagaccgggtccgcgagctctatggtcaatggagtggttcggctgctcacaaagccttgggacgtgctgcccaccgtcacacaaatggccatgaccgatacgacacctttcggccagcagagagtgtttaaagaaaaggtggacacccgcacccaggagcccaaggaggggaccaagaaacttatgaaaattacggctgaatggctgtggaaggagctcggcaagaagaaaacccctagaatgtgtacacgggaagagttcacccgcaaggtcagatccaacgccgctctgggcgccatctttacagatgagaataagtggaaaagcgctcgggaagccgttgaggactctagattctgggaactggtggataaggagcggaacctccacctggaagggaaatgcgagacctgtgtgtacaatatgatgggaaagcgcgagaagaaacttggcgaatttggcaaagcgaaagggtccagagccatttggtacatgtggctgggagctcggttcctcgagtttgaagccctgggcttccttaacgaggaccattggtttagccgcgaaaattctctgtccggggtcgagggagagggcctccacaagctggggtatatcctgagagatgtgagcaaaaaggaaggcggagctatgtacgccgacgacacagccggctgggatacccggatcacgctcgaggacctgaaaaacgaagagatggttaccaatcacatggaaggggagcataagaaacttgcggaggctattttcaaactgacatatcaaaacaaggtggtccgcgtgcagagacccaccccgcggggaacagttatggatatcatttcccgcagagaccagcggggcagcgggcaagtgggaacctacggcctcaatacgtttacaaacatggaagcccagctgatccgccagatggagggggaaggcgtcttcaaaaatattcagcaccttaccgtgacagaggaggttgccgtgcataactggctggctagagtcggacgggaacgcctctctagaatggccatcagcggcgatgactgcgtggtcaagcctctggatgaccggttcgctaacgccctgaccgcgctcaatgatatggggaaaatcagaaaggacattcaacagtgggagccctccaagggatggaacgattggacacaggtgcccttttgctctcaccatttccacgaactgatcatgaaagacggccgcgttcttgtggtcccttgtcggaatcaggatgagctgattgggagagcccgcatcagccaaggagctggctggtccctccgggaaaccgcctgcctggggaagtcttatgctcagatgtggagccttatgtactttcacagacgcgacctgcggctcgccgcgaacgccatttgttccgctgtgccgtctcattgggtgcccacaagcagaaccacatggtccatccacgccaaacatgagtggatgaccacagaggacatgctgaccgtttggaatcgcgtgtggattcgggaaaacccttggatggaggataagacgcccgtcgaaagctgggaggaaatcccttatctgggcaaaagagaggaccagtggtgcggatctctcatcggcctgacatcccgcgctacctgggccaagaatattcaggctgccatcaaccaagtgcggagccttattgggaatgaggaatacaccgattacatgccctctatgaagagattccggagagaggaagaggaagcgggagttctgtggtga

SEQ ID NO: 20126 - RNA, 9876 nt, synthetic construct
  misc_feature 1..9876: note = derived and/or modified CDS sequence (opt5) from DENV-2__EU482776__SS-prME
  source 1..9876: mol_type = other RNA
agcgccggcatgatcattatgctgatccccaccgtcatggctttccacctgacaacgagaaatggggaacctcatatgattgtcggaatccaggaaaagggcaagagcctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatccgcggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttattaccgggaacatgagctttaaggacctgggacgcgtggttgtgatggtcggcgctacgatggccgatgacatcggcatgggggtgacctatctcgccctgctggctgcctacaaagttcggcctacattcgcggctggacttctgctcagaaagctgacctccaaggagctcatgatgacaaccattggcatcgtgctgctttctcaaagcacgattcccgaaacagtcctggagctcaccgatgccctggccctggggatgatggtgcttaaaatcgtgcgcaatatggaaaagtatcagctggctgtcacaatcatggccattctctgcgttcctaacgcggtgatcctgcagaatgcttggaaagcctcctgtaccattctcgccgtggtctctgtgagccccctgcttctgacctccagccagcaaaagacagactggatccctctcgctctgacgattaaaggactgaaccccaccgccatctttcttacaaccctgtctagaacaaataagaaacggtcctggccgctcaacgaggctatcatggccgttggcatggtgagcattctggcgtcttccctcctgaagaatgacatccctatgaccgggccccttgtcgccggaggcctgctgacggtgtgctacgttctcacaggccgcagcgctgatctggaacttgagagagccaccgacgtgaagtgggaggatcaggctgaaatttctgggtccagccctatcctgtccattaccatcagcgaggacggatctatgagcattaaaaacgaagaggaggaacagacactcaccatcctgatccggacaggcctcctggtcatttccgggcttttccccatctctattccgatcacggccgccgcttggtatctgtgggaggtgaagaaacagcgcgcgggagtcctgtgggatgtgccttctccccctcccatgggcaaggccgaactcgaggacggggcttacagaattaaacaaaagggaatcctgggctactcccagatcggcgccggggtttataaggaaggaacctttcacacaatgtggcatgtgacccggggcgccgtccttatgcacaaagggaagcgcattgagccctcctgggctgatgtgaaaaaggacctgatcagctacggaggcgggtggaaactcgagggagaatggaaggagggcgaagaggttcaggtgctggccctcgaacctggcaagaatccgagagcggtccagacaaaacccgggctgttcaagaccaacacgggaaccattggcgctgtgtcccttgatttttctcctgggacaagcggatcccccatcattgacaaaaagggcaaagtggttgggctgtatggaaacggcgtcgtgacccggagcggcgcctacgtgtctgccatcgctcaaacagagaagtccatcgaggataatcctgaaattgaggacgatatcttccgcaagagacggctgaccattatggacctccaccccggggccggaaaaacaaagagatatctgcctgcgatcgtccgcgaagctattaaacggggccttagaacgctgatcctcgccccgacccgcgtggttgccgctgagatggaagaggccctgcgggggctccccattagataccagacccctgctatccgcgccgagcataccggacgggaaatcgtggacctgatgtgtcacgcgacctttacaatgagacttctgagccccgtccgcgtgcctaactataatctgattatcatggatgaggcccatttcacggaccccgcttctattgccgctcggggctacatctccaccagagttgaaatgggggaggccgccggcattttcatgacagctaccccgcctggaagccgggatccctttccccagtccaacgcgcctatcatcgacgaggaacgcgagattcccgaaagatcttggaatagcggccacgagtgggtgacagatttcaaggggaaaaccgtctggtttgtgccttccatcaaggccggaaacgacattgctgcctgcctccggaagaatggcaaaaaggttatccaactgagccgcaaaacgttcgattctgaatacgtgaagacaagaaccaacgactgggattttgtcgtgaccacagacatttccgagatgggggccaatttcaaagctgagcgggtgatcgatccgagacgctgtatgaagcccgtcatccttaccgacggagaggaacgggttattctggccggccctatgcccgtgacacatagctctgcggctcagagacgcgggcggatcggcagaaaccctaaaaatgaaaacgaccagtatatttacatgggagagcccctcgaaaatgatgaggactgcgcccactggaaggaggccaagatgctgctggataacatcaataccccggaaggcattatccctagcatgtttgagcccgaacgcgagaaagtggacgctattgatggggaatatcggctcagaggagaggcccgcaagacgttcgtcgaccttatgagacggggcgatctgcctgtgtggctggcgtacaaagttgccgctgaggggatcaactatgccgaccgcagatggtgttttgatggaatcaagaacaatcagattctcgaagagaacatggaagtggagatctggacaaaagagggcgaacggaagaagctgaaaccccgctggcttgacgctagaatttactccgatcctctggccctcaaggagttcaaagaatttgctgccgggcggaagtctctgaccctgaatctcatcacagagatgggcagacttcccaccttcatgacgcagaagacccgcgacgcgctggataacctggccgtcctccacacagctgaagccggaggccgggcttataatcatgccctgagcgagcttccggagaccctggaaacactcctgctgctcacccttctggccacagtgaccgggggaattttcctgtttctcatgtccggcagagggatcggaaagatgacgctgggcatgtgctgcatcattacagcttctatccttctgtggtacgcgcagattcagcctcactggatcgccgctagcattatcctcgagttctttctgatcgttctgctcattcccgaacccgagaagcagcgcacccctcaagacaaccagcttacctacgtggtcatcgccattctgacagtggtcgccgctaccatggccaatgaaatgggcttcctggagaaaacaaagaaagacctcgggctgggatccatcgcgacgcagcagccggagagcaacattcttgatatcgacctgcggcccgcctctgcttggaccctctatgccgtggctacaacctttgttacacctatgctgagacattccattgaaaatagctccgtgaacgtgtctctgaccgccatcgcgaatcaagccacggtcctcatgggccttgggaagggatggcccctgagcaaaatggatatcggcgttcctctgctcgctattgggtgttactcccaggtgaaccccatcaccctgacagccgcccttctgctcctggtggcccactatgctattatcggacctggcctgcaggccaaggcgacccgggaggcccagaagcgcgctgccgctggcattatgaaaaatccgacagtcgacgggatcaccgtgatcgatctcgaccccattccttacgatcccaagttcgaaaaacaacttggacaggttatgctgctgatcctctgcgtgacgcaggtcctgatgatgagaacaacctgggccctttgtgaggccctgacactcgcgaccggccctatttctaccctgtgggaagggaaccccggacggttttggaatacaacgatcgctgtgagcatggccaacattttccgcggctcctatctggctggggccggactcctttttagcatcatgaagaataccacaaacaccagacggggcacaggcaacatcggggagaccctgggagagaaatggaagtctcgcctgaatgccctcggcaaatccgagttccaaatttacaaaaagagcgggatccaggaggtcgacagaacgctggctaaagaaggaattaagcggggcgagacagatcaccatgccgtgtctcgcgggtccgcgaaacttagatggtttgttgagcggaacatggtgaccccggaaggaaaggtcgtggacctgggctgcggcagagggggatggagctattactgtggcgggctcaaaaatgttcgcgaggtgaagggactgaccaagggcgggcctggacacgaagaacccatccccatgtctacatacggctggaacctggtccggctccagagcggcgtggatgtgttctttattcctcccgaaaaatgcgacacccttctgtgtgatatcggggagtcctctcctaatccgacagttgaggccggaagaacgctgcgcatcctcaacctggtcgaaaattggcttaacaataacacccagttctgcattaaggtgctgaatccctatatgcctagcgtgatcgagaaaatggaagctctccaacggaagtacggcggggccctggtcagaaaccccctgtcccgcaatagcacacatgagatgtattgggtttccaacgcttctggaaatattgtgagctccgtgaacatgatctctcggatgctcattaacagattcaccatgcgccacaaaaaggccacatacgaacctgacgtcgaccttggcagcgggacccggaatatcggaattgagtccgagatccccaacctggatatcattggcaagagaatcgagaagattaagcaggagcatgaagcgtcttggcactatgaccaggatcacccgtacaaaacgtgggcctatcatggcagctacgagaccaagcagacagggtccgctagctctatggtgaatggagttgtgcgcctgctcaccaaaccttgggacgtcctgcccacagtgacccaaatggccatgacagataccacgccttttggccagcagcgggttttcaaggaaaaggtggacacaagaacccaggagcccaaagaggggaccaagaaacttatgaagatcacagctgaatggctgtggaaagagctcggaaagaaaaagacgcctcgcatgtgtaccagagaagagtttacacggaaggtccgctccaacgccgctctgggcgccattttcaccgatgagaataaatggaaaagcgcgagagaagccgtggaggactctcggttttgggaactggtggataaagagagaaacctccacctggaagggaagtgcgagacatgtgtctacaatatgatgggaaaacgggagaagaaacttggcgagttcggcaaagctaaggggtcccgcgccatctggtatatgtggctgggagctagatttctcgagttcgaagccctgggctttcttaacgaggaccattggttcagccgggaaaattctctgtccggggttgagggagagggcctccacaaactggggtacatcctgcgcgatgtgagcaagaaagaaggcggagccatgtatgcggacgacaccgctggctgggatacaagaattaccctcgaggacctgaagaacgaagagatggtgacgaatcacatggaaggggagcataagaaacttgccgaggccatctttaagctgacctaccaaaacaaagtcgtgcgggttcagcgccccacaccgagaggaaccgtgatggatattatctcccggcgcgaccagagaggcagcgggcaagtcggaacatatggcctcaataccttcacgaacatggaagctcagctgattcggcagatggagggggaaggcgtgtttaagaatatccagcaccttacagttaccgaggaggtggccgtccataactggctggctcgcgtgggatgcgaaagactctctcggatggccatcagcggcgatgactgcgttgtgaaacctctggatgaccgcttcgcgaacgccctgacagctctcaatgatatggggaagattagaaaggacatccaacagtgggagccctccaaaggatggaacgattggacccaggtccccttctgttctcaccattttcacgaactgattatgaaggacggccgggtgcttgtcgtgccttgcagaaatcaggatgagctgatcgggcgcgcccggattagccaaggagctggctggtccctcagagaaacggcctgtctggggaaatcttacgcgcagatgtggagccttatgtatttccaccgccgggacctgagactcgccgctaacgccatctgctccgctgttccgtctcattgggtgcccaccagccgcacaacctggtccattcacgccaagcatgagtggatgacaaccgaggacatgctgacagtctggaatcgggtgtggatcctggaaaacccttggatggaggataaaacccccgtggaaagctgggaggaaatcccttacctcggcaagagagaggaccagtggtgtggatctctgattggccttacgtcccgcgctacatgggccaagaatatccaggcggccattaaccaagttcggagcctgatcgggaatgaggaatacaccgattatatgccctctatgaaaagatttcgccgggaggaagaggaagctggagtgctctggtga

SEQ ID NO: 20127 - RNA, 9876 nt, synthetic construct
  misc_feature 1..9876: note = derived and/or modified CDS sequence (opt5) from DENV-2__EU482777__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagacggactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccgatcacggctgccgcctggtacctgtgggaggtcaaaaagcagcgggctggagtgctgtgggatgttccttctccccctcccatgggcaaagcggaactcgaggacggggcctatcgcattaagcaaaagggaatcctgggctactcccagatcggcgctggggtgtacaaagaaggaaccttccacacaatgtggcatgtcaccagaggcgccgtgcttatgcacaaggggaaacggattgagccctcctgggccgatgttaagaaagacctgatcagctatggaggcgggtggaagctcgagggagaatggaaggagggcgaagaggtgcaggtcctggctctcgaacctggcaaaaatccgcgcgccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgaccagaagcggcgcttatgtctctgccatcgcccaaacagagaagtccatcgaggataatcctgaaattgaggacgatatctttcggaaacgcagactgaccattatggacctccaccccggggctggaaagacaaaacggtacctgcctgccatcgtgagagaagcgattaagcgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaagggaagaccgtgtggttcgttccttccatcaaggcgggaaacgacattgccgcttgcctccgcaaaaatggcaagaaagtgatccaactgagccggaagacgtttgattctgaatacgtcaaaacacgcaccaacgactgggatttcgtggtgaccacagacatttccgagatgggggccaattttaaggccgagagagtcatcgatccgcggagatgtatgaaacccgttatccttaccgacggagaggaacgcgtgattctggctggccctatgcccgtgacacatagctctgccgcgcagcggagagggcgcatcggccggaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaaagagagaaggtcgacgccattgatggggaataccgcctccggggagaggctagaaaaacgtttgtggaccttatgcgcagaggcgatctgcctgtttggctggcctataaggtggcggccgaggggatcaactacgctgaccggcgctggtgtttcgatggaatcaaaaacaatcagattctcgaagagaacgtcgaagtggagatctggacaaaggagggcgaaagaaagaaactgaagccccggtggcttgacgcccgcatttattccgatcctctggctctcaaagagtttaaggagttcgccgctgggagaaaatctctgaccctgaatctcatcacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagagaacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaaacgggccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcatgaaaaataccacaaacacccgcagaggcacaggcaacatgggggagaccctgggagagaagtggaaatctcggctgaatgccctcggcaagtccgaatttcaaatctataagaaaagcgggattcaggaggttgaccgcacgctggccaaggaaggaatcaaaagaggcgagacagatcaccatgctgtgtctcgggggtccgccaaacttcgctggttcgtcgagagaaacatggtgaccccggaaggaaaagttgtggacctgggctgcggcagagggggatggagctactattgtggcgggctcaagaatgtccgggaggtgaagggactgaccaaaggcgggcctggacacgaagaacccattcccatgtctacatacggctggaacctggtgcgcctccagagcggcgttgatgtctttttcatccctcccgaaaagtgcgacacccttctgtgtgatattggggagtcctctcctaatccgacagtggaggcgggacggacgctgagagtgctcaacctggtcgaaaattggcttaacaataacacccagttctgcatcaaagttctgaatccctacatgcctagcgtgatcgagaagatggaagccctccaacgcaaatatggcggggctctggtgcggaaccccctgtccagaaatagcacacatgagatgtactgggtctccaacgcctctggaaatattgtgagctccgttaacatgatctctcgcatgctcattaaccggtttaccatgagacacaagaaggctacatatgaacctgacgtggaccttggcagcgggacccgcaatatcggaattgagtccgagatccccaacctggatattatcggcaaacggatcgaaaagattaaacaggagcatgaaacgtcttggcactacgaccaggatcacccgtataagacctgggcctaccatggcagctatgagacaaaacagaccgggtccgcgagctctatggtcaatggagtggttagactgctcacaaagccttgggacgtgctgcccaccgtcacacaaatggccatgaccgatacgacacctttcggccagcagcgcgtgtttaaggaaaaagtggacacccggacccaggagcccaaggaggggaccaagaaacttatgaaaatcacggctgaatggctgtggaaggagctcggcaaaaagaagacccctagaatgtgtacacgcgaagagttcaccagaaaagtccggtccaacgccgctctgggcgccatttttacagatgagaataagtggaaaagcgctcgcgaagccgttgaggactctagattctgggaactggtggataaggagcggaacctccacctggaagggaaatgcgagacctgtgtgtacaatatgatgggaaagagagagaagaaacttggcgaatttggcaaggcgaaagggtcccgggccatctggtacatgtggctgggagctcgcttcctcgagtttgaagccctgggcttccttaacgaggaccattggtttagcagagaaaattctctgtccggggtcgagggagagggcctccacaagctggggtatattctgcgggatgtgagcaaaaaggaaggcggagctatgtacgccgacgacacagccggctgggatacccgcatcacgctcgaggacctgaagaacgaagagatggttaccaatcacatggaaggggagcataagaaacttgcggaggctatcttcaaactgacatatcaaaacaaagtggtcagagtgcagcggcccaccccgcgcggaacagttatggatattatctccagacgggaccagcgcggcagcgggcaagtgggaacctacggcctcaatacgtttacaaacatggaagcccagctgattagacagatggagggggaaggcgtcttcaaaaatatccagcaccttaccgtgacagaggaggttgccgtgcaaaactggctggctcgggtcggacgcgaaagactctctcggatggccattagcggcgatgactgcgtggtcaagcctctggatgaccgcttcgctaacgccctgaccgcgctcaatgatatggggaagatcagaaaagacatccagcagtgggagccctccaagggatggaacgattggacacaggtgcccttttgctctcatcacttccatgaactgattatgaaagacggccgggttcttgtggtcccttgtagaaatcaagatgagctgatcgggcgcgcccggattagccagggagctggctggtccctcagagaaaccgcctgcctggggaagtcttatgctcagatgtggagccttatgtactttcaccgccgggacctgagactcgccgcgaacgccatctgttccgctgtgccgtctcactgggtgcccacaagccgcaccacatggtccattcatgccaaacacgagtggatgaccacagaggacatgctgaccgtttggaatcgggtgtggatcagagaaaacccttggatggaggataagacgcccgtcgaaagctgggaggaaattccttatctgggcaagcgcgaggaccagtggtgcggatctctcatcggcctgacatcccgggctacctgggccaaaaatatccaagctgccattaaccaggtgagaagccttatcgggaatgaggaatacaccgattacatgccctctatgaagcgcttccggagagaggaagaggaagcgggagttctgtggtga

SEQ ID NO: 20128 - RNA, 9876 nt, synthetic construct
  misc_feature 1..9876: note = derived and/or modified CDS sequence (opt5) from DENV-2__EU482778__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagacagaggacggggttaatatgtgcaccctgatggcgatcgatctcggagaactgtgtgaggacacaattacctacaaatgcccccttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaggaacaggacaaacgctttgtgtgcaagcattccatggtggatagaggctggggcaacgggtgtggactgttcggcaaagggggcatcgttacctgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaaaattgccactggcccaagtcccataccctgtggagcaacggggtgctggaatctgagatgatcattcccaagagcttcgccggacctgtttcccagcacaactaccgccccggctattacacgcaaacagccgggccctggcatcttggaaagctcgaaatggattttgacttctgtgagggcaccaccgtggtcgtgacagaagattgcgggaatcggggacctagcctgagaaccacgacagcttctggcaaactgatcaccgagtggtgctgtcggtcctgcacactcccgcccctgcgctacagaggcgaggacgggtgttggtatggaatggaaattcggcctcttaaggagaaggaagagaacctggtgaatagcctcgtcaccgcgggccacgggcagatcgataacttttccctgggagttctgggcatggcccttttcctcgaagagatgctgagaacacgcgtggggaccaaacatgctatcctgctcgtggccgtctcttttgtgacgctgattaccggaaatatgagcttccgggaccttggcagagttatggtgatggtcggcgccgctatgacagatgacatcgggattggagtgacctacctggccctcctggcggcttttaaggttcgccccacattcgccgccggcctgcttctgagaaaactcacctccaaggagctgatgatggctacgatcgggattgccctcctgtctcagagcacaatccctgaaaccatccttgagctgacagatgcgctcgctctgggaatgatggtgctgaaaattgtccggaacatggaaaagtatcaacttgccgtgaccatcatggccatttcctgcgttcccaatgctgtgatcctgcagaacgcctggaaggtctcttgtaccattctcgctacagtgagcgtgtcccctctgctcctgacgagctctcagcagaaagccgactggatcccccttgcgctgaccatcaagggcctcaatccgacagccatttttctgaccacactgtcccgcaccagcaaaaagagatcttggcctcttaacgaggctatcatggccgtcgggatggtttccattctggctagctctctcctgaaaaatgacatccccatgacgggacctctcgtggccggcggcctgcttacagtgtgctacgtcctgaccgggcggtccgccgatctggaactcgagcgcgctaccgacgtgaagtgggaggatcaagcggaaattagcggatccagccccatcctgtctattacaatcgccgaggacggcagcatgtccatcaaaaacgaagaggaggaacagacccttacaattctgatcagaacggggctcctggttatttctggactcttcccggtgagcatccctattaccgctgccgcctggtatctgtgggaggtcaagaagcagcgggctggcgtgctttgggatgttccctcccctccgcccgtggggaaagccgaactggaggacggagcgtaccgcatcaagcagaaaggcatcctgggctattctcaaattggggctggagtctacaaggaaggcacatttcacaccatgtggcacgtgacaagaggggccgtcctcatgcatcggggaaaacgcatcgagcctagctgggccgatgtgaagaaggacctgatttcctacggcgggggatggaaacttgagggcgaatggaaggagggcgaagaggttcaggtgctggctctcgaaccggggaaaaatcccagagccgtccagaccaagcctggactgttcaaaacgaacaccggcacaatcggggcggtgtctctcgattttagccccggaacctccggcagccctattgttgacaagaaggggaaagtggtcggactgtatggcaatggcgtggtgacacggtctggggcttacgtttccgccatcgcccagaccgaaaagagcatcgaggataaccccgaaattgaggacgatatcttccgcaagaagcgccttacaattatggacctgcaccctggagctggcaaaacgaagcggtatctgccggccatcgtcagagaagctattaagcgcgggctccggaccctgatccttgcccccacaagagtggtggcggccgagatggaagaggctctgcgcggactccctattcggtaccaaacccccgccatcagagctgagcataccggccgcgaaatcgtcgacctgatgtgtcacgccacattcacgatgcggctcctgtctcctgtgagagttcccaactataatcttattatcatggatgaggcccattttaccgacccggcttccattgcggcccgggggtacatcagcacacgcgtggaaatgggcgaggctgccggaattttcatgaccgccacacctcccggctccagagatccctttcctcagtctaacgctcccatcatggacgaggaacgggagatccctgaacgcagctggaactccgggcacgagtgggtcaccgatttcaaaggaaagacggtgtggtttgttccgagcattaaagccggcaatgacatcgcggcttgcctgagaaagaatgggaaaaaggtgattcagctgtctcggaagacattcgattccgaatatgtcaaaaccagaaccaacgactgggattttgtggttacaaccgacatcagcgagatgggagccaatttcaaggccgagcgcgtgattgatccccggagatgtatgaaacctgtcatcctcacagacggcgaggagagagtgatcctggctgggcccatgcctgtgacccactctagcgccgcgcaacggagaggccgcattggacggaaccccaagaatgaaaacgaccagtacatctacatgggcgagccgcttgaaaatgatgaggactgcgcccattggaaagaggctaagatgctgctcgataacattaatacgcctgaagggatcattccctccatgtttgagcctgaaagagagaaagtcgacgccatcgatggagaatatcgcctgagaggcgaggctcggaagacattcgttgacctgatgcgcagaggggatctccccgtgtggcttgcctaccgggtggctgccgagggaattaactatgcggaccgcagatggtgttttgatggcgtcaagaataaccagatcctggaagagaacgtggaagttgagatctggaccaaagagggggaacggaagaaactgaagcctagatggctcgacgcccgcatttactctgatcccctggctcttaaagagttcaaggagttcgccgctggcagaaagagcctgacactcaatctgatcaccgagatgggaagactgccgacgtttatgacccagaaagcccgcgacgccctcgataaccttgctgtgctgcacacagcggaagccggcgggcgggcttataatcatgccctgtccgagctccctgagaccctggaaacacttctgctcctgaccctgctcgccacagtcaccggaggcattttcctttttctgatgtctgggaagggagtgggcaaaatgacgctgggcatgtgctgcatcattacagctagcatcctcctgtggcacgcccaaatccagccccactggattgcggcctccatcattcttgagttctttctgatcgttctcctgattcccgaacctgagaagcagagaaccccgcaggacaaccaactgacctacgtggtcatcgctatcctcacagtggtcgccgctaccatggccaatgaaatggggttccttgagaaaacaaagaaggacctgggactgggcagcattgcgacgcaggagcccgaatctaacatcctcgatattgacctgcggcctgcctccgcttggaccctttatgccgtggctacaacctttgttacacccatgctgcgccatagcatcgaaaattcctctgtgaacgtgagcctcaccgccattgctaatcaggccacggtcctgatggggctgggaaaaggctggcctctctccaagatggatatcggggttccccttctggcgattggatgttactctcaggtgaaccctatcaccctgacagccgctctcctgcttctggtggcccactacgctatcattggcccgggcctccaagccaaagccaccagagaagcgcagaagcgggctgccgctgggatcatgaaaaatcccacagtcgacggaattaccgtgatcgatctggaccctattccctatgatcctaagttcgagaagcagctgggccaggttatgctccttatcctgtgcgtgacgcaagtcctgatgatgcgcacaacctgggccctctgtgaagccctgacacttgctaccgggcccatcagcaccctgtgggagggaaacccgggcagattttggaatacaacgattgccgtgtccatggcgaacatcttccgggggagctacctcgccggagctggcctgctgttttctattatgaaaaataccacaaacacccgcagaggcacagggaatatcggagagaccctcggcgaaaagtggaaatcccggcttaacgccctgggaaagagcgagttccagatttataaaaagtctggaatccaggaagtcgaccgcacgctggctaaagagggcatcaagagaggggagacagatcatcacgccgtgtcccggggaagcgcgaagctcagatggtttgttgaacgcaacatggtgacccctgagggcaaagtcgtggacctgggctgcgggcggggaggctggtcttactattgtgggggacttaagaatgttagagaagtgaaaggcctgaccaaaggcgggcccgggcatgaggaacccgtccctatgagcacatacggctggaacctcgtgcgcctgcaatccggggtggatgttttcttcaccccgcctgagaaatgcgacacactgctctgtgatattggagagtctagcccgaatcccacgatcgaagccggccggacccttagagtcctgtccctggtggagaactggctcaataacgacacacagttttgcattaaggtgctgaatccttatatgcccagcgtcatcgaaaagatggagacccttcagcgcaaatacgggggagctctggttcggaaccctctctccagaaattctacacacgaaatgtactgggtgagcaacgccaccggcaatattgtgtcctctgtcaacatgatcagccgcatgctgatcaatcggttcacgatgaagcacaaaaaggctacctatgagcccgacgtggatctggggtccggaacaagaaacattggcatcgagtctgaaattccgaatctcgacatcattggcaaacgcatcgagaagattaagcaggaacatgagaccagctggcactacgatcaagaccatccttataaaacatgggcctaccacgggtcctatgaaaccaagcagacaggaagcgcttcttccatggttaacggcgtggtccggcttctgaccaaaccctgggatgtggttcctatggtgacgcagatggccatgacagacaccaccccctttgggcagcaaagagtcttcaaggagaaagtggatacacgcacgcaggagcctaaggaaggaaccaagaaactgatgaagatcacagcggagtggctctggaaagaactgggcaagaaaaagacccccagaatgtgtacacgggaggagtttacccgcaaagtgagaagcaacgccgctcttggggccatcttcacagacgaaaataagtggaagtctgctcgggaggccgtcgaagattccagattttgggagctggttgacaaagaacggaacctccacctggagggaaagtgcgagacctgtgtgtacaatatgatgggcaaacgcgaaaagaaactgggcgagttcgggaaggccaagggaagcagagcgatttggtatatgtggctcggcgctcggtttctggagttcgaggcccttgggtttctgaacgaagatcattggttctctcgcgaaaattccctcagcggagtggagggcgaagggctgcacaaacttggctacatcctgagagacgtctccaagaaagagggaggcgccatgtacgctgacgatacggccgggtgggacacccggattacactcgaagatctgaagaacgaggaaatggtgaccaatcatatggagggagagcacaaaaagctggctgaagccatctttaagctcacatatcagaacaaagttgtgcgcgtccagagaccgacccctcggggcacggtgatggacattatcagccgcagagatcaacgggggtctggacaggttggcacatacgggctgaataccttcacaaacatggaggcgcagcttatccgccaaatggaaggcgagggaattttcaagagcatccagcatctgaccgtgacggaggaaattgccgtccagaattggctcgctagagtgggccgggagcgcctgtccagaatggccatctctggggacgattgcgttgtgaaaccccttgacgatcggtttgctagcgccctgaccgcgctcaacgacatgggaaaggtcagaaaagatattcagcaatgggaaccctcccgcggctggaatgactggacacaggtgcctttctgctctcaccactttcatgagctgatcatgaaggatgggcgggtcctggtggttccgtgtagaaaccaggacgaactcatcggacgcgcccggattagccagggcgctgggtggtccctgaaggagaccgcctgccttggcaaatcttatgctcaaatgtggagcctgatgtacttccacagacgcgacctccggctggccgctaatgccatctgttccgcggtgcccagccattgggtccctacatctagaaccacatggtccattcacgccaagcacgagtggatgaccacggaagatatgcttacagtgtggaaccgcgtgtggatccaggagaacccctggatggaagacaaaacccctgttgagagctgggaagaggtgccctatctgggaaagcgggaggatcagtggtgcggctctctcattgggctgacctccagagctacatgggccaaaaatatccagaccgccattaaccaagtccgcagcctgatcggaaatgaagagtacacagactatatgccttccatgaagcggtttagacgggaagaggaagaggctggcgtgctctggtga

SEQ ID NO: 20129 - RNA, 9876 nt, synthetic construct
  misc_feature 1..9876: note = derived and/or modified CDS sequence (opt5) from DENV-2__EU482779__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtgacggtcagctttgtgaccctgattacaggaaacatgtccttccgggaccttggcagagttatggtgatggtcggcgccgccatgaccgatgacatcgggatgggagtgacatacctggctctcctggccgcgtttaaggttcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtcgggatggttagcatcctggcttcttccctcctgaaaaacgacattcccatgacgggacctctcgtggccggcggcctgcttacagtgtgctacgtcctgaccgggcggagcgccgatctggaactcgagcgcgctaccgacgtgaagtgggaggatcaagcggaaatctccggaagctctcccattctgagcatcacaattgccgaggacggctccatgtctatcaaaaatgaagaggaggaacagacccttacaatcctgattagaacggggctcctggttatcagcggactcttcccggtgtccattcctatcaccgctgccgcctggtatctgtgggaggtcaagaagcagcgggctggcgtgctttgggatgttccctctcctccgcccgtggggaaagccgaactggaggacggagcgtaccgcattaagcagaaaggcatcctgggctatagccaaatcggggctggagtctacaaggaaggcacatttcacaccatgtggcacgtgacaagaggggccgtcctcatgcatcggggaaaacgcattgagccttcctgggccgatgtgaagaaggacctgatctcttacggcgggggatggaaacttgagggcgaatggaaggagggcgaagaggttcaggtgctggctctcgaaccggggaaaaaccccagagccgtccagaccaagcctggactgttcaaaacgaataccggcacaattggggcggtgagcctcgatttttcccccggaaccagcggctctcctatcgttgaccggaaggggaaggtggtcggactgtatggcaacggcgtggtgacaagatccggggcttacgttagcgccattgcccagaccgagaaatctatcgaggataatcccgaaatcgaggacgatattttccgcaagaaacggcttacaatcatggacctgcaccctggagctggcaagacgaaaagatatctgccggccattgtccgcgaagctatcaagcgggggctcagaaccctgattcttgcccccacacgcgtggtggcggccgagatggaagaggctctgcggggactccctatcagataccaaacccccgccattcgcgctgagcataccggccgggaaatcgtcgacctgatgtgtcacgccacattcacgatgagactcctgtcccctgtgcgggttcccaactataaccttatcattatggatgaggcccattttaccgacccggctagcatcgcggcccgcgggtacatttccacaagagtggaaatgggcgaggctgccggaatcttcatgaccgccacacctcccggctctcgggatccctttcctcagagcaatgctcccattatggacgaggaacgcgagatccctgaaagatcctggaacagcgggcacgagtgggtcaccgatttcaagggaaaaacggtgtggtttgttccgtctatcaaggccggcaatgacattgcggcttgcctgcggaaaaacgggaagaaagtgatccagctgtccagaaagacattcgatagcgaatatgtcaagacccgcaccaatgactgggattttgtggttacaaccgacatttctgagatgggagccaacttcaaagccgagcgggtgatcgatcccagacgctgtatgaagcctgtcattctcacagacggcgaagaacgggtgatcctggctgggcccatgcctgtgacccacagctccgccgcgcaaagacgcggccggatcggaagaaatcccaaaaacgaaaatgaccagtacatttacatgggcgagccgcttgaaaacgatgaggactgcgcccattggaaggaggctaaaatgctgctcgataatatcaacacgcctgaagggattatcccctctatgtttgagcctgaacgcgagaaggtcgacgccattgatggagaatatagactgcggggcgaggctcgcaaaacattcgttgacctgatgagaagaggggatctccccgtgtggcttgcctaccgcgtggctgccgagggaatcaattatgcggacagacggtggtgttttgatggcgtcaagaacaatcagattctggaagagaacgtggaagttgagatctggaccaaggagggggaacgcaagaagctgaaacctcgctggctcgacgcccggatctacagcgatcccctggctcttaaggagttcaaagagttcgccgctggcagaaagtccctgacactcaacctgattaccgagatgggacgcctgccgacgtttatgacccagaaggcccgggacgccctcgataatcttgctgtgctgcacacagcggaagccggcgggagagcttataaccatgccctgtctgagctccctgagaccctggaaacacttctgctcctgaccctgctcgccacagtcaccggaggcatcttcctttttctgatgagcgggaaaggagtgggcaagatgacgctgggcatgtgctgcattatcacagcttccattctcctgtggtacgcccaaatccagccccactggatcgcggccagcattatccttgagttctttctgattgttctcctgatccccgaacctgagaaacagcggaccccgcaggacaatcaactgacctatgtggtcattgctatcctcacagtggtcgccgctaccatggccaacgaaatggggttccttgagaagaccaagaaggacctgggactgggctctatcgcgacgcaggagcccgaatccaatattctcgatatcgacctgcgccctgccagcgcttggaccctttacgccgtggctacaacctttgttacacccatgctgagacactccattgagaactctagcgtgaatgtgtccctcaccgccatcgctaaccaggccacggtcctgatggggctgggaaagggctggcctctctctaaaatggatattggggttccccttctggcgatcggatgttacagccaggtgaatcctattaccctgacagccgctctcctgcttctggtggcccattatgctatcatcggcccgggcctccaagccaaggccacccgggaagcgcagaaacgcgctgccgctgggattatgaagaaccccacagtcgacggagtgaccgttatcgatctggaccctattccctacgatcctaaattcgagaagcagctgggccaggtgatgctccttatcctgtgcgtcacgcaagtgctgatgatgagaacaacctgggccctctgtgaagccctgacacttgctaccgggcccatttccaccctgtgggagggaaatccgggccggttttggaacacaacgatcgccgtcagcatggcgaatatcttccgcgggtcttatctcgccggagctggcctgctgttttccattatgaagaacaccacaaataccagacggggcacagggaacatcggagagaccctcggcgaaaaatggaaaagccgccttaatgccctggggaaatctgagttccagatttacaagaaatccggaatccaggaagtggacagaacgctggctaaggagggcattaaaagaggggaaacagatcaccatgccgttagcagaggatctgcgaagctccgctggtttgtggaacggaacatggtcacccctgagggcaaggtggttgacctgggctgcgggagaggaggctggagctattactgtgggggacttaaagatgtgcgcgaagtcaagggcctgaccaaagggggacccggccacgaggaacccatccctatgtccacatatggctggaacctcgtgcggctgcaatctggggtggacgttttcttcacaccccctgagaagtgcgataccctgctctgtgacatcggagagagctccccgaatcccacgattgaagccggcagaacccttcgcgtcctgagcctggtggagaactggctcaataacgacacacagttttgcatcaaagtgctgaatccttacatgccctccgtcattgaaaagatggagacccttcagcggaagtacgggggagctctggttagaaaccctctctctcgcaatagcacacatgaaatgtattgggtgtccaacgccaccggcaatatcgtgtctagcgtcaacatgatttcccggatgctgatcaatagattcacgatgaaacacaagaaagctacctacgagcccgatgtggacctggggtctggaacacgcaacatcggcattgagagcgaaatcccgaatctcgatattatcggcaagcggattgagaaaatcaagcaggaacacgagacctcctggcattatgaccaagatcacccttacaagacatgggcctatcatgggagctacgaaaccaaacagacaggatctgcttccagcatggttaacggcgtggtcagacttctgaccaagccctgggacgtggttcctatggtgacgcagatggccatgacagataccaccccctttgggcagcaacgcgtcttcaaagagaaggtggacacaagaacgcaggagcctaaagaaggaaccaagaagctgatgaaaattacagcggagtggctctggaaggaactgggcaaaaagaaaacaccccggatgtgtacacgcgaggagtttaccagaaaggtgcggtctaatgccgctcttggggccatcttcacagatgaaaacaaatggaagtccgctagagaggccgtcgaagacagccggttttgggagctggttgataaggaacgcaacctccacctggagggaaaatgcgagacctgtgtgtataatatgatgggcaagagagagaagaagctgggcgagttcgggaaagccaagggatctcgggcgatctggtacatgtggctcggcgctcgctttctggagttcgaggcccttgggtttctgaacgaagaccactggttctccagagagaatagcctctccggagtggagggcgaagggctgcataaacttggctacattctgcgggacgtcagcaaaaaggagggaggcgccatgtatgctgatgacacggccgggtgggatacccgcatcacactcgaagacctgaaaaacgaggaaatggtgaccaatcacatggagggagagcataagaaactggctgaagccatttttaagctcacataccagaacaaggttgtgagagtccagcggccgacccctcgcggcacggtgatggatatcatttctagacgggaccaacgcgggagcggacaggttggcacatatgggctgaataccttcacaaacatggaggcgcagcttatcagacaaatggaaggcgagggagtgttcaaatccatccagcggctgaccgtcacggaggaaattgccgtgcagaattggctcgctcgcgttggcagagagcggctgtctagaatggccatcagcggggatgactgcgtggtcaagccccttgatgaccgctttgcttccgccctgaccgcgctcaacgatatgggaaaagtgcggaaggacattcagcaatgggaaccctctagaggctggaatgattggacacaggtccctttctgcagccaccattttcacgagctgatcatgaaagacgggcgcgtgctggttgtgccgtgtcggaaccaggacgaactcattggacgggcccgcatctcccagggcgctgggtggtctctgaaggagaccgcctgccttggcaagagctacgctcaaatgtggtccctgatgtatttccaccggagagatctccgcctggccgctaatgccatctgtagcgcggtcccctctcattgggtgcctacatcccggaccacatggagcattcacgccaaacatgagtggatgaccacggaagacatgcttacagtgtggaacagagtttggatccaggagaatccctggatggaagataagacccctgtggagtcttgggaagaggtcccctacctgggaaaacgcgaggaccagtggtgcggctccctcattgggctgaccagccgggctacatgggccaagaacatccagaccgccattaaccaagtgagatccctgatcggaaatgaagagtatacagattacatgccttctatgaaacggtttagacgcgaagaggaagaggctggcgttctctggtga

SEQ ID NO: 20130 - RNA, 9876 nt, synthetic construct
  misc_feature 1..9876: note = derived and/or modified CDS sequence (opt5) from DENV-2__EU482780__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtgacggtcagctttgtgaccctgattacaggaaacatgtccttccgggaccttggcagagttatggtgatggtcggcgccgccatgaccgatgacatcgggatgggagtgacatacctggctctcctggccgcgtttaaggttcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtcgggatggttagcatcctggcttcttccctcctgaaaaacgacattcccatgacgggacctctcgtggccggcggcctgcttacagtgtgctacgtcctgaccgggcggagcgccgatctggaactcgagcgcgctaccgacgtgaagtgggaggatcaagcggaaatctccggaagctctcccattctgagcatcacaattgccgaggacggctccatgtctatcaaaaatgaagaggaggaacagacccttacaatcctgattagaacggggctcctggttatcagcggactcttcccggtgtccattcctatcaccgctgccgcctggtatctgtgggaggtcaagaagcagcgggctggcgtgctttgggatgttccctctcctccgcccgtggggaaagccgaactggaggacggagcgtaccgcattaagcagaaaggcatcctgggctatagccaaatcggggctggagtctacaaggaaggcacatttcacaccatgtggcacgtgacaagaggggccgtcctcatgcatcggggaaaacgcattgagccttcctgggccgatgtgaagaaggacctgatctcttacggcgggggatggaaacttgagggcgaatggaaggagggcgaagaggttcaggtgctggctctcgaaccggggaaaaaccccagagccgtccagaccaagcctggactgttcaaaacgaataccggcacaattggggcggtgagcctcgatttttcccccggaaccagcggctctcctatcgttgaccggaaggggaaggtggtcggactgtatggcaacggcgtggtgacaagatccggggcttacgttagcgccattgcccagaccgagaaatctatcgaggataatcccgaaatcgaggacgatattttccgcaagaaacggcttacaatcatggacctgcaccctggagctggcaagacgaaaagatatctgccggccattgtccgcgaagctatcaagcgggggctcagaaccctgattcttgcccccacacgcgtggtggcggccgagatggaagaggctctgcggggactccctatcagataccaaacccccgccattcgcgctgagcataccggccgggaaatcgtcgacctgatgtgtcacgccacattcacgatgagactcctgtcccctgtgcgggttcccaactataaccttatcattatggatgaggcccattttaccgacccggctagcatcgcggcccgcgggtacatttccacaagagtggaaatgggcgaggctgccggaatcttcatgaccgccacacctcccggctctcgggatccctttcctcagagcaatgctcccattatggacgaggaacgcgagatccctgaaagatcctggaacagcgggcacgagtgggtcaccgatttcaagggaaaaacggtgtggtttgttccgtctatcaaggccggcaatgacattgcggcttgcctgcggaaaaacgggaagaaagtgatccagctgtccagaaagacattcgatagcgaatatgtcaagacccgcaccaatgactgggattttgtggttacaaccgacatttctgagatgggagccaacttcaaagccgagcgggtgatcgatcccagacgctgtatgaagcctgtcattctcacagacggcgaagaacgggtgatcctggctgggcccatgcctgtgacccacagctccgccgcgcaaagacgcggccggatcggaagaaatcccaaaaacgaaaatgaccagtacatttacatgggcgagccgcttgaaaacgatgaggactgcgcccattggaaggaggctaaaatgctgctcgataatatcaacacgcctgaagggattatcccctctatgtttgagcctgaacgcgagaaggtcgacgccattgatggagaatatagactgcggggcgaggctcgcaaaacattcgttgacctgatgagaagaggggatctccccgtgtggcttgcctaccgcgtggctgccgagggaatcaattatgcggacagacggtggtgttttgatggcgtcaagaacaatcagattctggaagagaacgtggaagttgagatctggaccaaggagggggaacgcaagaagctgaaacctcgctggctcgacgcccggatctacagcgatcccctggctcttaaggagttcaaagagttcgccgctggcagaaagtccctgacactcaacctgattaccgagatgggacgcctgccgacgtttatgacccagaaggcccgggacgccctcgataatcttgctgtgctgcacacagcggaagccggcgggagagcttataaccatgccctgtctgagctccctgagaccctggaaacacttctgctcctgaccctgctcgccacagtcaccggaggcatcttcctttttctgatgagcgggaaaggagtgggcaagatgacgctgggcatgtgctgcattatcacagcttccattctcctgtggtacgcccaaatccagccccactggatcgcggccagcattatccttgagttctttctgattgttctcctgatccccgaacctgagaaacagcggaccccgcaggacaatcaactgacctatgtggtcattgctatcctcacagtggtcgccgctaccatggccaacgaaatggggttccttgagaagaccaagaaggacctgggactgggctctatcgcgacgcaggagcccgaatccaatattctcgatatcgacctgcgccctgccagcgcttggaccctttacgccgtggctacaacctttgttacacccatgctgagacactccattgagaactctagcgtgaatgtgtccctcaccgccatcgctaaccaggccacggtcctgatggggctgggaaagggctggcctctctctaaaatggatattggggttccccttctggcgatcggatgttacagccaggtgaatcctattaccctgacagccgctctcctgcttctggtggcccattatgctatcatcggcccgggcctccaagccaaggccacccgggaagcgcagaaacgcgctgccgctgggattatgaagaaccccacagtcgacggagtgaccgttatcgatctggaccctattccctacgatcctaaattcgagaagcagctgggccaggtgatgctccttatcctgtgcgtcacgcaagtgctgatgatgagaacaacctgggccctctgtgaagccctgacacttgctaccgggcccatttccaccctgtgggagggaaatccgggccggttttggaacacaacgatcgccgtcagcatggcgaatatcttccgcgggtcttatctcgccggagctggcctgctgttttccattatgaagaacaccacaaataccagacggggcacagggaacatcggagagaccctcggcgaaaaatggaaaagccgccttaatgccctggggaaatctgagttccagatttacaagaaatccggaatccaggaagtggacagaacgctggctaaggagggcattaaaagaggggaaacagatcaccatgccgttagcagaggatctgcgaagctccgctggtttgtggaacggaacatggtcacccctgagggcaaggtggttgacctgggctgcgggagaggaggctggagctattactgtgggggacttaaagatgtgcgcgaagtcaagggcctgaccaaagggggacccggccacgaggaacccatccctatgtccacatatggctggaacctcgtgcggctgcaatctggggtggacgttttcttcacaccccctgagaagtgcgataccctgctctgtgacatcggagagagctccccgaatcccacgattgaagccggcagaacccttcgcgtcctgagcctggtggagaactggctcaataacgacacacagttttgcatcaaagtgctgaatccttacatgccctccgtcattgaaaagatggagacccttcagcggaagtacgggggagctctggttagaaaccctctctctcgcaatagcacacatgaaatgtattgggtgtccaacgccaccggcaatatcgtgtctagcgtcaacatgatttcccggatgctgatcaatagattcacgatgaaacacaagaaagctacctacgagcccgatgtggacctggggtctggaacacgcaacatcggcattgagagcgaaatcccgaatctcgatattatcggcaagcggattgagaaaatcaagcaggaacacgagacctcctggcattatgaccaagatcacccttacaagacatgggcctatcatgggagctacgaaaccaaacagacaggatctgcttccagcatggttaacggcgtggtcagacttctgaccaagccctgggacgtggttcctatggtgacgcagatggccatgacagataccaccccctttgggcagcaacgcgtcttcaaagagaaggtggacacaagaacgcaggagcctaaagaaggaaccaagaagctgatgaaaattacagcggagtggctctggaaggaactgggcaaaaagaaaacaccccggatgtgtacacgcgaggagtttaccagaaaggtgcggtctaatgccgctcttggggccatcttcacagatgaaaacaaatggaagtccgctagagaggccgtcgaagacagccggttttgggagctggttgataaggaacgcaacctccacctggagggaaaatgcgagacctgtgtgtataatatgatgggcaagagagagaagaagctgggcgagttcgggaaagccaagggatctcgggcgatctggtacatgtggctcggcgctcgctttctggagttcgaggcccttgggtttctgaacgaagaccactggttctccagagagaatagcctctccggagtggagggcgaagggctgcataaacttggctacattctgcgggacgtcagcaaaaaggagggaggcgccatgtatgctgatgacacggccgggtgggatacccgcatcacactcgaagacctgaaaaacgaggaaatggtgaccaatcacatggagggagagcataagaaactggctgaagccatttttaagctcacataccagaacaaggttgtgagagtccagcggccgacccctcgcggcacggtgatggatatcatttctagacgggaccaacgcgggagcggacaggttggcacatatgggctgaataccttcacaaacatggaggcgcagcttatcagacaaatggaaggcgagggagtgttcaaatccatccagcggctgaccgtcacggaggaaattgccgtgcagaattggctcgctcgcgttggcagagagcggctgtctagaatggccatcagcggggatgactgcgtggtcaagccccttgatgaccgctttgcttccgccctgaccgcgctcaacgatatgggaaaagtgcggaaggacattcagcaatgggaaccctctagaggctggaatgattggacacaggtccctttctgcagccaccattttcacgagctgatcatgaaagacgggcgcatgctggtggttccgtgtcggaaccaggacgaactcattggacgggcccgcatctcccagggcgctgggtggtctctgaaggagaccgcctgccttggcaagagctacgctcaaatgtggtccctgatgtatttccaccggagagatctccgcctggccgctaatgccatctgtagcgcggtgccctctcattgggtccctacatcccggaccacatggagcattcacgccaaacatgagtggatgaccacggaagacatgcttacagtgtggaacagagtgtggatccaggagaatccctggatggaagataagacccctgttgagtcttgggaagaggtgccctacctgggaaaacgcgaggaccagtggtgcggctccctcattgggctgaccagccgggctacatgggccaagaacatccagaccgccattaaccaagtcagatccctgatcggaaatgaagagtatacagattacatgccttctatgaaacggtttagacgcgaagaggaagaggctggcgtgctctggtga

SEQ ID NO: 20131 - RNA, 9876 nt, synthetic construct
  misc_feature 1..9876: note = derived and/or modified CDS sequence (opt5) from DENV-2__EU482781__SS-prME
  source 1..9876: mol_type = other RNA
accgccggcgtgatcattatgctcatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcagcccggaaagcggtcccttagacctcaacccacagaactcaaatattcttggaagacctggggcaaggccaaaatgctgagcacggagtcccataaccagaccttcctgatcgatgggcctgaaacagctgagtgccccaataccaaccgcgcctggaatagcctcgaggtcgaagactacggatttggcgtgttcacaaccaacatctggctgaaacttcgggagaaacaggacgtcttttgtgattctaagctgatgtccgctgccattaaagacaatagagcggtgcacgccgatatgggctattggatcgaaagcgctctcaacgacacatggaagatggagaaggcctctttcattgaggtcaaatcctgccactggcccaagagccataccctgtggtctaatggggtgctggaaagcgagatgatcattcctaaatccttcgctggacccgttagccagcacaactaccgccccggctattacacgcaaacagccgggccttggcatcttggaaagctcgaaatggattttgacttctgtgagggcaccaccgtggtcgtgacagaagattgcgggaaccggggaccgtctctgagaaccacgacagcctccggcaaactgatcaccgagtggtgctgtcggagctgcacactgccccctctgcgctacagaggcgaggacgggtgttggtatggaatggaaattcggccccttaaggagaaggaagagaatctggtgaactccctcgtcaccgctggccacgggcagatcgataatttttctctgggagttctgggcatggcgcttttcctcgaagagatgctgagaacacgcgtggggaccaaacatgccatcctgctcgtgacggtcagctttgtgaccctgattacaggaaacatgtccttccgggaccttggcagagttatggtgatggtcggcgctgccatgaccgatgacatcgggatgggagtgacatacctggccctcctggctgcctttaaggttcgccctaccttcgcggctggcctgcttctgagaaaactcacgtctaaggagctgatgatggccacaattgggatcgccctcctgagccagtccaccattcccgaaacaatccttgagctgaccgatgctctcgccctgggaatgatggtgctgaaaatcgtccggaatatggaaaagtatcaacttgcggtgaccattatggctatctcttgcgttcctaacgccgtgattctgcagaatgcctggaaggtcagctgtacaatcctcgctgccgtgtccgtgagccccctgctcctgacgtcttcccagcagaaagctgactggattccgcttgccctgaccatcaagggcctcaaccctacagcgatctttctgaccacactgagccgcacctctaaaaagagatcctggccccttaatgaggccattatggctgtcgggatggttagcatcctggcctcttccctcctgaaaaacgacattcctatgacgggacccctcgtggctggcggcctgcttacagtgtgctacgtcctgaccgggcggagcgccgatctggaactcgagcgcgccaccgacgtgaagtgggaggatcaagctgaaatctccggaagctctccgattctgagcatcacaattgcggaggacggctccatgtctatcaaaaatgaagaggaggaacagacccttacaatcctgattagaacggggctcctggttatcagcggactcttccctgtgtccattcccatcaccgccgctgcctggtatctgtgggaggtcaagaagcagcgggccggcgtgctttgggatgttccttctccgccccctgtggggaaagctgaactggaggacggagcctaccgcattaagcagaaaggcatcctgggctatagccaaatcggggcgggagtctacaaggaaggcacatttcacaccatgtggcacgtgacaagaggggctgtcctcatgcatcggggaaaacgcattgagccgtcctgggccgatgtgaagaaggacctgatctcttacggcgggggatggaaacttgagggcgaatggaaggagggcgaagaggttcaggtgctggccctcgaacccgggaaaaaccctagagctgtccagaccaagcccggactgttcaaaacgaataccggcacaattggggccgtgagcctcgatttttcccctggaaccagcggctctcccatcgttgaccggaaggggaaggtggtcggactgtatggcaacggcgtggtgacaagatccggggcgtacgttagcgctattgcccagaccgagaaatctatcgaggataatcctgaaatcgaggacgatattttccgcaagaaacggcttacaatcatggacctgcacccgggagccggcaagacgaaaagatatctgcccgctattgtccgcgaagccatcaagcgggggctcagaaccctgattcttgctcctacacgcgtggtggccgcggagatggaagaggccctgcggggactccccatcagataccaaacccctgctattcgcgccgagcataccggccgggaaatcgtcgacctgatgtgtcacgctacattcacgatgagactcctgtcccccgtgcgggttccgaactataaccttatcattatggatgaggcccattttaccgaccctgccagcatcgctgcgcgcgggtacatttccacaagagtggaaatgggcgaggccgctggaatcttcatgaccgccacaccgcccggctctcgggatccttttccccagagcaatgcccctattatggacgaggaacgcgagatcccggaaagatcctggaacagcgggcacgagtgggtcaccgatttcaagggaaaaacggtgtggtttgttccctctatcaaggctggcaatgacattgccgcgtgcctgcggaaaaacgggaagaaagtgatccagctgtccagaaagacattcgatagcgaatatgtcaagacccgcaccaatgactgggattttgtggttacaaccgacatttctgagatgggagctaacttcaaagccgagcgggtgatcgatcctagacgctgtatgaagcccgtcattctcacagacggcgaagaacgggtgatcctggccgggcctatgcccgtgacccacagctccgctgcccaaagacgcggccggatcggaagaaatccgaaaaacgaaaatgaccagtacatttacatgggcgagcctcttgaaaacgatgaggactgcgcgcattggaaggaggccaaaatgctgctcgataatatcaacacgcccgaagggattatcccttctatgtttgagcccgaacgcgagaaggtcgacgctattgatggagaatatagactgcggggcgaggcccgcaaaacattcgttgacctgatgagaagaggggatctccctgtgtggcttgcttaccgcgtggccgctgagggaatcaattatgccgacagacggtggtgttttgatggcgtcaagaacaatcagattctggaagagaacgtggaagttgagatctggaccaaggagggggaacgcaagaagctgaaaccccgctggctcgacgcgcggatctacagcgatccgctggcccttaaggagttcaaagagttcgctgccggcagaaagtccctgacactcaacctgattaccgagatgggacgcctgcctacgtttatgacccagaaggctcgggacgccctcgataatcttgccgtgctgcacacagctgaagcgggcgggagagcctataaccatgctctgtctgagctccccgagaccctggaaacacttctgctcctgaccctgctcgccacagtcaccggaggcatcttcctttttctgatgagcgggaaaggagtgggcaagatgacgctgggcatgtgctgcattatcacagcctccattctcctgtggtacgctcaaatccagccccactggatcgccgcgagcattatccttgagttctttctgattgttctcctgatccctgaaccggagaaacagcggacaccccaggacaatcaactgacctatgtggtcattgccatcctcacagtggtcgctgccaccatggctaacgaaatggggttccttgagaagaccaagaaggacctgggactgggctctatcgccacgcaggagcctgaatccaatattctcgatatcgacctgcgccccgcgagcgcctggaccctttacgctgtggccacaacctttgttacacctatgctgagacactccattgagaactctagcgtgaatgtgtccctcaccgctatcgccaaccaggctacggtcctgatggggctgggaaagggctggcccctctctaaaatggatattggggttcctcttctggccatcggatgttacagccaggtgaatccgattaccctgacagcggccctcctgcttctggtggctcattatgccatcatcggccccggcctccaagctaaggccacccgggaagcccagaaacgcgcggctgccgggattatgaagaaccctacagtcgacggagtgaccgttatcgatctggaccccattccttacgatcccaaattcgagaagcagctgggccaggtgatgctccttatcctgtgcgtcacgcaagtgctgatgatgagaacaacctgggctctctgtgaagccctgacacttgccaccgggccgatttccaccctgtgggagggaaatcctggccggttttggaacacaacgatcgctgtcagcatggccaatatcttccgcgggtcttatctcgcgggagccggcctgctgttttccattatgaagaacaccacaaataccagacggggcacagggaacatcggagagaccctcggcgaaaaatggaaaagccgccttaatgctctggggaaatctgagttccagatttacaagaaatccggaatccaggaagtggacagaacgctggccaaggagggcattaaaagaggggagacagatcaccatgctgttagcagaggatctgccaagctccgctggtttgtggaacggaacatggtcacccccgagggcaaggtggttgacctgggctgcgggagaggaggctggagctattactgtgggggacttaaagatgtgcgcgaagtcaagggcctgaccaaagggggacccggccacgaggaacctatccccatgtccacatatggctggaacctcgtgcggctgcaatctggggtggacgttttcttcacccctccggagaagtgcgatacactgctctgtgacatcggagagagctcccccaatcctacgattgaagcgggcagaacccttcgcgtcctgagcctggtggagaactggctcaataacgacacacagttttgcatcaaagtgctgaatccctacatgccttccgtcattgaaaagatggagacccttcagcggaagtacgggggagccctggttagaaaccccctctctcgcaatagcacacatgaaatgtattgggtgtccaacgctaccggcaatatcgtgtctagcgtcaacatgatttcccggatgctgatcaatagattcacgatgaaacacaagaaagccacctacgagccggatgtggacctggggtctggaacacgcaacatcggcattgagagcgaaatccctaatctcgatattatcggcaagcggattgagaaaatcaagcaggaacacgagacctcctggcattatgaccaagatcacccctacaagacatgggcttatcatgggagctacgaaaccaaacagacaggatctgcctccagcatggttaacggcgtggtcagacttctgaccaagccttgggacgtggttcccatggtgacgcagatggctatgacagataccaccccttttgggcagcaacgcgtcttcaaagagaaggtggacacaagaacgcaggagcccaaagaaggaaccaagaagctgatgaaaattacagccgagtggctctggaaggaactgggcaaaaagaaaaccccgcggatgtgtacacgcgaggagtttaccagaaaggtgcggtctaatgcggcccttggggctatcttcacagatgaaaacaaatggaagtccgccagagaggctgtcgaagacagccggttttggaagctggttgataaagagcgcaacctccacctggaaggaaagtgcgagacctgtgtgtataatatgatgggcaaaagagagaagaaactgggcgagttcgggaaggccaagggatctcgggccatctggtacatgtggctcggcgcgcgctttctggagttcgaagctcttgggtttctgaacgaggaccactggttctccagagaaaatagcctctccggagtggagggcgaggggctgcataaacttggctacattctgcgggacgtcagcaagaaagaaggaggcgccatgtatgccgatgacacggctgggtgggatacccgcatcacactcgaggacctgaagaacgaagagatggtgaccaatcacatggaaggagagcataaaaagctggccgaggctatttttaagctcacataccagaacaaagttgtgagagtccagcggcctacgccccgcggcaccgtgatggatatcatttctagacgggaccaacgcgggagcggacaggttggcacatatgggctgaataccttcacaaacatggaagcccagcttatcagacaaatggagggcgaaggagtgttcaagtccatccagcggctgaccgtcacggaggagattgcggtgcagaattggctcgcccgcgttggcagagaacggctgtctagaatggctatcagcggggatgactgcgtggtcaaaccccttgatgaccgctttgcctccgctctgaccgccctcaacgatatgggaaaggtgcggaaagacattcagcaatgggagccttctagaggctggaatgattggacacaggtcccgttctgcagccaccattttcacgaactgatcatgaaggacgggcgcgtgctggttgtgccctgtcggaaccaggacgagctcattggacgggcgcgcatctcccagggcgccgggtggtctctgaaggaaaccgcttgccttggcaaaagctacgcccaaatgtggtccctgatgtatttccaccggagagatctccgcctggctgccaatgctatctgtagcgccgtcccttctcattgggtgcccacatcccggaccacatggagcattcacgcgaagcatgagtggatgaccacggaggacatgcttacagtgtggaacagagtttggatccaggaaaatccttggatggaggataaaacccccgtggaatcttgggaggaagtcccttacctgggaaagcgcgaggaccagtggtgcggctccctcattgggctgaccagccgggccacatgggctaaaaacatccagaccgccattaaccaagtgagatccctgatcggaaatgaggaatatacagattacatgccctctatgaagcggtttagacgcgaggaagaggaagccggcgttctctggtga

SEQ ID NO: 20132 - RNA, 9876 nt, synthetic construct
  misc_feature 1..9876: note = derived and/or modified CDS sequence (opt5) from DENV-2__EU482782__SS-prME
  source 1..9876: mol_type = other RNA
agcgccggcatgatcattatgctgatccccaccgtgatggctttccacctgacaacgagaaatggggaacctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatccgcggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattacagacctggataccacacccagattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttattaccgggaacatgagctttaaggacctgggacgcgtggttgtgatggtcggcgctacgatggccgatgacatcggcatgggggtgacctatctcgccctgctggctgccttcaaagttcggcctacatttgtggcgggacttctgctcagaaagctgacctccaaggagctcatgatgacaaccattggcatcgtcctgctttctcaaagcacgattcccgaaacagtgctggagctcaccgatgctctggccctggggatgatggtgcttaaaatcgtccgcaatatggaaaagtaccagctggccgttacaatcatggctattctctgcgtgcctaacgccgtgatcctgcagaatgcgtggaaagtctcctgtaccattctcgctgtggtttctgtgagccccctgcttctgacctccagccagcaaaagacagactggatccctctcgccctgacgattaaaggactgaaccccaccgccatcttccttacaaccctgtctagaacaaataagaaacggtcctggccgctcaacgaggctatcatggccgtcggcatggtgagcattctggcttcttccctcctgaagaatgacatccctatgaccgggccccttgttgccggaggcctgctgacggtgtgctatgtcctcacaggccgcagcgcggatctggaacttgagagagccaccgacgtgaagtgggaggatcaggctgaaatttctgggtccagccctatcctgtccattaccatcagcgaggacggatctatgagcattaaaaacgaagaggaggaacagacactcaccatcctgatccggacaggcctcctggtcatttccgggctttttcccatctctattccgatcacggccgctgcctggtacctgtgggaggtgaagaaacagcgcgccggagttctgtgggatgtgccttctccccctcccatgggcaaggctgaactcgaggacggggcgtatagaattaaacaaaagggaatcctgggctactcccagatcggcgccggggtctacaaggaaggaaccttccacacaatgtggcatgtgacccggggcgctgttcttatgcacaaagggaagcgcattgagccctcctgggccgatgtgaaaaaggacctgatcagctatggaggcgggtggaaactcgagggagaatggaaggagggcgaagaggtccaggtgctggccctcgaacctggcaagaatccgagagctgtgcagacaaaacccgggctgtttaagaccaacacgggaaccattggcgccgtttcccttgatttctctcctgggacaagcggatcccccatcattgacaaaaagggcaaagtcgtggggctgtacggaaacggcgtggtcacccggagcggcgcgtatgtgtctgctatcgcccaaacagagaagtccatcgaggataatcctgaaattgaggacgatatctttcgcaagagacggctgaccattatggacctccaccccggggccggaaaaacaaagagatacctgcctgctatcgttcgcgaagccattaaacggggccttagaacgctgatcctcgcgccgacccgcgtggtcgctgccgagatggaagaggccctgcgggggctccccattagatatcagacccctgctatccgcgccgagcataccggacgggaaatcgtggacctgatgtgtcacgctaccttcacaatgagacttctgagccccgttcgcgtgcctaactacaatctgattatcatggatgaggcccatttcacggaccccgcgtctattgccgctcggggctatatctccaccagagtcgaaatgggggaggccgctggcatttttatgacagccaccccgcctggaagccgggatcccttcccccagtccaacgcccctatcatcgacgaggaacgcgagattcccgaaagatcttggaatagcggccacgagtgggtgacagattttaaggggaaaaccgtttggttcgtgccttccatcaaggctggaaacgacattgcggcctgcctccggaagaatggcaaaaaggtcatccaactgagccgcaaaacgtttgattctgaatacgtgaagacaagaaccaacgactgggatttcgtggtcaccacagacatttccgagatgggggctaattttaaagccgagcgggttatcgatccgagacgctgtatgaagcccgtgatccttaccgacggagaggaacgggtgattctggccggccctatgcccgtcacacatagctctgctgcccagagacgcgggcggatcggcagaaaccctaaaaatgaaaacgaccagtacatttatatgggagagcccctcgaaaatgatgaggactgcgcgcactggaaggaggctaagatgctgctggataacatcaataccccggaaggcattatccctagcatgttcgagcccgaacgcgagaaagtggacgccattgatggggaataccggctcagaggagaggcccgcaagacgtttgttgaccttatgagacggggcgatctgcctgtgtggctggcttataaagtcgccgcggaggggatcaactacgccgaccgcagatggtgtttcgatggaatcaagaacaatcagattctcgaagagaacgtggaagttgagatctggacaaaagagggcgaacggaagaagctgaaaccccgctggcttgacgctagaatttattccgatcctctggccctcaaggagtttaaagagttcgctgccgggcggaagtctctgaccctgaatctcatcacagagatgggcagacttcccaccttcatgacgcagaagacccgcgacgctctggataacctggccgtgctccacacagcggaagccggaggccgggcttacaatcatgccctgagcgagcttccggagaccctggaaacactcctgctgctcacccttctggctacagtcaccgggggaatttttctgttcctcatgtccggcagagggatcggaaagatgacgctgggcatgtgctgcatcattacagcctctatccttctgtggtatgcccagattcagcctcactggatcgctgcgagcattatcctcgagtttttcctgatcgtgctgctcattcccgaacccgagaagcagcgcacccctcaagacaaccagcttacctacgtcgtgatcgccattctgacagttgtggctgccaccatggccaatgaaatgggctttctggagaaaacaaagaaagacctcgggctgggatccatcgctacgcagcagccggagagcaacattcttgatatcgacctgcggcccgcctctgcgtggaccctctacgccgtggctacaaccttcgtcacacctatgctgagacattccattgaaaatagctccgttaacgtgtctctgaccgccatcgctaatcaagccacggtgctcatgggccttgggaagggatggcccctgagcaaaatggatatcggcgtccctctgctcgcgattgggtgttattcccaggtgaaccccatcaccctgacagccgcccttctgctcctggttgcccactacgctattatcggacctggcctgcaggccaaggctacccgggaggcccagaagcgcgcggccgctggcattatgaaaaatccgacagtggacgggatcaccgtcatcgatctcgaccccattccttatgatcccaagtttgaaaaacaacttggacaggtgatgctgctgatcctctgcgtcacgcaggtcctgatgatgagaacaacctgggccctttgtgaggctctgacactcgccaccggccctatttctaccctgtgggaagggaaccccggacggttctggaatacaacgatcgccgttagcatggcgaacatttttcgcggctcctacctggctggggccggactccttttcagcatcatgaagaataccacaaacaccagacggggcacaggcaacatcggggagaccctgggagagaaatggaagtctcgcctgaatgctctcggcaaatccgaatttcaaatttataaaaagagcgggatccaggaggtggacagaacgctggccaaagaaggaattaagcggggcgagacagatcaccatgccgtctctcgcgggtccgctaaacttagatggttcgtggagcggaacatggttaccccggaaggaaaggtggtcgacctgggctgcggcagagggggatggagctactattgtggcgggctcaaaaatgtgcgcgaggtgaagggactgaccaagggcgggcctggacacgaagaacccatccccatgtctacatacggctggaacctggttcggctccagagcggcgtcgatgtgtttttcattcctcccgaaaaatgcgacacccttctgtgtgatatcggggagtcctctcctaatccgacagtggaggccggaagaacgctgcgcgtcctcaacctggttgaaaattggcttaacaataacacccagttctgcatcaaggtgctgaatccctacatgcctagcgtgattgagaaaatggaagcgctccaacggaagtatggcggggccctggtcagaaaccccctgtcccgcaatagcacacatgagatgtactgggtgtccaacgcttctggaaatatcgttagctccgtgaacatgatttctcggatgctcatcaacagatttaccatgcgccacaaaaaggccacatatgaacctgacgtcgaccttggcagcgggacccggaatattggaatcgagtccgagattcccaacctggatatcatcggcaagagaattgagaagatcaagcaggagcatgaaacgtcttggcactacgaccaggatcacccgtataaaacctgggcttaccatggcagctatgagacaaagcagaccgggtccgccagctctatggtgaatggagttgtgcgcctgctcacaaaaccttgggacgtcctgcccaccgtgacacaaatggcgatgaccgatacgacacctttcggccagcagcgggtgtttaaggaaaaggtcgacaccagaacccaggagcccaaagaggggacaaagaaacttatgaagattacggccgaatggctgtggaaagagctcggaaagaaaaagacccctcgcatgtgtacaagagaagagttcacccggaaggttcgctccaacgctgccctgggcgctatctttacagatgagaataaatggaaaagcgccagagaagctgtggaggactctcggttctgggaactggtggataaagagagaaacctccacctggaagggaagtgcgagacctgtgtctacaatatgatgggaaaacgggagaagaaacttggcgaatttggcaaagccaaggggtcccgcgcgatttggtacatgtggctgggagccagattcctcgagtttgaagctctgggcttccttaacgaggaccattggtttagccgggaaaattctctgtccggggtggagggagagggcctccacaaactggggtatatcctgcgcgatgttagcaagaaagaaggcggagccatgtacgctgacgacacagccggctgggataccagaatcacgctcgaggacctgaagaacgaagagatggtgaccaatcacatggaaggggagcataagaaacttgccgaggcgattttcaagctgacatatcaaaacaaagtcgtgcgggttcagcgccccaccccgagaggaacagtgatggatatcatttcccggcgcgaccagagaggcagcgggcaagtcggaacctacggcctcaatacgtttacaaacatggaagctcagctgatccggcagatggagggggaaggcgtgttcaagaatattcagcaccttaccgttacagaggaggtggccgtccataactggctggcccgcgtgggaagagaacggctctctcgcatggctatcagcggcgatgactgcgtcgtgaaacctctggatgacagattcgccaacgctctgaccgccctcaatgatatggggaagatccggaaggacattcaacagtgggagccctccaaaggatggaacgattggacgcaggttcccttttgctctcaccatttccacgaactgatcatgaaggacggcagagtgcttgtcgtgccttgtcgcaatcaggatgagctgattgggcgggcgagaatcagccaaggagccggctggtccctccgcgaaaccgcttgcctggggaaatcttatgcccagatgtggagccttatgtactttcaccggagagacctgcgcctcgctgccaacgcgatttgttccgccgtgccgtctcattgggttcccacaagccggaccacatggtccatccacgctaagcatgagtggatgaccacagaggacatgctgaccgtgtggaatagagtctggattcgcgaaaacccttggatggaggataaaacgcccgtggaaagctgggaggaaatcccttatctgggcaagcgggaggaccagtggtgcggatctctcatcggcctgacatccagagccacctgggctaagaatattcaggccgctatcaaccaagttcgcagccttattgggaatgaggaatacaccgattacatgccctctatgaaacggttcagacgggaggaagaggaagccggagtgctgtggtga

SEQ ID NO: 20133 - RNA, 9876 nt, synthetic construct
  misc_feature 1..9876: note = derived and/or modified CDS sequence (opt5) from DENV-2__EU482783__SS-prME
  source 1..9876: mol_type = other RNA
accgccggcgtgatcattatgctgatccccaccgctatggccttccacctcacgaccagaaacggggagcctcatatgattgtcggacggcaggaaaagggcaaaagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggaatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgggatcaaaggaattatgcaggccggcaagcggtcccttagaccccaacctacagaactcaaatattcttggaagacctgggggaaggctaaaatgctgagcacggagtcccataaccagaccttcctgatcgacggacccgaaacagccgagtgccctaataccaaccgcgcttggaatagcctcgaggtcgaagattacggctttggcgtgttcacaaccaacatctggctgaaacttcgggagaaacaggacgtcttttgtgactctaagctgatgtccgccgcgattaaagataatagagccgtgcacgctgacatggggtattggatcgaaagcgccctcaacgatacatggaagatggagaaggcttctttcattgaggtcaaatcctgccactggcccaagagccataccctgtggtctaatggagtgctggaaagcgagatgatcattccgaaatccttcgccggccctgttagccagcacaactaccgccccgggtattacacgcaaacagccggaccctggcatcttggcaagctcgaaatggactttgatttctgtgaggggaccaccgtggtcgtgacagaagactgcggaaaccggggcccttctctgagaaccacgacagcttccggcaaactgatcaccgagtggtgctgtcggagctgcacactcccgcccctgcgctacagaggggaggatggatgttggtatggcatggaaattcggcctcttaaggagaaggaagagaatctggtgaactccctcgtcaccgcggggcacggacagatcgacaatttttctctgggcgttctggggatggcccttttcctcgaagagatgctgagaacacgcgtgggaaccaaacatgctatcctgctcgtgacggtcagctttgtgaccctgattacaggcaacatgtccttccgggatcttggcagagttatggtgatggtcggggccgccatgaccgacgatatcggaatgggcgtgacatacctggctctcctggccgcgtttaaggttcgccccaccttcgctgccgggctgcttctgagaaaactcacgtctaaggagctgatgatggccacaattggaatcgctctcctgagccagtccaccattcctgaaacaatccttgagctgaccgacgccctcgcgctgggcatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaagccgattggattccccttgcgctgaccatcaaggggctcaacccgacagccatctttctgaccacactgagccgcacctctaaaaagagatcctggcctcttaatgaggctattatggccgtcggaatggttagcatcctggcttcttccctcctgaaaaacgacattcccatgacgggccctctcgtggccggcgggctgcttacagtgtgctacgtcctgaccggacggagcgccgacctggaactcgagcgcgctaccgatgtgaagtgggaggaccaagcggaaatctccggcagctctcccattctgagcatcacaattgccgaggatgggtccatgtctatcaaaaatgaagaggaggaacagacccttacaatcctgattagaacgggactcctggttatcagcggcctcttcccggtgtccattcctatcaccgctgccgcctggtatctgtgggaggtcaagaagcagcgggctggggtgctttgggacgttccctctcctccgcccgtgggaaaagccgaactggaggatggcgcgtaccgcattaagcagaaaggcatcctggggtatagccaaatcggagctggcgtctacaaggaagggacatttcacaccatgtggcacgtgacaagaggagccgtcctcatgcatcggggcaaacgcattgagccttcctgggccgacgtgaagaaggatctgatctcttacgggggaggctggaaacttgagggcgaatggaaggagggggaagaggttcaggtgctggctctcgaaccgggcaagaaccccagagccgtccagaccaagcctggcctgttcaaaacgaataccgggacaattggagcggtgagcctcgacttttcccccggcaccagcgggtctcctatcgttgatcggaagggaaaggtggtcggcctgtatggcaacggggtggtgacaagatccggagcttacgttagcgccattgcccagaccgagaaatctatcgaggacaatcccgaaatcgaggatgacattttccgcaagaaacggcttacaatcatggatctgcaccctggcgctgggaagacgaaaagatatctgccggccattgtccgcgaagctatcaagcggggactcagaaccctgattcttgcccccacacgcgtggtggcggccgagatggaagaggctctgcggggcctccctatcagataccaaacccccgccattcgcgctgagcataccgggcgggaaatcgtcgacctgatgtgtcacgccacattcacgatgagactcctgtcccctgtgcgggttcccaactataaccttatcattatggacgaggcccattttaccgatccggctagcatcgcggcccgcggctacatttccacaagagtggaaatgggagaggctgccggcatcttcatgaccgccacacctcccgggtctcgggacccctttcctcagagcaatgctcccattatggatgaggaacgcgagatccctgaaagatcctggaacagcggacacgagtgggtcaccgacttcaagggcaaaacggtgtggtttgttccgtctatcaaggccgggaatgatattgcggcttgcctgcggaaaaacggaaagaaagtgatccagctgtccagaaagacattcgacagcgaatatgtcaagacccgcaccaatgattgggactttgtggttacaaccgatatttctgagatgggcgccaacttcaaagccgagcgggtgatcgaccccagacgctgtatgaagcctgtcattctcacagatggggaagaacgggtgatcctggctggccccatgcctgtgacccacagctccgccgcgcaaagacgcggacggatcggcagaaatcccaaaaacgaaaatgaccagtacatttacatgggggagccgcttgaaaacgacgaggattgcgcccattggaaggaggctaaaatgctgctcgacaatatcaacacgcctgaaggaattatcccctctatgtttgagcctgaacgcgagaaggtcgatgccattgacggcgaatatagactgagaggggaagctcgcaaaacattcgttgatctgatgagacggggagacctccccgtgtggcttgcctaccgcgtggctgccgagggcatcaattatgcggatagacggtggtgttttgacggggtcaagaacaatcagattctggaagagaacgtggaagttgagatctggaccaaggagggcgaacgcaagaagctgaaacctcgctggctcgatgcccggatctacagcgaccccctggctcttaaggagttcaaagagttcgccgctggaagaaagtccctgacactcaacctgattaccgagatgggccgcctgccgacgtttatgacccagaaggcccgggatgccctcgacaatcttgctgtgctgcacacagcggaagccgggggacgggcttataaccatgccctgtctgagctccctgagaccctggaaacacttctgctcctgaccctgctcgccacagtcaccggcgggatcttcctttttctgatgagcggaaaaggcgtgggcaagatgacgctggggatgtgctgcattatcacagcttccattctcctgtggtacgcccaaatccagccccactggatcgcggccagcattatccttgagttctttctgattgttctcctgatccccgaacctgagaaacagcggaccccgcaggataatcaactgacctatgtggtcattgctatcctcacagtggtcgccgctaccatggccaacgaaatgggattccttgagaagaccaagaaggacctgggcctggggtctatcgcgacgcaggagcccgaatccaatattctcgacatcgatctgcgccctgccagcgcttggaccctttacgccgtggctacaacctttgttacacccatgctgagacactccattgagaactctagcgtgaatgtgtccctcaccgccatcgctaaccaggccacggtcctgatgggactgggcaaggggtggcctctctctaaaatggacattggagttccccttctggcgatcggctgttacagccaggtgaatcctattaccctgacagccgctctcctgcttctggtggcccattatgctatcatcggcccggggctccaagccaaggccacccgggaagcgcagaaacgcgctgccgctggaattatgaagaaccccacagtcgatggcatcaccgtgattgacctggatcctatcccctacgaccctaaattcgagaagcagctggggcaggttatgctccttattctgtgcgtgacgcaagtcctgatgatgagaacaacctgggccctctgtgaagccctgacacttgctaccggacccatctccaccctgtgggagggcaatccggggcggttttggaacacaacgatcgccgtgagcatggcgaatattttccgcggatcttatctcgccggcgctggcctgctgttttccatcatgaagaacaccacaaataccagacgggggacaggaaacattggcgagaccctcggggaaaaatggaaaagccgccttaatgccctgggaaaatctgagttccagatctacaagaaatccggcattcaggaagtcgatagaacgctggctaaggaggggatcaaacggggagagacagaccaccatgccgtgagcagaggctctgcgaagctccgctggtttgttgaacggaacatggtgacccctgagggcaaggtcgtggatctggggtgcggaagaggcgggtggagctattactgtggaggccttaaagacgttcgcgaagtgaaggggctgaccaaaggaggccccggccacgaggaacccatccctatgtccacatatgggtggaacctcgtccggctgcaatctggagtggatgtgttcttcacaccccctgagaagtgcgacaccctgctctgtgatattggcgagagctccccgaatcccacgatcgaagccgggagaacccttcgcgttctgagcctggtcgagaactggctcaataacgacacacagttttgcattaaagtgctgaatccttacatgccctccgtgatcgaaaagatggagacccttcagcggaagtacggaggcgctctggtcagaaaccctctctctcgcaatagcacacatgaaatgtattgggtttccaacgccaccgggaatattgtgtctagcgtgaacatgatctcccggatgctgatcaatagattcacgatgaaacacaagaaagctacctacgagcccgacgtcgatctgggatctggcacacgcaacattggcatcgagagcgaaattccgaatctcgacatcattgggaagcggatcgagaaaattaagcaggaacacgagacctcctggcattatgatcaagaccacccttacaagacatgggcctatcatggaagctacgaaaccaaacagacaggctctgcttccagcatggtgaacggggttgtgagacttctgaccaagccctgggatgtcgtgcctatggttacgcagatggccatgacagacaccaccccctttggacagcaacgcgtgttcaaagagaaggtcgatacaagaacgcaggagcctaaagaaggcaccaagaagctgatgaaaatcacagcggagtggctctggaaggaactggggaaaaagaaaacaccccggatgtgtacacgcgaggagtttaccagaaaggtgcggtctaatgccgctcttggagccatcttcacagacgaaaacaaatggaagtccgctagagaggccgtggaagatagccggttttgggagctggtcgacaaggaacgcaacctccacctggagggcaaatgcgagacctgtgtttataatatgatgggcaagagagagaagaagctgggggagttcggaaaagccaagggctctcgggcgatttggtacatgtggctcggggctcgctttctggagttcgaggcccttggatttctgaacgaagatcactggttctccagagagaatagcctctccggcgtggagggggaaggcctgcataaacttggatacatcctgcgggacgtgagcaaaaaggagggcggggccatgtatgctgacgatacggccggatgggacacccgcattacactcgaagatctgaaaaacgaggaaatggtcaccaatcacatggagggcgagcataagaaactggctgaagccatctttaagctcacataccagaacaaggtggttagagtgcagcggccgacccctcgcgggacggtcatggacattatctctagacgggatcaacgcggaagcggccaggtggggacatatggcctgaataccttcacaaacatggaggcgcagcttatcagacaaatggaaggagagggcgttttcaaatccattcagcggctgaccgtgacggaggaaatcgccgtccagaattggctcgctcgcgtggggagagagcggctgtctagaatggccattagcggagacgattgcgttgtgaagccccttgacgatcgctttgcttccgccctgaccgcgctcaacgacatgggcaaagtccggaaggatatccagcaatgggaaccctctagagggtggaatgactggacacaggtgcctttctgcagccaccattttcacgagctgattatgaaagatggacgcgtcctggtggttccgtgtcggaaccaggacgaactcatcggcagagcccgcatctcccagggggctggctggtctctgaaggagaccgcctgccttggaaagagctacgctcaaatgtggtccctgatgtatttccaccggagagacctccgcctggccgctaatgccatttgtagcgcggtgccctctcattgggtccctacatcccggaccacatggagcatccacgccaaacatgagtggatgaccacggaagatatgcttacagtgtggaacagagtgtggattcaggagaatccctggatggaagacaagacccctgttgagtcttgggaagaggtgccctacctgggcaaacgcgaggatcagtggtgcgggtccctcatcggactgaccagccgggctacatgggccaagaacattcagaccgccatcaaccaagtcagatccctgattggcaatgaagagtatacagactacatgccttctatgaaacggtttagacgcgaagaggaagaggctggggtgctctggtga

SEQ ID NO: 20134 - RNA, 9876 nt, synthetic construct
  misc_feature 1..9876: note = derived and/or modified CDS sequence (opt5) from DENV-2__EU482784__SS-prME
  source 1..9876: mol_type = other RNA
agcgccggcatgatcattatgctgatccccaccgtgatggctttccacctcaccacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgttacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatccgcggcattatgcaagctgggaaacggtctcttagacctcagcccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgtcttttgtgactccaagctgatgagcgctgccatcaaggattctcgggctgtgcatgccgacatgggctattggatcgagtccgcgctcaatgatacctggaaaattgagaaggccagcttcatcgaagtcaaatcttgccactggcctaagagccatacactgtggtccaacggcgtgctggagagcgaaatgattatccccaaaaatttcgctgggccggtgtctcaacacaactacagacctggataccacacccagacggccggcccctggcatcttgggcgcctcgagatggactttgatttctgtgaaggaacaaccgtcgttgtgaccgaggactgcggcaaccgggggccctccctgagaacaaccacggctagcggaaagctgattacagagtggtgctgtcggtcctgcaccctccctccgctgcgctatagaggcgaagatggctgttggtacgggatggagatccggccccttaaggaaaaagaggaaaatctggtgaactctctcgtcacagccggacacggccagattgacaattttagcctgggggtgctgggaatggcccttttcctcgaggagatgctgagaacccgcatcggcacaaagcatgctatcctgctcgttgcggtgtcctttgtcaccctgattacggggaacatgtctttccgggatcttggaagagtgatggttatggtgggcgccaccatgacagacgatatcggcatgggggtcacctatctggctctcctggccgcctttaaagtgcgccctacattcgctgccggactgcttctgagaaagctcaccagcaaagaactgatgatgacgacaattggcatcgttctcctgtcccaatctaccattcccgagacagtgcttgaactgaccgacgcgctcgctctggggatgatggtcctgaagatcgtgcggaatatggagaagtaccagcttgccgtgaccatcatggccattctgtgcgtccctaacgctgttatcctccagaatgcctggaaagtgagctgtacaattctggcggtggtctccgtgagccccctcctgcttacgtcttcccagcaaaagaccgattggatccctctggctctcacaattaaaggactgaaccccaccgccatctttctgacaacccttagccgcacgaataagaaaagatcttggccgctgaacgaagccatcatggctgttggcatggtgtccattctcgccagctctctgctcaagaatgacatccctatgacagggcccctggtcgctggaggccttctgaccgtgtgctatgttctgaccggccggtccgccgacctcgagctggagcgcgcgacagatgtgaaatgggaagaccaggccgagattagcgggtccagccctatcctttctattaccatcagcgaagatggatccatgtctattaagaacgaggaggaagaacagacactgacgatcctcatcagaaccggcctgctcgtcattagcgggctgttccccatctccattccgatcacagctgccgcttggtacctttgggaagtgaagaaacagcgggccggagtcctgtgggacgtgccttctccccctcccatgggcaaggccgagctggaagatggggcttatcgcattaaacaaaagggaatcctcggctacagccagatcggcgcgggggtttacaaagagggaacctttcacacaatgtggcatgtgaccagaggcgccgtcctgatgcacaaggggaagcggattgagccctcctgggctgacgtgaaaaaggatcttatctcttatggaggcgggtggaaactggaaggagagtggaaggaaggcgaggaagttcaggtgctcgccctggagcctggcaaaaatccgcgcgccgtccagacgaagcccgggctgttcaagaccaacacaggaaccattggcgctgtgagcctggacttttcccctgggacaagcggatctcccatcattgataaaaagggcaaagtggttgggctttacggaaatggcgtcgtgaccagatccggcgcctatgtgagcgcgatcgctcaaacagagaagtctatcgaagacaaccctgagattgaagatgacatcttccggaaaagacgcctgacgattatggatctgcaccccggggccggaaagaccaagcggtacctccctgccatcgtcagagaggctattaaacgcggcctgcggacacttatcctggccccgaccagagtggttgcggctgaaatggaggaggccctccgcgggctgcccattcggtatcagacccctgccatcagagctgaacatacaggacgcgagatcgtggacctcatgtgtcacgccacgttcaccatgcggctgctttcccccgtcagagtgcctaactacaatctgattatcatggacgaagctcattttacagatcccgccagcattgcggcccggggctatatctccacccgcgttgagatgggggaggctgccggcattttcatgacagctaccccgcctggatctagagacccctttccccagagcaacgcccctatcatcgatgaagaacgggaaattcccgagcgctcctggaatagcggccacgaatgggtgacggacttcaaggggaaaacagtctggtttgtgccttctatcaaggccggaaacgatattgctgcgtgcctgcgcaaaaatggcaagaaggttatccaactctcccggaaaaccttcgacagcgagtacgtgaagaccagaacaaacgattgggactttgtcgtgaccacagatatttctgagatgggggccaatttcaaagctgaacgcgtgatcgacccgcggagatgtatgaagcccgtcatcctgaccgatggagaggaacgcgttattcttgccggccctatgcccgtgacgcatagctccgccgctcagcggagagggcgcatcggccggaaccctaaaaatgagaacgaccagtacatttatatgggagaacccctggagaatgacgaggattgcgcccactggaaggaagcgaaaatgctcctggacaacatcaatacaccggagggcattatcccttctatgtttgaacccgagagagaaaaggtggatgctattgacggggagtaccgcctgagaggagaggcccggaagaccttcgtcgatctcatgcgcagaggcgaccttcctgtgtggctggcctataaagttgctgccgaagggatcaactacgcggatcggcgctggtgttttgacggaatcaagaataaccagattctggaggaaaacgtggaggtcgagatctggacaaaagaaggcgagagaaagaaactcaagccccggtggctggatgccagaatttatagcgaccctcttgctctgaaggagttcaaagagttcgccgctgggcgcaagtccctcaccctgaatctgatcacggaaatgggccggctccccacctttatgacacagaagaccagagatgcccttgacaacctggctgtgctgcacacagccgaggcgggaggccgcgcctacaatcatgctctctctgagctgccggaaacccttgagacactgctcctgctgaccctccttgccacggttacagggggaattttcctgtttctgatgagcggccgggggatcggaaagatgaccctcggcatgtgctgcatcattaccgcttccatcctgctttggtatgcccagattcagcctcactggatcgccgctagcattatcctggagttctttctcatcgtgctgctgattcccgagcccgaaaaacagagaacacctcaagataaccagctcacctacgtcgtgatcgcgattcttacagtcgtggccgctacgatggccaatgagatgggcttcctggagaagaccaagaaagacctggggctcggatctatcgccacacagcagccggaatccaacattctggacatcgatcttcggcccgctagcgcctggaccctgtacgcggttgccacaacctttgtgacgcctatgctccgccattccattgaaaattctagcgtgaacgtctccctgaccgctatcgccaatcaagctacagttctgatgggcctcgggaagggatggcccctttctaaaatggacatcggcgtgcctctgctggccattgggtgttatagccaggtgaaccccatcaccctcacagcggccctgcttctgctcgtcgctcactacgccattatcggacctggcctgcaggctaaggccaccagagaagctcagaaacgggccgcggccggcattatgaagaatccgacggtggatgggatcacagttatcgacctggatcccattccttatgaccccaagttcgagaaacaactcggacaggtgatgcttctgatcctgtgcgtcacccaggtgctcatgatgcgcacaacctgggctctgtgtgaagcccttaccctggctacaggccctatttccacgctctgggaggggaaccccggaagattttggaataccacaatcgccgtcagcatggccaacattttccggggctcttacctggcgggggctggactgctcttttccatcatgaagaataccacaaacacccgcagaggcacgggcaatatcggggagacacttggagaaaaatggaaaagccggctgaacgccctgggcaaatctgagttccaaatttataagaaatccgggatccaggaagtggatcgcaccctcgctaaggagggaattaagagaggcgagaccgaccaccatgccgttagccgggggtctgccaaactgagatggtttgtggaacgcaacatggtcacaccggagggaaaggtggttgatcttggctgcggcagagggggatggagctactattgtggcgggctgaaaaatgtgcgggaagtcaagggactcaccaaaggcgggcctggacacgaggaacccatccccatgtccacatacggctggaacctggtgcgcctgcagtctggcgtggacgttttcttcattcctcccgagaagtgcgatacgctcctttgtgacatcggggagagctcccctaatccgaccgtcgaagctggacggacactgagagtgctgaacctcgtggagaattggctgaacaataacacccagttttgcatcaaggtccttaatccctacatgcctagcgttattgagaagatggaggccctgcaacgcaagtatggcggggcgctcgtgcggaaccccctgtccagaaattctacacatgaaatgtactgggtgagcaacgcctccggaaatatcgtctctagcgtgaacatgatttcccgcatgctgatcaatcggttcaccatgagacacaaaaaggctacgtatgagcctgatgttgacctcggctctgggacccgcaacattggaatcgagagcgaaattcccaaccttgacatcatcggcaaacggattgagaagatcaagcaggaacatgagacatcctggcactacgatcaggaccacccgtataaaacctgggcctaccatggcagctatgaaacaaagcagaccgggtctgcttccagcatggtgaatggagtcgtgagactgctgacaaaaccttgggatgttctccccaccgtgacgcaaatggccatgacagacaccaccccttttggccagcagcgcgtcttcaaggagaaagtggatacaagaacgcaggagcccaaggaagggaccaagaaactgatgaagattacagcggagtggctttggaaagaactgggaaagaaaaagacccctcggatgtgtacacgcgaggagtttaccagaaaagtgcggtctaacgccgctctcggcgccatcttcacagacgaaaataagtggaagtccgctagagaggccgtcgaagatagccggttttgggagctggttgacaaagaacgcaacctgcacctcgaggggaagtgcgagacctgtgtgtacaatatgatgggaaaaagagaaaagaaactgggcgagttcggcaaggctaaggggtctcgggccatttggtacatgtggcttggagcgcgctttctggagttcgaggccctcggctttctgaacgaagatcattggttctccagagagaatagcctttccggggtggagggagaaggcctgcacaaactcgggtatatcctgcgggacgtcagcaagaaagagggcggagctatgtacgccgatgacacggctggctgggacacccgcatcacactggaagatctcaagaacgaggaaatggtgaccaatcacatggagggggagcataaaaagctggccgaagccatttttaaacttacatatcaaaacaaagttgtgagagtccagcggcccaccccgcgcggaacggtgatggacatcatttctagacgggatcagcgcggcagcgggcaagttggaacatacggcctgaataccttcacaaacatggaggcgcagctcatcagacagatggaaggggagggcgtgttcaagaatattcagcacctgaccgtcacggaggaagtggctgttcataactggcttgcccgggtgggacgcgagagactgtcccggatggccatctctggcgacgattgcgtcgtgaaacctctcgacgatagatttgctaatgccctgaccgctctgaacgacatggggaagatccgcaaagatattcaacagtgggaacccagcaagggatggaacgactggacacaggtccccttctgctcccaccattttcacgagctcatcatgaaggatggccgggtgctggttgtgccttgtagaaatcaggacgaacttattgggcgcgcccggatctctcaaggagcgggctggagcctgagagagaccgcctgcctcgggaaatcctatgctcagatgtggtctctgatgtacttccaccgccgggatcttagactggccgctaacgccatttgtagcgcggtcccgtcccattgggtgcccacaagccgcaccacatggtctatccacgccaagcatgagtggatgaccacggaagacatgctcacagtgtggaatcgggtttggattagagagaacccttggatggaagacaaaacccccgtggagtcctgggaagagatcccttatctgggcaagcgcgaggatcagtggtgcggaagcctgatcggcctcacctctcgggctacatgggccaaaaatattcaggctgccatcaaccaagtcagatccctgattgggaatgaagagtacaccgactacatgcccagcatgaagcggtttagacgcgaagaggaagaggctggagtgctttggtga

SEQ ID NO: 20135 - RNA, 9876 nt, synthetic construct
  misc_feature 1..9876: note = derived and/or modified CDS sequence (opt5) from DENV-2__EU482785__SS-prME
  source 1..9876: mol_type = other RNA
accgccggcgtgatcattatgctgatccccaccgctatggccttccacctcacgaccagaaacggggaacctcatatgattgtcggacggcaggaaaagggcaaaagcctgctttttaagaccgaagacggggttaatatgtgcaccctgatggcgatcgatctcggagaactgtgtgaggacacaattacctacaaatgcccccttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaaggcgggatcgttacatgcgccatgtttacatgcaaaaagaatatggaagggaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtgacggtcagctttgtgaccctgattacaggaaacatgtccttccgggaccttggcagagttatggtgatggtcggcgccgccatgaccgatgacatcgggatgggagtgacatacctggctctcctggccgcgtttaaggttcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtcgggatggttagcatcctggcttcttccctcctgaaaaacgacattcccatgacgggacctctcgtggccggcggcctgcttacagtgtgctacgtcctgaccgggcggagcgccgatctggaactcgagcgcgctaccgacgtgaagtgggaggatcaagcggaaatctccggaagctctcccattctgagcatcacaattgccgaggacggctccatgtctatcaaaaatgaagaggaggaacagacccttacaatcctgattagaacggggctcctggttatcagcggactcttcccggtgtccattcctatcaccgctgccgcctggtatctgtgggaggtcaagaagcagcgggctggcgtgctttgggatgttccctctcctccgcccgtggaaaaagccgagctggaagacggggcgtaccgcattaagcagaaaggaatcctgggctatagccaaatcggcgctggggtctacaaggagggaacatttcacaccatgtggcacgtgacaagaggcgccgtcctcatgcatcgggggaaacgcattgagccttcctgggccgatgtgaagaaggacctgatctcttacggaggcgggtggaaacttgaaggagagtggaaggaaggcgaggaagttcaggtgctggctctcgagccgggcaaaaaccccagagccgtccagaccaagcctgggctgttcaaaacgaataccggaacaattggcgcggtgagcctcgatttttcccccgggaccagcggatctcctatcgttgaccggaagggcaaggtggtcgggctgtatggaaacggcgtggtgacaagatccggcgcttacgttagcgccattgcccagaccgagaaatctatcgaagataatcccgagatcgaagacgatattttccgcaagaaacggcttacaatcatggacctgcaccctggggctggaaagacgaaaagatatctgccggccattgtccgcgaggctatcaagcggggcctcagaaccctgattcttgcccccacacgcgtggtggcggccgaaatggaggaggctctgcgggggctccctatcagataccaaacccccgccattcgcgctgaacataccggacgggagatcgtcgacctgatgtgtcacgccacattcacgatgagactcctgtcccctgtgcgggttcccaactataaccttatcattatggatgaagcccattttaccgacccggctagcatcgcggcccgcggctacatttccacaagagtggagatgggggaggctgccggcatcttcatgaccgccacacctcccggatctcgggatccctttcctcagagcaatgctcccattatggacgaagaaagagaaatccctgagagatcctggaacagcggccacgaatgggtcaccgatttcaaggggaaaacggtgtggtttgttccgtctatcaaggccggaaatgacattgcggcttgcctgcggaaaaacggcaagaaagtgatccagctgtccagaaagacattcgatagcgagtatgtcaagacccgcaccaatgactgggattttgtggttacaaccgacatttctgagatgggggccaacttcaaagccgaacgggtgatcgatcccagacgctgtatgaagcctgtcattctcacagacggagaggaacgggtgatcctggctggccccatgcctgtgacccacagctccgccgcgcaaagacgcgggcggatcggcagaaatcccaaaaacgagaatgaccagtacatttacatgggagaaccgcttgagaacgatgaggactgcgcccattggaaggaagctaaaatgctgctcgataatatcaacacgcctgagggcattatcccctctatgtttgaacctgagcgcgaaaaggtcgacgccattgatggggagtatagactgcggggagaggctcgcaaaacattcgttgacctgatgagacggggcgatctccccgtgtggcttgcctaccgcgtggctgccgaagggatcaattatgcggacagacggtggtgttttgatggagtcaagaacaatcagattctggaggaaaacgtggaggttgagatctggaccaaggaaggcgagcgcaagaagctgaaacctcgctggctcgacgcccggatctacagcgatcccctggctcttaaggagttcaaagagttcgccgctgggagaaagtccctgacactcaacctgattaccgaaatgggccgcctgccgacgtttatgacccagaaggcccgggacgccctcgataatcttgctgtgctgcacacagcggaggccggaggcagagcttataaccatgccctgtctgagctccctgaaaccctggagacacttctgctcctgaccctgctcgccacagtcaccgggggaatcttcctttttctgatgagcggcaaaggggtgggaaagatgacgctgggcatgtgctgcattatcacagcttccattctcctgtggtacgcccaaatccagccccactggatcgcggccagcattatccttgagttctttctgattgttctcctgatccccgagcctgaaaaacagcggaccccgcaggacaatcaactgacctatgtggtcattgctatcctcacagtggtcgccgctaccatggccaacgagatgggcttccttgagaagaccaagaaggacctggggctgggatctatcgcgacgcaggaacccgagtccaatattctcgatatcgacctgcgccctgccagcgcttggaccctttacgccgtggctacaacctttgttacacccatgctgagacactccattgaaaactctagcgtgaatgtgtccctcaccgccatcgctaaccaggccacggtcctgatgggcctggggaagggatggcctctctctaaaatggatattggcgttccccttctggcgatcgggtgttacagccaggtgaatcctattaccctgacagccgctctcctgcttctggtggcccattatgctatcatcggaccgggcctccaagccaaggccacccgggaggcgcagaaacgcgctgccgctggcattatgaagaaccccacagtcgacggggtgaccgttatcgatctggaccctattccctacgatcctaaattcgaaaagcagctgggacaggtgatgctccttatcctgtgcgtcacgcaagtgctgatgatgagaacaacctgggccctctgtgaggccctgacacttgctaccggccccatttccaccctgtgggaggggaatccgggacggttttggaacacaacgatcgccgtcagcatggcgaatatcttccgcggctcttatctcgccggggctggactgctgttttccattatgaagaacaccacaaataccagacggggcacaggcaacatcggggaaaccctcggagagaaatggaaaagccgccttaatgccctgggcaaatctgagttccagatttacaagaaatccgggatccaggaggtggacagaacgctggctaaggagggaattaaacggggcgaaacagatcaccatgccgttagcagagggtctgcgaagctccgctggtttgtggagcggaacatggtcacccctgaaggaaaggtggttgacctgggctgcggcagagggggatggagctattactgtggcgggcttaaagatgtgcgcgaggtcaagggactgaccaaaggcgggcccggacacgaagaacccatccctatgtccacatatggctggaacctcgtgcggctgcaatctggcgtggacgttttcttcacaccccctgagaagtgcgataccctgctctgtgacatcggggaaagctccccgaatcccacgattgaggccggaagaacccttcgcgtcctgagcctggtggaaaactggctcaataacgacacacagttttgcatcaaagtgctgaatccttacatgccctccgtcattgagaagatggaaacccttcagcggaagtacggcggggctctggttagaaaccctctctctcgcaatagcacacatgagatgtattgggtgtccaacgccaccggaaatatcgtgtctagcgtcaacatgatttcccggatgctgatcaatagattcacgatgaaacacaagaaagctacctacgagcccgatgtggacctgggctctgggacacgcaacatcggaattgaaagcgagatcccgaatctcgatattatcggcaagcggattgagaagatcaagcaggagcacgaaacctcctggcattatgaccaagatcacccttacaagacatgggcctatcatggcagctacgagaccaaacagacagggtctgcttccagcatggttaacggagtggtcagacttctgaccaagccctgggacgtggttcctatggtgacgcagatggccatgacagataccaccccctttggccagcaacgcgtcttcaaagagaaggtggacacaagaacgcaggaacctaaagaggggaccaagaagctgatgaaaattacagcggaatggctctggaaggagctgggcaagaagaaaacaccccggatgtgtacacgcgaggaatttaccagaaaggtgcggtctaatgccgctcttggcgccatcttcacagatgagaacaaatggaagtccgctagagaagccgtcgaggacagccggttttgggaactggttgataaggagcgcaacctccacctggaggggaaatgcgaaacctgtgtgtataatatgatgggaaagagagagaaaaagctgggcgagttcggcaaagccaaggggtctcgggcgatctggtacatgtggctcggagctcgctttctggagttcgaagcccttggctttctgaacgaggaccactggttctccagagagaatagcctctccggggtggaaggagagggcctgcataaacttgggtacattctgcgggacgtcagcaaaaaggaaggcggagccatgtatgctgatgacacggccggctgggatacccgcatcacactcgaggacctgaaaaacgaagagatggtgaccaatcacatggagggggaacataagaaactggctgaggccatttttaagctcacataccagaacaaggttgtgagagtccagcggccgacccctcgcggaacggtgatggatatcatttctagacgggaccaacgcggcagcgggcaggttggaacatatggcctgaataccttcacaaacatggaagcgcagcttatcagacaaatggagggggagggcgtgttcaaatccatccagcggctgaccgtcacggaagagattgccgtgcagaattggctcgctcgcgttggaagagaacggctgtctagaatggccatcagcggcgatgactgcgtggtcaagccccttgatgaccgctttgcttccgccctgaccgcgctcaacgatatggggaaagtgcggaaggacattcagcaatgggagccctctagaggatggaatgattggacacaggtccctttctgcagccaccattttcacgaactgatcatgaaagacggccgcgtgctggttgtgccgtgtcggaaccaggacgagctcattgggagagcccgcatctcccagggagctggctggtctctgaaggagaccgcctgccttggaaagagctacgctcaaatgtggtccctgatgtatttccaccggagagatctccgcctggccgctaatgccatctgtagcgcggtcccctctcattgggtgcctacatcccggaccacatggagcattcacgccaaacatgaatggatgaccacggaggacatgcttacagtgtggaacagagtttggatccaggaaaatccctggatggaggataagacccctgtggaatcttgggaggaggtcccctacctgggcaaacgcgaagaccagtggtgcggatccctcattggcctgaccagccgggctacatgggccaagaacatccagaccgccattaaccaagtgagatccctgatcgggaatgaggaatatacagattacatgccttctatgaaacggtttagacgcgaggaagaggaggctggagttctctggtga

SEQ ID NO: 20136 - RNA, 9876 nt, synthetic construct
  misc_feature 1..9876: note = derived and/or modified CDS sequence (opt5) from DENV-2__EU482786__SS-prME
  source 1..9876: mol_type = other RNA
agcgccggaatgatcattatgctgatccccaccgtgatggctttccacctcacgacgagaaatggggagcctcatatgattgtcgggatccaggaaaagggaaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagagatacgtgctgggacgcctgattacagtcaaccctatcgtgacgggcaaggattctccggttaacattgaggcggaacccccttttggggactcctacatcattatcggcgtggagcccggacagctcaagctgaattggttcaaaaagggcagctctattgggcaaatgtttgagaccacaatgcggggagccaaaagaatggctatccttggcgataccgcctgggacttcgggagcctgggaggcgtctttacatccatcgggaaggccctccatcaggtgttcggcgctatttatggagccgcgttttctggcgtgagctggaccatgaaaatcctgattggggttatcattacgtggatcggaatgaactcccgcagcacatctctgtccgtcagccttgtgctcgtgggcatcgtcaccctgtacctgggggtgatggttcaggctgattctggatgtgtggtctcctggaagaataaggaactcaaatgcggcagcgggattttcatcaccgacaacgtgcacacatggaccgagcagtataagtttcaacctgaatccccctctaaactggccagcgccattcagaaggctcaggaggaaggcatctgtggcattcggtccgttacaagacttgagaatctgatgtggaaacagatcacgccggagctcaaccacatcctggccgaaaatgaggtgaagctgaccattatgacaggcgatatcaaagggattatgcaagctggaaagcgctctcttcggcctcagcccaccgaactcaagtacagctggaaaacatggggcaaggccaaaatgctgtccaccgagagctataaccagacgttcctgatcgacgggcctgaaaccgcggagtgccccaatacaaacagagcctggaactctctcgaggtcgaagattacggatttggcgtgttcaccacaaacatttggctgaaacttaaagagaagcaggacgctttttgtgactccaagctgatgagcgccgctatcaaagataatcgcgccgttcatgcggacatgggctattggatcgaatctgccctcaacgatacctggaagattgagaaggctagcttcatcgaggtgaagaattgccactggcctaaaagccatacactgtggtctaacggggtcctggaaagcgagatgattatccccaagaaccttgccggaccggtgtcccaacacaattaccggcctggctaccacacccagattgctgggccctggcatctcggaaagctggaaatggacttcgatttttgtgacggcacgacagtgatcgtcaccgaggattgcgggaacagaggacccagcctgcgcaccacaaccgcctctggcaaactcattacggaatggtgctgtcggtcctgcacactgcctccgcttagatatcggggcgaggacgggtgttggtacggaatggagatccgccccctgaaggaaaaagaggaaaatctcgttaacagcctggtgaccgccggccacgggcaggtcgataatttctccctgggagtccttggcatggctctctttctggaggaaatgctgagaacacgggtggggaccaagcatgcgatcctcctggttgccgtgtctttcgtcacacttattaccggaaacatgagctttaaagacctgggcagagtggttgtgatggtcggcgctacgatggccgatgacatcgggatgggagtgacctatctcgccctgctggctgccttcaaggttcgccctacatttgcggctggccttctgctccggaagctgacctccaaagagctcatgatgacaaccattgggatcgtgctgctttctcaaagcacgattcccgagacagtcctggaactcaccgatgccctggccctgggaatgatggtgcttaagatcgtgagaaatatggagaaataccagctggctgtcacaatcatggccattctctgcgttcctaacgcggtggtgctgcagaatgcttggaaggtctcctgtaccatcctcgccgtggtttctgtgagccccctgcttctgacctccagccagcagaagaccgactggattcctctcgccctgacgatcaagggcctgaaccccaccgctattttccttacaaccctgtctcgcacaaataaaaagagatcctggccgctcaacgaagccatcatggctgtcgggatggtgagcatcctggcctcttccctcctgaagaatgacattcctatgaccggaccccttgttgcgggcggcctgctgacggtgtgctatgtcctcacagggcggagcgccgatctggagcttgaacgcgctaccgacgtgaaatgggaggatcaggccgagatctctggatccagccctattctgtccatcaccattagcgaagacggctctatgagcatcaagaacgaggaagaggagcagacactcaccattctgatcagaacagggctcctggtcatctccggactttttcccatttctatcccgattacggctgccgcctggtacctgtgggaagtgaaaaagcagcgggctggcgttctgtgggatgtgccttctccccctcccatggggaaagcggagctcgaagacggagcctatcgcatcaagcaaaagggcattctgggctactcccagatcggggctggagtctacaaagagggcaccttccacacaatgtggcatgtgaccagaggggccgttcttatgcacaagggaaaacggatcgaaccctcctgggccgatgtgaagaaagacctgattagctatggcgggggatggaagctcgagggcgagtggaaggaaggcgaggaagtccaggtgctggctctcgagcctgggaaaaatccgcgcgccgtgcagacaaagcccggactgtttaaaaccaacacgggcaccatcggggcggtttcccttgatttctctcctggaacaagcggctcccccattatcgacaagaaagggaaggtcgtgggactgtacggcaacggcgtggtcaccagaagcggggcttatgtgtctgccattgcccaaacagaaaagtccatcgaggataatcctgagatcgaagacgatatttttcggaaacgcagactgaccatcatggacctccaccccggagctggcaagacaaaacggtacctgcctgccattgttagagaggcgatcaagcgcgggcttcggacgctgattctcgctccgaccagagtggtcgccgccgaaatggaggaagctctgcgcggactccccatccggtatcagacccctgccattaaagctgagcataccggcagagagatcgtggacctgatgtgtcacgccaccttcacaatgcgccttctgagccccgttcgggtgcctaactacaatctgatcattatggatgaagcgcatttcacggaccccgcctctatcgctgccagagggtatatttccacccgcgtcgagatgggcgaagctgccggaatctttatgacagccaccccgcctggcagccgggatcccttcccccagtccaacgctcctattatcgacgaggagagagaaatccccgagcggtcttggaatagcgggcacgaatgggtgacagattttaagggaaagaccgtttggttcgtgccttccattaaagcgggcaacgacatcgccgcttgcctccgcaagaatgggaaaaaggtcattcaactgagcagaaaaacgtttgattctgagtacgtgaagacacggaccaacgactgggatttcgtggtcaccacagacatctccgaaatgggagccaattttaaagccgagcgcgttattgatccgagacggtgtatgaagcccgtgatccttaccgacggcgaggaaagagtgatcctggctgggcctatgcccgtcacacatagctctgccgcgcagcgccggggcagaattggacgcaaccctaagaatgagaacgaccagtacatctatatgggcgaacccctcgagaatgatggggactgcgctcactggaaagaagccaagatgctgctggataacattaataccccggagggaatcattcctagcatgttcgagcccgaacgggagaaagtggacgccatcgatggcgaatacagactccgcggggaggctcggaagacgtttgttgaccttatgagacgcggagatctgcctgtgtggctggcctataaagtcgcggccgaaggcattaactacgctgacagacggtggtgtttcgatgggatcaagaacaatcagatcctcgaggagaacgtggaagttgagatttggacaaaggaaggcgagcgcaaaaagctgaaacccagatggcttgacgcccggatctattccgatcctctggctctcaaggagtttaaagagttcgccgctggacgcaagtctctgaccctgaatctcattacagagatgggcagacttcccaccttcatgacgcaaaagacccgggacgccctggataacctggcggtgctccacacagccgaagctgggggcagagcctacaatcatgctctgagcgagcttccggaaaccctggagacactcctgctgctcacccttctggccacagtcaccggcgggatctttctgttcctcatgtccggacgcggcattggcaaaatgacgctggggatgtgctgcatcatcacagcctctattcttctgtggtatgctcagatccagcctcactggattgcggccagcatcattctcgagtttttcctgatcgtgctgctcatccccgaacccgagaagcagcggacccctcaagacaaccagcttacctacgtcgtgattgctatcctgacagttgtggccgccaccatggctaatgaaatgggatttctggagaaaacaaagaaagacctcggcctggggtccattgccacgcagcagccggaaagcaacatccttgatattgacctgagacccgcgtctgcctggaccctctacgctgtggccacaaccttcgtcacacctatgctgcgccattccatcgagaatagctccgttaacgtgtctctgaccgctattgccaatcaagcgacggtgctcatgggacttggcaaggggtggcccctgagcaagatggatatcggagtccctctgctcgccatcggctgttattcccaggtgaaccccattaccctgacagctgcccttctgctcctggttgctcactacgccatcattggccctgggctgcaggctaaagccacccgggaggcgcagaagagagccgctgccggaatcatgaaaaatccgacagtggacggcattaccgtcatcgatctcgaccccatcccttatgatcccaagtttgaaaaacaacttggacaggtgatgctgctgattctctgcgtcacacaggtgctgatgatgcggacaacctgggctctttgtgaggccctgacactcgccaccggacctatctctaccctgtgggaaggcaaccccgggcgcttctggaatacaacgattgcggttagcatggctaacatctttagaggatcctacctggccggcgctggcctccttttcagcattatgaagaataccacaaacacccggcgcgggacaggaaacatcggcgagaccctgggggaaaaatggaagtctagactgaatgccctcggaaagtccgagtttcaaatctataaaaagagcggcattcaggaggtggaccggacgctggccaaagaagggatcaagcgcggagagacagatcaccatgctgtctctagaggctccgccaaacttcggtggttcgtggaacgcaacatggttaccccggagggcaaggtggtcgacctggggtgcggaagaggcgggtggagctactattgtggaggcctcaagaatgtgcgggaggtgaaagggctgaccaagggaggccctggccacgaagaacccattcccatgtctacatacgggtggaacctggttagactccagagcggagtcgatgtgtttttcatccctcccgaaaaatgcgacacccttctgtgtgatattggcgagtcctctcctaatccgacagtggaagcggggcgcacgctgcgggtcctcaacctggttgagaattggcttaacaataacacccagttctgcatcaaggtgctgaatccctacatgcctagcgtgatcgagaaaatggaagccctccaaagaaagtatggaggcgctctggtccgcaaccccctgtcccggaatagcacacatgagatgtactgggtgtccaacgcctctgggaatattgttagctccgtgaacatgatctctagaatgctcattaaccgctttaccatgcggcacaagaaagctacatatgaacctgacgtcgaccttggaagcggcaccagaaatatcggcattgagtccgaaatccccaacctggatattatcgggaagcgcatcgagaaaattaagcaggagcatgaaacgtcttggcactacgaccaggatcacccgtataaaacctgggcctaccatggaagctatgagacaaagcagaccggctccgcgagctctatggtgaatggggttgtgcggctgctcacaaagccttgggacgtcctgcccaccgtgacacaaatggccatgaccgatacgacacctttcggacagcagagagtgtttaaagaaaaggtcgacacccgcacccaggagcccaaagaaggcacaaagaaacttatgaagatcacggctaaatggctgtggaaggagctcgggaagaaaaagacccctcggatgtgtacaagagaggagttcacccgcaaagttagatccaacgccgctctgggagccatttttacagatgagaataagtggaaaagcgctcgggaagccgtggaggactctcgcttctgggagctggtggataaggaaagaaacctccacctggagggcaagtgcgaaacctgtgtctacaatatgatgggcaaacgggagaagaaacttggggaatttggaaaggcgaaaggctccagagccatctggtacatgtggctgggggctcggttcctcgagtttgaggccctgggattccttaacgaagaccattggtttagccgcgaaaattctctgtccggcgtggaaggggagggcctccacaagctgggatatattctgagagatgttagcaagaaagaaggcggggctatgtacgccgacgacacagccggatgggatacccggatcacgctcgaggacctgaagaacgaggaaatggtgaccaatcacatggagggcgaacataagaaacttgcggaggctatcttcaaactgacatatcaaaacaaagtcgtgcgcgttcagagacccaccccgcgggggacagtgatggatattatctcccgcagagaccagcggggaagcggccaagtcgggacctacggcctcaatacgtttacaaacatggaagcccagctgattcgccagatggagggagagggcgtgttcaagaatatccagcaccttaccgttacagaagaggtggccgtccaaaactggctggctagagtggggcgggaacgcctctctagaatggccattagcggagatgactgcgtcgtgaaacctctggatgaccggttcgctaacgccctgaccgcgctcaatgatatgggcaagatccgcaaagacatccagcagtgggagccctccaaggggtggaacgattggacgcaggttcccttttgctctcatcacttccatgagctgattatgaaagacggaagagtgcttgtcgtgccttgtcggaatcaagatgaactgatcggcagagcccgcattagccagggggctggctggtccctccgggagaccgcctgcctgggaaagtcttatgctcagatgtggagccttatgtactttcacagacgcgacctgcggctcgccgcgaacgccatctgttccgctgtgccgtctcactgggttcccacaagcagaaccacatggtccattcatgccaagcacgaatggatgaccacagaggacatgctgaccgtgtggaatcgcgtctggatccgggaaaacccttggatggaggataaaacgcccgtggagagctgggaagagattccttatctgggcaagagagaagaccagtggtgcgggtctctcatcggactgacatcccgcgctacctgggccaaaaatatccaagctgccattaaccaggttcggagccttatcggcaatgaggaatacaccgattacatgccctctatgaagagattccgccgggaggaggaagaggcgggggtgctgtggtga

SEQ ID NO: 20137 - RNA, 9876 nt, synthetic construct
  misc_feature 1..9876: note = derived and/or modified CDS sequence (opt5) from DENV-2__EU482787__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaagaacaggacaaacgctttgtgtgcaagcattccatggtggatagaggctggggcaacgggtgtggactgttcggcaaagggggcatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtgacggtcagctttgtgaccctgattacaggaaacatgtccttccgggaccttggcagagttatggtgatggtcggcgccgccatgaccgatgacatcgggatgggagtgacatacctggctctcctggccgcgtttaaggttcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtcgggatggttagcatcctggcttcttccctcctgaaaaacgacattcccatgacgggacctctcgtggccggcggcctgcttacagtgtgctacgtcctgaccgggcggagcgccgatctggaactcgagcgcgctaccgacgtgaagtgggaggatcaagcggaaatctccggaagctctcccattctgagcatcacaattgccgaggacggctccatgtctatcaaaaatgaagaggaggaacagacccttacaatcctgattagaacggggctcctggttatcagcggactcttcccggtgtccattcctatcaccgctgccgcctggtatctgtgggaggtcaagaagcagcgggctggcgtgctttgggatgttccctctcctccgcccgtggggaaagccgaactggaggacggagcgtaccgcattaagcagaaaggcatcctgggctatagccaaatcggggctggagtctacaaggaaggcacatttcacaccatgtggcacgtgacaagaggggccgtcctcatgcatcggggaaaacgcattgagccttcctgggccgatgtgaagaaggacctgatctcttacggcgggggatggaaacttgagggcgaatggaaggagggcgaagaggttcaggtgctggctctcgaaccggggaaaaaccccagagccgtccagaccaagcctggactgttcaaaacgagcaccggcacaattggggcggtgtccctcgattttagccccggaacctctggctcccctatcgttgaccggaaggggaaggtggtcggactgtatggcaatggcgtggtgacaagaagcggggcttacgtttctgccattgcccagaccgagaaatccatcgaggataaccccgaaatcgaggacgatattttccgcaagaaacggcttacaatcatggacctgcaccctggagctggcaagacgaaaagatatctgccggccattgtccgcgaagctatcaagcgggggctcagaaccctgattcttgcccccacacgcgtggtggcggccgagatggaagaggctctgcggggactccctatcagataccaaacccccgccattcgcgctgagcataccggccgggaaatcgtcgacctgatgtgtcacgccacattcacgatgagactcctgagccctgtgcgggttcccaattataaccttatcattatggatgaggcccattttaccgacccggcttccatcgcggcccgcgggtacatttctacaagagtggaaatgggcgaggctgccggaatcttcatgaccgccacacctcccggcagccgggatccctttcctcagtccaacgctcccattatggacgaggaacgcgagatccctgaaagaagctggaactctgggcacgagtgggtcaccgatttcaagggaaaaacggtgtggtttgttccgtccatcaaggccggcaatgacattgcggcttgcctgcggaaaaatgggaagaaagtgatccagctgagcagaaagacattcgattctgaatatgtcaagacccgcaccaacgactgggattttgtggttacaaccgacattagcgagatgggagccaatttcaaagccgagcgggtgatcgatcccagacgctgtatgaagcctgtcattctcacagacggcgaagaacgggtgatcctggctgggcccatgcctgtgacccactcctctgccgcgcaaagacgcggccggatcggaagaaaccccaaaaatgaaaacgaccagtacatttacatgggcgagccgcttgaaaatgatgaggactgcgcccattggaaggaggctaaaatgctgctcgataacatcaatacgcctgaagggattatccccagcatgtttgagcctgaacgcgagaaggtcgacgccattgatggagaatatagactgcggggcgaggctcgcaaaacattcgttgacctgatgagaagaggggatctccccgtgtggcttgcctaccgcgtggctgccgagggaatcaactatgcggacagacggtggtgttttgatggcgtcaagaataaccagattctggaagagaatgtggaagttgagatctggaccaaggagggggaacgcaagaagctgaaacctcgctggctcgacgcccggatctactccgatcccctggctcttaaggagttcaaagagttcgccgctggcagaaagtctctgacactcaacctgattaccgagatgggacgcctgccgacgtttatgacccagaaggcccgggacgccctcgataaccttgctgtgctgcacacagcggaagccggcgggagagcttataatcatgccctgagcgagctccctgagaccctggaaacacttctgctcctgaccctgctcgccacagtcaccggaggcatcttcctttttctgatgtccgggaaaggagtgggcaagatgacgctgggcatgtgctgcattatcacagctagcattctcctgtggtacgcccaaatccagccccactggatcgcggcctctattatccttgagttctttctgattgttctcctgatccccgaacctgagaaacagcggaccccgcaggacaaccaactgacctatgtggtcattgctatcctcacagtggtcgccgctaccatggccaatgaaatggggttccttgagaagaccaagaaggacctgggactgggctccatcgcgacgcaggagcccgaaagcaacattctcgatatcgacctgcgccctgcctccgcttggaccctttacgccgtggctacaacctttgttacacccatgctgagacactctattgagaatagctccgtgaacgtgtctctcaccgccatcgctaatcaggccacggtcctgatggggctgggaaagggctggcctctcagcaaaatggatattggggttccccttctggcgatcggatgttactcccaggtgaaccctattaccctgacagccgctctcctgcttctggtggcccattatgctatcatcggcccgggcctccaagccaaggccacccgggaagcgcagaaacgcgctgccgctgggattatgaagaatcccacagtcgacggagtgaccgttatcgatctggaccctattccctacgatcctaaattcgagaagcagctgggccaggtgatgctccttatcctgtgcgtcacgcaagtgctgatgatgagaacaacctgggccctctgtgaagccctgacacttgctaccgggcccattagcaccctgtgggagggaaacccgggccggttttggaatacaacgatcgccgtctctatggcgaacatcttccgcgggtcctatctcgccggagctggcctgctgtttagcattatgaagaataccacaaacaccagacggggcacagggaatatcggagagaccctcggcgaaaaatggaagtctcgccttaacgccctggggaaatccgagttccagatttacaagaaaagcggaatccaggaagtggacagaacgctggctaaggagggcattaaaagaggggaaacagatcaccatgccgtttctagaggaagcgcgaagctccgctggtttgtggaacggaatatggtcacccctgagggcaaggtggttgacctgggctgcgggagaggaggctggtcctattactgtgggggacttaaagatgtgcgcgaagtcaagggcctgaccaaagggggacccggccacgaggaacccatccctatgtctacatatggctggaacctcgtgcggctgcaaagcggggtggacgttttcttcacaccccctgagaagtgcgataccctgctctgtgacatcggagagtccagcccgaaccccacgattgaagccggcagaacccttcgcgtcctgtccctggtggagaattggctcaacaatgacacacagttttgcatcaaagtgctgaacccttacatgccctctgtcattgaaaagatggagacccttcagcggaagtacgggggagctctggttagaaatcctctcagccgcaactccacacatgaaatgtattgggtgtctaatgccaccggcaacatcgtgagctccgtcaatatgatttctcggatgctgatcaacagattcacgatgaaacacaagaaagctacctacgagcccgatgtggacctggggagcggaacacgcaatatcggcattgagtccgaaatcccgaacctcgatattatcggcaagcggattgagaaaatcaagcaggaacacgagaccagctggcattatgaccaagatcacccttacaagacatgggcctatcatgggtcttacgaaaccaaacagacaggatccgctagctctatggttaatggcgtggtcagacttctgaccaagccctgggacgtggttcctatggtgacgcagatggccatgacagataccaccccctttgggcagcaacgcgtcttcaaagagaaggtggacacaagaacgcaggagcctaaagaaggaaccaagaagctgatgaaaattacagcggagtggctctggaaggaactgggcaaaaagaaaacaccccggatgtgtacacgcgaggagtttaccagaaaggtgcggtccaacgccgctcttggggccatcttcacagatgaaaataaatggaaaagcgctagagaggccgtcgaagactctcggttttgggagctggttgataaggaacgcaacctccacctggagggaaaatgcgagacctgtgtgtataacatgatgggcaagagagagaagaagctgggcgagttcgggaaagccaagggatcccgggcgatctggtacatgtggctcggcgctcgctttctggagttcgaggcccttgggtttctgaatgaagaccactggttcagcagagagaactccctcagcggagtggagggcgaagggctgcataaacttggctacattctgcgggacgtctctaaaaaggagggaggcgccatgtatgctgatgacacggccgggtgggatacccgcatcacactcgaagacctgaaaaatgaggaaatggtgaccaaccacatggagggagagcataagaaactggctgaagccatttttaagctcacataccagaataaggttgtgagagtccagcggccgacccctcgcggcacggtgatggatatcattagcagacgggaccaacgcgggtccggacaggttggcacatatgggctgaacaccttcacaaatatggaggcgcagcttatcagacaaatggaaggcgagggagtgttcaaatctatccagcggctgaccgtcacggaggaaattgccgtgcagaactggctcgctcgcgttggcagagagcggctgagcagaatggccatctccggggatgactgcgtggtcaagccccttgatgaccgctttgcttctgccctgaccgcgctcaatgatatgggaaaagtgcggaaggacattcagcaatgggaacccagcagaggctggaacgattggacacaggtccctttctgctcccaccattttcacgagctgatcatgaaagacgggcgcgtgctggttgtgccgtgtcggaatcaggacgaactcattggacgggcccgcatctctcagggcgctgggtggagcctgaaggagaccgcctgccttggcaagtcctacgctcaaatgtggagcctgatgtatttccaccggagagatctccgcctggccgctaacgccatctgttctgcggtcccctcccattgggtgcctacaagccggaccacatggtctattcacgccaaacatgagtggatgaccacggaagacatgcttacagtgtggaatagagtttggatccaggagaacccctggatggaagataagacccctgtggagtcctgggaagaggtcccctacctgggaaaacgcgaggaccagtggtgcggcagcctcattgggctgacctcccgggctacatgggccaagaatatccagaccgccattaaccaagtgagatctctgatcggaaacgaagagtatacagattacatgcctagcatgaaacggtttagacgcgaagaggaagaggctggcgttctctggtga

SEQ ID NO: 20138 - RNA, 9876 nt, synthetic construct
  misc_feature 1..9876: note = derived and/or modified CDS sequence (opt5) from DENV-2__EU482788__SS-prME
  source 1..9876: mol_type = other RNA
accgccggcgtgatcattatgctgatccccaccgctatggccttccacctcacgacccggaacggggagcctcatatgattgtcggacggcaggaaaagggcaagagcctgctttttaagaccgaggacggggttaatatgtgcaccctgatggcgatcgatctcggagaactgtgtgaggacacaattacctacaaatgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgcccagcggatcgagacctggattctgcgccatcccgggttcacaatcatggctgccattctcgcttacaccgttggaaccacacactttcagagagccctgatcttcattcttctggcggccgtggctcctagcatgacgatgcggtgcatcggcatttccaaccgcgattttgtcgaaggggtgtctggaggcagctgggttgacatcgtgctcgagcacgggtcctgtgtcaccacaatggccaagaataagcccaccctggatttcgaacttatcaaaacagaggctaagcagcctgccaccctgagaaaatattgcattgaagcgaagctcacgaacacaaccaccgagagccggtgtccgacacaaggagagccctctctgaatgaggaacaggacaaacgctttgtgtgcaagcattccatggtggatagaggctggggcaacgggtgtggactgttcggcaaagggggaatcgttacatgcgccatgtttacatgcaaaaagaatatggaaggcaaaattgttcagcctgagaacctcgaatacacgatcgtgattacaccccacagcggggaggagcatgctgtgggaaatgacacaggcaagcacggcaaagaaatcaagatcacccctcagtctcccattacagaggccgaactgaccgggtatggaacggtcaccatggagtgttccccgcggacaggccttgatttcaacgaaatggtgctgctccaaatggaggacaaggcttggctggttcaccgccagtggtttcttgatctgcctctcccctggctgcctggggccgacacccagggaagcaattggatccagaaggagacactggtgaccttcaagaacccccatgccaaaaagcaagacgtcgtggttctcggctctcaggaaggggctatgcacacggcgctgacaggcgccaccgagattcagatgtccagcggaaatcttctgtttacaggccatctcaaatgcagactgcggatggataaacttcaactgaaagggatgtcctactctatgtgtaccggaaagttcaagatcgtgaaagaaattgctgagacccagcacggcacaatcgtcatcagagtgcagtatgagggggacggaagcccctgcaagattcctttcgaaatcatggatctcgagaaacgccatgtcctgggccggctgattacggtgaacccgatcgttaccgaaaaggactcccccgtgaacattgaggccgaacctccctttggggatagctacatcattatcggcgtcgagcctggacagctcaaactgaattggttcaagaagggatcttccatcgggcaaatgtttgagacaaccatgagaggagccaaacgcatggctattcttggcgacacagcctgggatttcgggagcctgggaggcgtgtttacctctatcgggaaggcgctccaccaggttttcggcgctatttacggagccgcctttagcggcgtgtcctggacgatgaaaatcctgattggggtcatcatcacatggattggaatgaactctcggagcacctccctgagcgtgtctcttgtgctcgttggcgtcatcaccctgtatctgggggctatggtgcaggccgactccggatgtgtggtcagctggaagaataaagaactcaagtgcggctctgggattttcatcacagataacgtgcacacctggacagagcagtacaagtttcaacccgaatccccgagcaaactggcttccgccattcagaaggcgcatgaggaaggcatctgtggaatcagatctgttacgcgccttgagaatctgatgtggaaacagattacccctgagctcaaccacatcctgagcgaaaatgaggtgaagctgacaattatgaccggcgacatcaaagggattatgcaggccggaaagcggtcccttagaccccaacctacagaactcaaatattcttggaagacctggggcaaggctaaaatgctgagcacggagtcccataaccagaccttcctgatcgatgggcccgaaacagccgagtgccctaataccaaccgcgcttggaatagcctcgaggtcgaagactacggatttggcgtgttcacaaccaacatctggctgaaacttcgggagaaacaggacgtcttttgtgattctaagctgatgtccgccgcgattaaagacaatagagccgtgcacgctgatatgggctattggatcgaaagcgccctcaacgacacatggaagatggagaaggcttctttcattgaggtcaaatcctgccactggcccaagagccataccctgtggtctaatggggtgctggaaagcgagatgatcattccgaaatccttcgccggacctgttagccagcacaactaccgccccggctattacacgcaaacagccgggccctggcatcttggaaagctcgaaatggattttgacttctgtgagggcaccaccgtggtcgtgacagaagattgcgggaaccggggaccttctctgagaaccacgacagcttccggcaaactgatcaccgagtggtgctgtcggagctgcacactcccgcccctgcgctacagaggcgaggacgggtgttggtatggaatggaaattcggcctcttaaggagaaggaagagaatctggtgaactccctcgtcaccgcgggccacgggcagatcgataatttttctctgggagttctgggcatggcccttttcctcgaagagatgctgagaacacgcgtggggaccaaacatgctatcctgctcgtgacggtcagctttgtgaccctgattacaggaaacatgtccttccgggaccttggcagagttatggtgatggtcggcgccgccatgaccgatgacatcgggatgggagtgacatacctggctctcctggccgcgtttaaggttcgccccaccttcgctgccggcctgcttctgagaaaactcacgtctaaggagctgatgatggccacaattgggatcgctctcctgagccagtccaccattcctgaaacaatccttgagctgaccgatgccctcgcgctgggaatgatggtgctgaaaatcgtccggaatatggaaaagtatcaacttgctgtgaccattatggccatctcttgcgttcccaacgccgtgattctgcagaatgcttggaaggtcagctgtacaatcctcgccgctgtgtccgtgagccctctgctcctgacgtcttcccagcagaaagccgactggattccccttgcgctgaccatcaagggcctcaacccgacagccatctttctgaccacactgagccgcacctctaaaaagagatcctggcctcttaatgaggctattatggccgtcgggatggttagcatcctggcttcttccctcctgaaaaacgacattcccatgacgggacctctcgtggccggcggcctgcttacagtgtgctacgtcctgaccgggcggagcgccgatctggaactcgagcgcgctaccgacgtgaagtgggaggatcaagcggaaatctccggaagctctcccattctgagcatcacaattgccgaggacggctccatgtctatcaaaaatgaagaggaggaacagacccttacaatcctgattagaacggggctcctggttatcagcggactcttcccggtgtccattcctatcaccgctgccgcctggtatctgtgggaggtcaagaagcagcgggctggcgtgctttgggatgttccctctcctccgcccgtggggaaagccgaactggaggacggagcgtaccgcattaagcagaaaggcatcctgggctatagccaaatcggggctggagtctacaaggaaggcacatttcacaccatgtggcacgtgacaagaggggccgtcctcatgcatcggggaaaacgcattgagccttcctgggccgatgtgaagaaggacctgatctcttacggcgggggatggaaacttgagggcgaatggaaggagggcgaagaggttcaggtgctggctctcgaaccggggaaaaaccccagagccgtccagaccaagcctggactgttcaaaacgaataccggcacaattggggcggtgagcctcgatttttcccccggaaccagcggctctcctatcgttgaccggaaggggaaggtggtcggactgtatggcaacggcgtggtgacaagatccggggcttacgttagcgccattgcccagaccgagaaatctatcgaggataatcccgaaatcgaggacgatattttccgcaagaaacggcttacaatcatggacctgcaccctggagctggcaagacgaaaagatatctgccggccattgtccgcgaagctatcaagcgggggctcagaaccctgattcttgcccccacacgcgtggtggcggccgagatggaagaggctctgcggggactccctatcagataccaaacccccgccattcgcgctgagcataccggccgggaaatcgtcgacctgatgtgtcacgccacattcacgatgagactcctgtcccctgtgcgggttcccaactataaccttatcattatggatgaggcccattttaccgacccggctagcatcgcggcccgcgggtacatttccacaagagtggaaatgggcgaggctgccggaatcttcatgaccgccacacctcccggctctcgggatccctttcctcagagcaatgctcccattatggacgaggaacgcgagatccctgaaagatcctggaacagcgggcacgagtgggtcaccgatttcaagggaaaaacggtgtggtttgttccgtctatcaaggccggcaatgacattgcggcttgcctgcggaaaaacgggaagaaagtgatccagctgtccagaaagacattcgatagcgaatatgtcaagacccgcaccaatgactgggattttgtggttacaaccgacatttctgagatgggagccaacttcaaagccgagcgggtgatcgatcccagacgctgtatgaagcctgtcattctcacagacggcgaagaacgggtgatcctggctgggcccatgcctgtgacccacagctccgccgcgcaaagacgcggccggatcggaagaaatcccaaaaacgaaaatgaccagtacatttacatgggcgagccgcttgaaaacgatgaggactgcgcccattggaaggaggctaaaatgctgctcgataatatcaacacgcctgaagggattatcccctctatgtttgagcctgaacgcgagaaggtcgacgccattgatggagaatatagactgcggggcgaggctcgcaaaacattcgttgacctgatgagaagaggggatctccccgtgtggcttgcctaccgcgtggctgccgagggaatcaattatgcggacagacggtggtgttttgatggcgtcaagaacaatcagattctggaagagaacgtggaagttgagatctggaccaaggagggggaacgcaagaagctgaaacctcgctggctcgacgcccggatctacagcgatcccctggctcttaaggagttcaaagagttcgccgctggcagaaagtccctgacactcaacctgattaccgagatgggacgcctgccgacgtttatgacccagaaggcccggaatgccctcgacaaccttgctgtgctgcacacagcggaagccggcgggagagcttataatcatgccctgtctgagctccctgagaccctggaaacacttctgctcctgaccctgctcgccacagtcaccggaggcatcttcctttttctgatgagcgggaaaggagtgggcaagatgacgctgggcatgtgctgcattatcacagcttccattctcctgtggtacgcccaaatccagccccactggatcgcggccagcattatccttgagttctttctgattgttctcctgatccccgaacctgagaaacagcggaccccgcaggataaccaactgacctatgtggtcattgctatcctcacagtggtcgccgctaccatggccaatgaaatggggttccttgagaagaccaagaaggacctgggactgggctctatcgcgacgcaggagcccgaatccaacattctcgacatcgatctgcgccctgccagcgcttggaccctttacgccgtggctacaacctttgttacacccatgctgagacactccattgaaaattctagcgtgaacgtgtccctcaccgccatcgctaatcaggccacggtcctgatggggctgggaaagggctggcctctctctaaaatggacattggggttccccttctggcgatcggatgttacagccaggtgaaccctattaccctgacagccgctctcctgcttctggtggcccattatgctatcatcggcccgggcctccaagccaaggccacccgggaagcgcagaaacgcgctgccgctgggattatgaagaatcccacagtcgatggaatcaccgtgattgacctggatcctatcccctacgaccctaaattcgagaagcagctgggccaggttatgctccttattctgtgcgtgacgcaagtcctgatgatgagaacaacctgggccctctgtgaagccctgacacttgctaccgggcccatctccaccctgtgggagggaaacccgggccggttttggaatacaacgatcgccgtgagcatggcgaacattttccgcgggtcttatctcgccggagctggcctgctgttttccatcatgaagaataccacaaacaccagacggggcacagggaatattggagagaccctcggcgaaaaatggaaaagccgccttaacgccctggggaaatctgagttccagatctacaagaaatccggcattcaggaagtcgatagaacgctggctaaggagggcatcaaaagaggggaaacagaccaccatgccgtgagcagaggatctgcgaagctccgctggtttgttgaacggaacatggtgacccctgagggcaaggtcgtggatctgggctgcgggagaggaggctggagctattactgtgggggacttaaagacgttcgcgaagtgaagggcctgaccaaagggggacccggccacgaggaacccatccctatgtccacatatggctggaatctcgtccggctgcaatctggggtggatgtgttcttcacaccccctgagaagtgcgacaccctgctctgtgatattggagagagctccccgaaccccacgatcgaagccggcagaacccttcgcgttctgagcctggtcgagaattggctcaacaatgacacacagttttgcattaaagtgctgaacccttacatgccctccgtgatcgaaaagatggagacccttcagcggaagtacgggggagctctggtcagaaatcctctctctcgcaacagcacacatgaaatgtattgggtttccaatgccaccggcaacattgtgtctagcgtgaatatgatctcccggatgctgatcaacagattcacgatgaaacacaagaaagctacctacgagcccgacgtcgatctggggtctggaacacgcaatattggcatcgagagcgaaattccgaacctcgacatcattggcaagcggatcgagaaaattaagcaggaacacgagacctcctggcattatgatcaagaccacccttacaagacatgggcctatcatgggagctacgaaaccaaacagacaggatctgcttccagcatggtgaatggcgttgtgagacttctgaccaagccctgggatgtcgtgcctatggttacgcagatggccatgacagacaccaccccctttgggcagcaacgcgtgttcaaagagaaggtcgatacaagaacgcaggagcctaaagaaggaaccaagaagctgatgaaaatcacagcggagtggctctggaaggaactgggcaaaaagaaaacaccccggatgtgtacacgcgaggagtttaccagaaaggtgcggtctaacgccgctcttggggccatcttcacagacgaaaacaaatggaagtccgctagagaggccgtggaagatagccggttttgggagctggtcgacaaggaacgcaatctccacctggagggaaaatgcgagacctgtgtttataacatgatgggcaagagagagaagaagctgggcgagttcgggaaagccaagggatctcgggcgatttggtacatgtggctcggcgctcgctttctggagttcgaggcccttgggtttctgaatgaagatcactggttctccagagagaacagcctctccggagtggagggcgaagggctgcataaacttggctacatcctgcgggacgtgagcaaaaaggagggaggcgccatgtatgctgacgatacggccgggtgggacacccgcattacactcgaagatctgaaaaatgaggaaatggtcaccaaccacatggagggagagcataagaaactggctgaagccatctttaagctcacataccagaataaggtggttagagtgcagcggccgacccctcgcggcacggtcatggacattatctctagacgggatcaacgcgggagcggacaggtgggcacatatgggctgaacaccttcacaaatatggaggcgcagcttatcagacaaatggaaggcgagggagttttcaaatccattcagcggctgaccgtgacggaggaaatcgccgtccagaactggctcgctcgcgtgggcagagagcggctgtctagaatggccattagcggggacgattgcgttgtgaagccccttgacgatcgctttgcttccgccctgaccgcgctcaatgacatgggaaaagtccggaaggatatccagcaatgggaaccctctagaggctggaacgactggacacaggtgcctttctgcagccaccattttcacgagctgattatgaaagatgggcgcgtcctggtggttccgtgtcggaatcaggacgaactcatcggacgggcccgcatctcccagggcgctgggtggtctctgaaggagaccgcctgccttggcaagagctacgctcaaatgtggtccctgatgtatttccaccggagagacctccgcctggccgctaacgccatttgtagcgcggtgccctctcattgggtccctacatcccggaccacatggagcatccacgccaaacatgagtggatgaccacggaagatatgcttacagtgtggaatagagtgtggattcaggagaacccctggatggaagacaagacccctgttgagtcttgggaagaggtgccctacctgggaaaacgcgaggatcagtggtgcggctccctcatcgggctgaccagccgggctacatgggccaagaacattcagaccgccatcaatcaagtcagatccctgattggaaacgaagagtatacagactacatgccttctatgaaacggtttagacgcgaagaggaagaggctggcgtgctctggtga

SEQ ID NO: 20139 - RNA, 9876 nt, synthetic construct
  misc_feature 1..9876: note = derived and/or modified CDS sequence (opt5) from DENV-2__EU482697__SS-prME
  source 1..9876: mol_type = other RNA
agcgccggaatgatcattatgctgatccccaccgtgatggctttccacctgaccacgcggaatggggagcctcatatgattgtcggaatccaggaaaagggcaagagcctgctttttaagaccgaggacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggccaggaaatcaaggtgacccctcaatccagcatcacagaggcggaactgaccgggtatggaacggttaccatggagtgttctcccagaacaggccttgatttcaatgaaatggtgctgctccagatggagaacaaagcctggctggtccaccggcagtggtttcttgacctgccgctcccttggctgcccggggctgataagcaggagtccaattggattcaaaaggaaaccctggtgacattcaaaaaccctcatgccaagaaacaggacgttgtggtcctcggaagccaggagggcgctatgcacaccgccctgacgggggccacagaaatccaaatgtcctctggcaatcttctgtttaccggacatctcaagtgccgcctgagaatggacaaacttcagctgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccaactcaagctgaattggttcaagaaaggaagctctattggccagatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacaatataaatttcagcctgagtccccctctaagctggccagcgccattcagaaagctcaggaagaggggatctgtggcattcggtccgttacaagacttgagaatctgatgtggaagcaaatcacgccggaactcaaccacatcctggccgagaatgaagtgaaactgaccattatgacaggagatatcaagggcattatgcaggctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaagacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaagtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatgaccgatgacatcggcatgggggtgacatatctcgccctgctggccgctttcaaagttcgccctacctttgccgcgggacttctgctccggaagctgacatccaaggagctcatgatgaccacgattggcatcgtgctgctttctcagagcacaattcccgaaaccgtcctggagctcacagatgctctggccctggggatgatggtgcttaaaatcgtgagaaatatggaaaagtaccagctggccgtcaccatcatggctattctctgcgttcctaacgccgtgatcctgcagaatgcgtggaaagtgtcctgtaccattctcgctgtcgtgtctgttagccccctgcttctgacatccagccaacagaagacggactggatccctctcgccctgaccattaaaggactgaaccccacagccatcttccttaccacactgtctcgcaccaataagaaaagatcctggccgctcaacgaggctatcatggccgtgggcatggtcagcattctggcttcttccctcctgaagaatgacatccctatgacggggccccttgtggccggaggcctgctgacagtttgctatgtgctcaccggccggagcgcggatctggaacttgagcgcgccaccgacgtcaagtgggaggatcaggctgaaatttctgggtccagccctatcctgtccattacaatcagcgaggacggatctatgagcattaaaaacgaagaggaggaacagaccctcacaatcctgatcagaacgggcctcctggtgatttccgggctttttcccatctctattccgatcaccgccgctgcctggtacctgtgggaggtcaagaaacaacgggccggagtgctgtgggatgttccttctccccctcccatgggcaaggctgaactcgaggacggggcgtatcgcattaaacagaagggaatcctgggctactcccagatcggcgccggggtgtacagagaaggaacattccacaccatgtggcatgtcacacggggcgctgtgcttatgcacaaggggaaacgcattgagccctcctgggccgatgttaagaaagacctgatcagctatggaggcgggtggaagctcgagggagaatggaaagagggcgaagaggtgcaggtcctggccctcgaacctggcaagaatccgagagctgtgcaaaccaagcccgggctgtttaaaacgaacaccggaacaattggcgccgtgtcccttgatttctctcctgggaccagcggatcccccatcattgacaagaaaggcaaggttgtcgggctgtacggaaacggcgtggtgacacggagcggcgcgtatgtctctgctatcgcccagaccgagaaatccatcgaggataatcctgaaattgaggacgatatctttcgcaagagacggctgacaattatggacctccaccccggggccggaaagacgaaaagatacctgcctgctatcgtgcgcgaagccattaagcggggccttagaaccctgatcctcgcgccgacacgcgttgtggctgccgagatggaagaggccctgcgggggctccccattagatatcagacccctgctatccgcgccgagcataccggacgggaaatcgtcgacctgatgtgtcacgctacattcacgatgagacttctgagccccgtgcgcgttcctaactacaatctgattatcatggatgaggcccatttcaccgaccccgcgtctattgccgctcggggctatatctccacaagagtggaaatgggggaggccgctggcatttttatgaccgccacaccgcctggaagccgggatcccttcccccaatccaacgcccctatcatcgacgaggaacgcgagattcccgaaagatcttggaatagcggccacgagtgggtcaccgattttaaagggaagacggtgtggttcgttccttccatcaaagctggaaacgacattgcggcctgcctccggaagaatggcaagaaagtgatccagctgagccgcaagacatttgattctgaatacgtcaaaaccagaaccaacgactgggatttcgtggtgacaaccgacatttccgagatgggggctaattttaaggccgagcgggtcatcgatccgagacgctgtatgaaacccgttatccttacagacggagaggaacgggtgattctggccggccctatgcccgtgacccatagctctgctgcccagagacgcgggcggatcggcagaaaccctaagaatgaaaacgaccagtacatttatatgggagagcccctcgaaaatgatgaggactgcgcgcactggaaagaggctaagatgctgctggataacatcaatacgccggaaggcattatccctagcatgttcgagcccgaacgcgagaaggtcgacgccattgatggggaataccggctcagaggagaggcccgcaaaacatttgtggaccttatgagacggggcgatctgcctgtttggctggcttataaggtggccgcggaggggatcaactacgccgaccgcagatggtgtttcgatggaatcaaaaacaatcaaattctcgaagagaacgtcgaagtggagatctggaccaaggagggcgaacggaaaaagctgaagccccgctggcttgacgctagaatttattccgatcctctggccctcaaagagtttaaggagttcgctgccgggcggaaatctctgacactgaatctcatcaccgagatgggcagacttcccacgttcatgacccagaagacacgcgacgctctggataacctggccgttctccacaccgcggaagccggaggccgggcttacaatcatgccctgagcgagcttccggagacactggaaaccctcctgctgctcacacttctggctaccgtgacagggggaatttttctgttcctcatgtccggcagagggatcggaaaaatgacactgggcatgtgctgcatcattaccgcctctatccttctgtggtatgcccagattcagcctcactggatcgctgcgagcattatcctcgagtttttcctgatcgtcctgctcattcccgaacccgagaagcaacgcacccctcaggacaaccagcttacatacgtggtcatcgccattctgaccgtggttgctgccacaatggccaatgaaatgggctttctggagaagacgaaaaaggacctcgggctgggatccatcgctacccagcaaccggagagcaacattcttgatatcgacctgcggcccgcctctgcgtggacactctacgccgtggctaccacattcgtgacccctatgctgagacattccattgaaaatagctccgtcaacgtttctctgacggccatcgctaatcaggccaccgtgctcatgggccttgggaaaggatggcccctgagcaagatggatatcggcgtgcctctgctcgcgattgggtgttattcccaggtcaaccccatcacactgaccgccgcccttctgctcctggtggcccactacgctattatcggacctggcctgcaggccaaagctacacgggaggcccaaaagcgcgcggccgctggcattatgaagaatccgaccgttgacgggatcacggtgatcgatctcgaccccattccttatgatcccaaatttgaaaagcagcttggacaggtcatgctgctgatcctctgcgtgacacaagtcctgatgatgagaaccacatgggccctttgtgaggctctgaccctcgccaccggccctatttctacactgtgggaagggaaccccggacggttctggaatacgaccatcgccgtgagcatggcgaacatttttcgcggctcctacctggctggggccggactccttttcagcatcatgaaaaatacaaccaacacaagacggggcaccggcaacatgggggagacgctgggagagaagtggaaatctcgcctgaatgctctcggcaagtccgaatttcagatctataaaaagagcgggattcaggaggttgacagaacactggccaaggaaggaatcaaacggggcgagaccgatcaccatgccgtgtctcgcgggtccgctaaacttagatggttcgtcgagcggaacatggtgaccccggaaggaaaagttgtggacctgggctgcggcagagggggatggagctactattgtggcgggctcaagaatgtccgcgaggtgaaaggactgacaaagggcgggcctggacacgaagaacccattcccatgtctacctacggctggaacctggtgcggctccagagcggcgttgatgtctttttcatccctcccgaaaagtgcgacacacttctgtgtgatattggggagtcctctcctaatccgacggtggaggccggaagaaccctgcgcgtgctcaacctggtcgaaaattggcttaacaataacacacaattctgcatcaaagttctgaatccctacatgcctagcgtgatcgagaagatggaagcgctccagcggaaatatggcggggccctggtgagaaaccccctgtcccgcaatagcacccatgagatgtactgggtctccaacgcttctggaaatattgtgagctccgttaacatgatctctcggatgctcattaacagatttacaatgcgccacaagaaagccacctatgaacctgacgtggaccttggcagcgggacgcggaatatcggaaccgagtccgagattcccaacctggatatcattggcaagagaatcgaaaagatcaaacaggagcatgaaacatcttggcactacgaccaggatcacccgtataagacctgggcttaccatggcagctatgagacaaaacaaaccgggtccgccagctctatggtcaatggagtggttcgcctgctcacaaagccttgggacgtgctgcccatggtcacccagatggcgatgacggatacaacccctttcggccagcagcgggtgtttaaagaaaaggtggacaccagaacacaagagcccaaggaggggacgaagaaacttatgaaaattaccgccgaatggctgtggaaagagctcggcaagaagaaaacacctcgcatgtgtaccagagaagagttcacacggaaggtccgctccaacgctgccctgggcgctatctttaccgatgagaataagtggaaaagcgccagagaagctgttgaggactctcggttctgggaactggtggataaggagagaaactttcacctcgaagggaaatgcgagacatgtgtgtacaatatgatgggaaagcgggagaaaaagctgggcgagttcggcaaggccaaagggtcccgcgcgatttggtacatgtggcttggagccagatttctggagttcgaagctctcggctttctgaacgaggaccattggttcagccgggaaaattctctttccggggtcgagggagagggcctgcacaagctcgggtatatcctgcgcgatgtgagcaaaaaggaaggcggagccatgtacgctgacgacaccgccggctgggatacgagaattaccctggaggacctcaaaaacgaagagatggttacaaatcacatggaaggggagcataagaagctggccgaggcgatctttaaacttacctatcagaacaaggtggtccgggtgcagcgccccacaccgagaggaaccgttatggatatcatttcccggcgcgaccaaagaggcagcgggcaggtcggaacgtacggcctgaatacattcaccaacatggaagctcagctcatccggcagatggagggggaaggcgtcttcaaaaatattcaacacctgacagtgaccgaggaggttgccgtgaagaactggcttgcccgcgtcggaagagaacggctgtctcgcatggctatcagcggcgatgactgcgtggtcaaacctctcgatgacagatttgccaacgctctgacggccctgaatgatatggggaagattcggaaggacatccagcagtgggagccctccaaaggatggaacgattggacccaggtgcccttctgctctcatcactttcatgaactcatcatgaaggacggcagagttctggtggtcccttgtcgcaatcaagatgagcttattgggcgggcgagaatcagccagggagccggctggtccctgcgcgaaacagcttgcctcgggaaatcttatgcccagatgtggagcctgatgtacttccaccggagagaccttcgcctggctgccaacgcgatttgttccgccgtgccgtctcactgggtgcccaccagccggacaacctggtccatccatgctaagcacgagtggatgacaaccgaggacatgctcacggtttggaatagagtgtggattcgcgaaaacccttggatggaggataaaacacccgtcgaaagctgggaggaaatcccttatctgggcaagcgggaggaccagtggtgcggatctctgattggcctcacctccagagccacctgggctaagaatatccaagccgctatcaaccaggtgcgcagcctgattgggaatgaggaatacacagattacatgccctctatgaaacggtttagacgggaggaagaggaagccggagttctttggtga

SEQ ID NO: 20140 - RNA, 9876 nt, synthetic construct
  misc_feature 1..9876: note = derived and/or modified CDS sequence (opt5) from DENV-2__EU482699__SS-prME
  source 1..9876: mol_type = other RNA
agcgccggcatgatcattatgctgatccccacagtgatggctttccacctgacgacgcggaatggggaacctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggctaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagccataaccagacgttcctgatcgacggccctgagaccgcggagtgccccaatacaaacagagcctggaactctctcgaagtcgaggattatgggtttggagtgttcaccacaaacatttggctgcgccttaaggaaaaacaggacgctttttgtgactccaagctgatgagcgccgctatcaaggataatcgggccgttcacgcggacatgggctactggatcgagtctgccctcaacgatacctggaaaattgagaaggcttccttcatcgaagtgaaaaattgccattggcctaagagccacacactgtggtctaacggcgtcctggagagcgaaatgattatccccaaaaaccttgccgggccggtgtcccaacacaattatagacctggataccatacccagattgctggcccctggcacctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtaccgcggcgaggacggctgttggtatgggatggaaatcagacccctgaaagagaaggaagagaatctcgttaacagcctggtgaccgccggacatggccaggtggataatttctccctggggatccttggaatggctctctttctggaagagatgctgcggacaagagtcggcaccaaacacgcgattctcctggccgctgtgtctttcgttacacttatcaccgggaacatgagctttaaggacctgggacgcgtgatggtcatggtgggcgccacgatggccgatgacattggcatgggggttacctacctcgctctgctggccgcgttcaaagtgcggcctacatttgctgccggacttctgctcagacgcctgacctccaaggagctcatgatgacaaccatcggcattgtcctgctttctcaaagcacgatccccgaaacagtgctggagctcaccgatgccctggctctggggatgatggttcttaagatcgtgagaaaaatggaaaagtatcagctggccgtcacaattatggcgatcctctgcgtgcctaatgctgtgattctgcagaacgcctggaaagtctcctgtaccatcctcgccgttgtgtctgtgagccccctgcttctgacctccagccagcaaaagacagactggattcctctcgctctgacgatcaaaggactgaatcccaccgccatcttccttacaaccctgtctcggacaaacaagaaacgctcctggccgctcaatgaggctattatggccgtcggcatggtgagcatcctggcgtcttccctcctgaagaacgacattcctatgaccgggccccttgttgccggaggcctgctgacggtgtgctacgtcctcacaggcagaagcgctgatctggaacttgagcgggccaccgacgtgaagtgggaggatcaggctgaaatctctgggtccagccctattctgtccatcaccattagcgaggacggatctatgagcatcaaaaatgaagaggaggaacagacactcaccatcctgattcgcacaggcctcctggttatctccgggctttttcccatttctatcccgattacggccgccgcttggtatctgtgggaggtgaagaaacagagagcgggagtcctgtgggatgtgccttctccccctcccgtcggcaaggccgaactcgaggacggggcttaccggatcaaacaaaagggaatcctgggctattcccagattggcgccggggtgtacaaggaaggaaccttccatacaatgtggcacgttacccgcggcgccgtgcttatgcacaaagggaagagaatcgagccctcctgggctgatgtcaaaaaggacctgattagctacggaggcgggtggaaactcgagggagaatggaaggagggcgaagaggtgcaggttctggccctcgaacctggcaagaacccgcgggcggtgcagacaaaacccgggctgtttaagaccaatacgggaaccatcggcgctgtctcccttgatttctctcctgggacaagcggatcccccattatcgacaaaaagggcaaagtggtggggctgtatggaaacggcgttgtcacccgcagcggcgcctacgtgtctgccatcgctcaaacagagaagtccattgaggataaccctgaaatcgaggacgatatttttagaaagcggagactgaccatcatggacctccatcccggggccggaaaaacaaagcgctatctgcctgcgattgtgcgggaagctatcaaaagaggccttcgcacgctgattctcgccccgacccgggtcgtggccgctgagatggaagaggccctgagagggctccccatccgctaccagacccctgctatccgggccgagcacaccggaagagaaattgttgacctgatgtgtcatgcgaccttcacaatgcgccttctgagccccgtgcgggtccctaattataacctgatcattatggatgaggcccacttcacggaccccgcttctatcgccgctagaggctacatttccacccgggtggaaatgggggaggccgccggcatctttatgacagctaccccgcctggaagccgcgatcccttcccccagtccaatgcgcctatcattgacgaggaaagagagatccccgaacggtcttggaacagcggccatgagtgggttacagattttaaggggaaaaccgtgtggttcgtcccttccattaaggccggaaatgacatcgctgcctgcctccgcaagaacggcaaaaaggtgattcaactgagcagaaaaacgtttgattctgaatatgttaagacacggaccaatgactgggatttcgtggtcaccacagacatctccgagatgggggccaactttaaagctgagagagtgatcgatccgcgccggtgtatgaagcccgtgattcttaccgacggagaagagagagtcatcctggccggccctatgcccgttacacacagctctgcggctcagcgccgggggagaattggccgcaatcctaaaaacgaaaatgaccagtacatctacatgggagagcccctcgaaaacgatgaggactgcgcccactggaaggaggccaagatgctgctggataatattaacaccccggaaggcatcattcctagcatgttcgagcccgaacgggagaaagtggacgctatcgatggggaatatagactccgcggagaggccagaaagacgtttgtggaccttatgcggcgcggcgatctgcctgtctggctggcgtacaaagtggccgctgaggggatcaattatgccgacagacggtggtgtttcgatggaattaagaacaaccagatcctcgaagagaatgttgaagtggagatttggacaaaaggcggggagaagaagaaactgaagccccgctggcttgacgctagaatctactccgatcctctggccctcaaagaatttaaggagttcgctgccggccggaaatctctgaccctgaacctcattacagaaatgggaagacttcccaccttcatgacgcaaaagacccgcgacgcgctggataatctggccgtcctccatacagctgaggccggcgggcgggcttataaccacgccctgagcgaacttccggagaccctggagacactcctgctgctcacccttctggccacagtgaccggaggcatctttctgttcctcatgtccgggagaggaatcggcaagatgacgctgggcatgtgctgcattatcacagcttctattcttctgtggtacgcgcagatccagcctcattggattgccgctagcatcatcctcgaatttttcctgattgttctgctcatccccgagcccgaaaaacagcgcacccctcaagacaatcagcttacctatgtggtcattgccatcctgacagtggtcgccgctaccatggccaacgagatggggtttctggaaaagaccaagaaggacctcggactgggctccattgcgacgcagcagccggagagcaatatccttgatattgacctgcggcccgcctctgcttggaccctctacgccgtggctacaaccttcgttacacctatgctgagacactccatcgagaacagctccgtgaatgtgtctctgaccgccatcgcgaaccaagccacggtcctcatggggcttggaaaaggctggcccctgagcaagatggatattggggttcctctgctcgctatcggatgttactcccaggtgaatcccattaccctgacagccgcccttctgctcctggtggcccactatgctatcattggccctggcctgcaggccaaggcgacccgggaagcccagaaacgcgctgccgctgggatcatgaagaacccgacagtcgacggaatcaccgtgattgatctcgaccccatcccttacgatcccaaatttgagaagcaacttggccaggttatgctgctgattctctgcgtgacgcaggtcctgatgatgagaacaacctgggccctttgtgaagccctgacactcgcgaccgggcctatctctaccctgtgggagggaaatcccggccggttctggaacacaacgattgctgtgagcatggccaatatctttcgcgggtcctatctggctggagccggcctccttttcagcatcatgaaaaacaccacaaataccagacggggcacagggaacatgggagaaaccctgggcgagaagtggaaatctcgcctgaacgccctcgggaagtccgagtttcaaatttacaagaaaagcggaatccaggaagtcgacagaacgctggctaaggagggcattaaaagaggggaaacagatcatcacgccgtgtctcgcggatccgcgaaacttagatggttcgttgagcggaatatggtgaccccggagggcaaagtcgtggacctgggctgcgggagaggaggctggagctattactgtgggggactcaagaacgttcgcgaagtgaagggcctgaccaaagggggacctggccatgaggaacccatccccatgtctacatatggctggaatctggtccggctccagagcggggtggatgtgtttttcattcctcccgagaagtgcgacacccttctgtgtgatatcggagaatcctctcctaacccgacagttgaggccggcagaacgctgcgcgtcctcaatctggtggagaactggcttaataacaatacccagttctgcatcaaagtgctgaacccctacatgcctagcgtcattgaaaagatggaggctctccaacggaaatacgggggagccctggttagaaatcccctgtcccgcaacagcacacacgaaatgtattgggtgtccaatgcttctggcaacatcgtgagctccgtcaatatgatttctcggatgctcatcaacagatttaccatgcgccataagaaggccacatacgagcctgacgtggaccttgggagcggaacccggaacattggcatcgaatccgagattcccaatctggatatcatcggcaaaagaattgagaagatcaaacaggaacacgagacgtcttggcactatgaccaggatcatccgtacaagacctgggcgtatcacgggagctacgaaacaaaacagaccggatccgccagctctatggttaacggcgtggtccgcctgctcacaaagccttgggacgtgctgcccaccgttacacaaatggctatgaccgatacgacacctttcgggcagcagcgggtgtttaaggagaaagtcgacaccagaacccaggaacccaaggagggaaccaagaaacttatgaaaattacggccgagtggctgtggaaggaactcggcaaaaagaagacccctcgcatgtgtacaagagaggagttcacccggaaagtgcgctccaatgctgccctgggggctatctttacagatgagaacaagtggaaaagcgccagagaggcggtggaagactctcggttctgggagctggtcgataaggaaagaaatctccatctggagggaaaatgcgaaacctgtgtttataacatgatgggcaagcgggagaagaaacttggcgagtttgggaaggccaaaggatcccgcgctatttggtacatgtggctgggcgccagattcctcgaatttgaggctctggggttccttaatgaagaccactggtttagccgggagaactctctgtccggagtggaaggcgaggggctccacaagctgggctacatcctgcgcgatgtgagcaaaaaggagggaggcgccatgtatgccgacgacacagcggggtgggataccagaatcacgctcgaagacctgaagaatgaggaaatggtcaccaaccatatggagggagaacacaagaaacttgctgaggccattttcaaactgacataccaaaataaagtggttcgggtgcagcgccccaccccgagaggcacagtcatggatatcatttcccggcgcgaccagagagggagcggacaagtgggcacctatgggctcaacacgtttacaaatatggaggcccagctgatccggcagatggaaggcgagggagttttcaaaaacattcagcatcttaccgtgacagaagaggtcgctgtgcaaaattggctggcccgcgttggcagagagcggctctctcgcatggctatcagcggggatgactgcgtggtcaagcctctggatgacagattcgccaacgcgctgaccgccctcaacgatatgggaaagatccggaaagacattcagcagtgggaaccctccaagggctggaatgattggacacaggtgcccttttgctctcaccatttccacgagctgatcatgaaagacgggagagtccttgtggttccttgtcgcaaccaagatgaactgattggacgggctagaatcagccagggcgccgggtggtccctccgcgagaccgcttgcctgggcaagtcttacgcccagatgtggagccttatgtattttcaccggagagacctgcgcctcgcggccaatgctatttgttccgccgtgccgtctcattgggtccccacaagccggaccacatggtccatccacgctaaacatgaatggatgaccacagaggacatgctgaccgtgtggaacagagtgtggattcgcgagaatccttggatggaagataagacgcccgttgagagctgggaagagatcccttacctgggaaagcgggaagaccagtggtgcggctctctcatcgggctgacatccagagccacctgggctaaaaacattcaagccgcgatcaatcaggtgcgcagccttattggaaacgaggagtataccgattacatgccctctatgaagcggttcagacgggaagaggaagaggccggcgtcctgtggtga
